United States Patent 9,675,668 (MODIFIED POLYNUCLEOTIDES ENCODING HEPATITIS A VIRUS CELLULAR RECEPTOR 2) - sequence listing, part 10

SEQ ID NO: 17921 - DNA, 2940 bp, Artificial Sequence
  Description of Artificial Sequence: Synthetic coding sequence
atgagaggctaccacggcgacagaggcagccaccccagacccgccagattcgccgaccagcagcacatggacgtgggccccgccgccagagccccctacctgctgggcagcagagaggccttcagcaccgagcccagattctgcgcccccagagccggcctgggccacatcagccccgagggccccctgagcctgagcgagggccccagcgtgggccccgagggcggccccgccggcgccggcgtgggcggcggcagcagcaccttccccagaatgtaccccggccagggccccttcgacacctgcgaggactgcgtgggccacccccagggcaagggcgcccccagactgccccccaccctgctggaccagttcgagaagcagctgcccgtgcagcaggacggcttccacaccctgccctaccagagaggccccgccggcgccggccccggccccgcccccggcaccggcaccgcccccgagcccagaagcgagagccccagcagaatcagacacctggtgcacagcgtgcagaagctgttcgccaagagccacagcctggaggcccccggcaagagagactacaacggccccaaggccgagggcagaggcggcagcggcggcgacagctaccccggccccggcagcggcggcccccacaccagccaccaccaccaccaccaccaccaccaccaccaccaccagagcagacacggcaagagaagcaagagcaaggacagaaagggcgacggcagacaccaggccaagagcaccggctggtggagcagcgacgacaacctggacagcgacagcggcttcctggccggcggcagaccccccggcgagcccggcggccccttctgcctggagggccccgacggcagctacagagacctgagcttcaagggcagaagcggcggcagcgagggcagatgcctggcctgcaccggcatgagcatgagcctggacggccagagcgtgaagagaagcgcctggcacaccatgatggtgagccagggcagagacggctaccccggcgccggccccggcaagggcctgctgggccccgagaccaaggccaaggccagaacctaccactacctgcaggtgccccaggacgactggggcggctaccccaccggcggcaaggacggcgagatcccctgcagaagaatgagaagcggcagctacatcaaggccatgggcgacgaggagagcggcgacagcgacggcagccccaagaccagccccaaggccgtggccagaagattcaccaccagaagaagcagcagcgtggaccaggccagaatcaactgctgcgtgccccccagaatccaccccagaagcagcatccccggctacagcagaagcctgaccaccggccagctgagcgacgagctgaaccagcagctggaggccgtgtgcggcagcgtgttcggcgagctggagagccaggccgtggacgccctggacctgcccggctgcttcagaatgagaagccacagctacctgagagccatccaggccggctgcagccaggacgacgactgcctgcccctgctggccacccccgccgccgtgagcggcagacccggcagcagcttcaacttcagaaaggcccccccccccatcccccccggcagccaggccccccccagaatcagcatcaccgcccagagcagcaccgacagcgcccacgagagcttcaccgccgccgagggccccgccagaagatgcagcagcgccgacggcctggacggccccgccatgggcgccagaaccctggagctggcccccgtgccccccagagccagccccaagccccccaccctgatcatcaagaccatccccggcagagaggagctgagaagcctggccagacagagaaagtggagacccagcatcggcgtgcaggtggagaccatcagcgacagcgacaccgagaacagaagcagaagagagttccacagcatcggcgtgcaggtggaggaggacaagagaagagccagattcaagagaagcaacagcgtgaccgccggcgtgcaggccgacctggagctggagggcctggccggcctggccaccgtggccaccgaggacaaggccctgcagttcggcagaagcttccagagacacgccagcgagccccagcccggccccagagcccccacctacagcgtgttcagaaccgtgcacacccagggccagtgggcctacagagagggctaccccctgccctacgagccccccgccaccgacggcagccccggccccgcccccgcccccacccccggccccggcgccggcagaagagacagctggatcgagagaggcagcagaagcctgcccgacagcggcagagccagcccctgccccagagacggcgagtggttcatcaagatgctgagagccgaggtggagaagctggagcactggtgccagcagatggagagagaggccgaggactacgagctgcccgaggagatcctggagaagatcagaagcgccgtgggcagcacccagctgctgctgagccagaaggtgcagcagttcttcagactgtgccagcagagcatggaccccaccgccttccccgtgcccaccttccaggacctggccggcttctgggacctgctgcagctgagcatcgaggacgtgaccctgaagttcctggagctgcagcagctgaaggccaacagctggaagctgctggagcccaaggaggagaagaaggtgcccccccccatccccaagaagcccctgagaggcagaggcgtgcccgtgaaggagagaagcctggacagcgtggacagacagagacaggaggccagaaagagactgctggccgccaagagagccgccagcttcagacacagcagcgccaccgagagcgccgacagcatcgagatctacatccccgaggcccagaccagactgtag

SEQ ID NO: 17922 - DNA, 798 bp, Artificial Sequence
  Description of Artificial Sequence: Synthetic coding sequence
atgagcatgagcctggacggccagagcgtgaagagaagcgcctggcacaccatgatggtgagccagggcagagacggctaccccggcgccggccccggcaagggcctgctgggccccgagaccaaggccaaggccagaacctaccactacctgcaggtgccccaggacgactggggcggctaccccaccggcggcaaggacggcgagatcccctgcagaagaatgagaagcggcagctacatcaaggccatgggcgacgaggagagcggcgacagcgacggcagccccaagaccagccccaaggccgtggccagaagattcaccaccagaagaagcagcagcgtggaccaggccagaatcaactgctgcgtgccccccagaatccaccccagaagcagcatccccggctacagcagaagcctgaccaccggccagctgagcgacgagctgaaccagcagatggagagagaggccgaggactacgagctgcccgaggagatcctggagaagatcagaagcgccgtgggcagcacccagctgctgctgagccagaaggtgcagcagttcttcagactgtgccagcagagcatggaccccaccgccttccccgtgcccaccttccaggacctggccggcttctgggacctgctgcagctgagcatcgaggacgtgaccctgaagttcctggagctgcagcagctgaaggccaacagctggaagctgctggagcccaaggaggagaagaaggtgcccccccccatccccaccagaccccccggccccagccacagcagatag

SEQ ID NO: 17923 - DNA, 2211 bp, Artificial Sequence
  Description of Artificial Sequence: Synthetic coding sequence
atggccggcagcagcaccggcggcggcggcgtgggcgagaccaaggtgatctaccacctggacgaggaggagaccccctacctggtgaagatccccgtgcccgccgagagaatcaccctgggcgacttcaagagcgtgctgcagagacccgccggcgccaagtacttcttcaagagcatggaccaggacttcggcgtggtgaaggaggagatcagcgacgacaacgccagactgccctgcttcaacggcagagtggtgagctggctggtgagcagcgacaacccccagcccgagatggccccccccgtgcacgagcccagagccgagctggccccccccgccccccccctgccccccctgccccccgagagaaccagcggcatcggcgacagcagaccccccagcttccaccccaacgtgagcagcagccacgagaacctggagcccgagaccgagaccgagagcgtggtgagcctgagaagagagagacccagaagaagagacagcagcgagcacggcgccggcggccacagaaccggcggccccagcagactggagagacacctggccggctacgagagcagcagcaccctgatgaccagcgagctggagagcaccagcctgggcgacagcgacgaggaggacaccatgagcagattcagcagcagcaccgagcagagcagcgccagcagactgctgaagagacacagaagaagaagaaagcagagaccccccagactggagagaaccagcagcttcagcagcgtgaccgacagcaccatgagcctgaacatcatcaccgtgaccctgaacatggagaagtacaacttcctgggcatcagcatcgtgggccagagcaacgagagaggcgacggcggcatctacatcggcagcatcatgaagggcggcgccgtggccgccgacggcagaatcgagcccggcgacatgctgctgcaggtgaacgacatgaacttcgagaacatgagcaacgacgacgccgtgagagtgctgagagacatcgtgcacaagcccggccccatcgtgctgaccgtggccaagtgctgggaccccagcccccaggcctacttcaccctgcccagaaacgagcccatccagcccatcgaccccgccgcctgggtgagccacagcgccgccctgaccggcaccttccccgcctaccccggcagcagcagcatgagcaccatcaccagcggcagcagcctgcccgacggctgcgagggcagaggcctgagcgtgcacaccgacatggccagcgtgaccaaggccatggccgcccccgagagcggcctggaggtgagagacagaatgtggctgaagatcaccatccccaacgccttcctgggcagcgacgtggtggactggctgtaccaccacgtggagggcttccccgagagaagagaggccagaaagtacgccagcggcctgctgaaggccggcctgatcagacacaccgtgaacaagatcaccttcagcgagcagtgctactacgtgttcggcgacctgagcggcggctgcgagagctacctggtgaacctgagcctgaacgacaacgacggcagcagcggcgccagcgaccaggacaccctggcccccctgcccggcgccaccccctggcccctgctgcccaccttcagctaccagtaccccgccccccacccctacagcccccagccccccccctaccacgagctgagcagctacacctacggcggcggcagcgccagcagccagcacagcgagggcagcagaagcagcggcagcaccagaagcgacggcggcgccggcagaaccggcagacccgaggagagagcccccgagagcaagagcggcagcggcagcgagagcgagcccagcagcagaggcggcagcctgagaagaggcggcgaggccagcggcaccagcgacggcggccccccccccagcagaggcagcaccggcggcgcccccaacctgagagcccaccccggcctgcacccctacggccccccccccggcatggccctgccctacaaccccatgatggtggtgatgatgccccccccccccccccccgtgccccccgccgtgcagccccccggcgccccccccgtgagagacctgggcagcgtgccccccgagctgaccgccagcagacagagcttccacatggccatgggcaaccccagcgagttcttcgtggacgtgatgtag

SEQ ID NO: 17924 - DNA, 4575 bp, Artificial Sequence
  Description of Artificial Sequence: Synthetic coding sequence
atggccatgagcaacggcaacaacgacttcgtggtgctgagcaacagcagcatcgccaccagcgccgccaaccccagccccctgaccccctgcgacggcgaccacgccgcccagcagctgacccccaaggaggccaccagaaccaaggtgagccccaacggctgcctgcagctgaacggcaccgtgaagagcagcttcctgcccctggacaaccagagaatgccccagatgctgccccagtgctgccacccctgcccctaccaccaccccctgaccagccacagcagccaccaggagtgccaccccgaggccggccccgccgcccccagcgccctggccagctgctgcatgcagccccacagcgagtacagcgccagcctgtgccccaaccacagccccgtgtaccagaccacctgctgcctgcagcccagccccagcttctgcctgcaccacccctggcccgaccacttccagcaccagcccgtgcagcagcacatcgccaacatcagacccagcagacccttcaagctgcccaagagctacgccgccctgatcgccgactggcccgtggtggtgctgggcatgtgcaccatgttcatcgtggtgtgcgccctggtgggcgtgctggtgcccgagctgcccgacttcagcgaccccctgctgggcttcgagcccagaggcaccgccatcggccagagactggtgacctggaacaacatggtgaagaacaccggctacaaggccaccctggccaactaccccttcaagtacgccgacgagcaggccaagagccacagagacgacagatggagcgacgaccactacgagagagagaagagagaggtggactggaacttccacaaggacagcttcttctgcgacgtgcccagcgacagatacagcagagtggtgttcaccagcagcggcggcgagaccctgtggaacctgcccgccatcaagagcatgtgcaacgtggacaacagcagaatcagaagccacccccagttcggcgacctgtgccagagaaccaccgccgccagctgctgccccagctggaccctgggcaactacatcgccatcctgaacaacagaagcagctgccagaagatcgtggagagagacgtgagccacaccctgaagctgctgagaacctgcgccaagcactaccagaacggcaccctgggccccgactgctgggacatggccgccagaagaaaggaccagctgaagtgcaccaacgtgcccagaaagtgcaccaagtacaacgccgtgtaccagatcctgcactacctggtggacaaggacttcatgacccccaagaccgccgactacgccacccccgccctgaagtacagcatgctgttcagccccaccgagaagggcgagagcatgatgaacatctacctggacaacttcgagaactggaacagcagcgacggcgtgaccaccatcaccggcatcgagttcggcatcaagcacagcctgttccaggactacctgctgatggacaccgtgtaccccgccatcgccatcgtgatcgtgctgctggtgatgtgcgtgtacaccaagagcatgttcatcaccctgatgaccatgttcgccatcatcagcagcctgatcgtgagctacttcctgtacagagtggtgttccacttcgagttcttccccttcatgaacctgaccgccctgatcatcctggtgggcatcggcgccgacgacgccttcgtgctgtgcgacgtgtggaactacaccaagttcgacaagccccacgccgagaccagcgagaccgtgagcatcaccctgcagcacgccgccctgagcatgttcgtgaccagcttcaccaccgccgccgccttctacgccaactacgtgagcaacatcaccgccatcagatgcttcggcgtgtacgccggcaccgccatcctggtgaactacgtgctgatggtgacctggctgcccgccgtggtggtgctgcacgagagatacctgctgaacatcttcacctgcttcaagaagccccagcagcagatctacgacaacaagagctgctggaccgtggcctgccagaagtgccacaaggtgctgttcgccatcagcgaggccagcagaatcttcttcgagaaggtgctgccctgcatcgtgatcaagttcagatacctgtggctgttctggttcctggccctgaccgtgggcggcgcctacatcgtgtgcatcaaccccaagatgaagctgcccagcctggagctgagcgagttccaggtgttcagaagcagccaccccttcgagagatacgacgccgagtacaagaagctgttcatgttcgagagagtgcaccacggcgaggagctgcacatgcccatcaccgtgatctggggcgtgagccccgaggacaacggcaaccccctgaaccccaagagcaagggcaagctgaccctggacagcagcttcaacatcgccagccccgccagccaggcctggatcctgcacttctgccagaagctgagaaaccagaccttcttctaccagaccgacgagcaggacttcaccagctgcttcatcgagaccttcaagcagtggatggagaaccaggactgcgacgagcccgccctgtacccctgctgcagccactggagcttcccctacaagcaggagatcttcgagctgtgcatcaagagagccatcatggagctggagagaagcaccggctaccacctggacagcaagacccccggccccagattcgacatcaacgacaccatcagagccgtggtgctggagttccagagcacctacctgttcaccctggcctacgagaagatgcaccagttctacaaggaggtggacagctggatcagcagcgagctgagcagcgcccccgagggcctgagcaacggctggttcgtgagcaacctggagttctacgacctgcaggacagcctgagcgacggcaccctgatcgccatgggcctgagcgtggccgtggccttcagcgtgatgctgctgaccacctggaacatcatcatcagcctgtacgccatcatcagcatcgccggcaccatcttcgtgaccgtgggcagcctggtgctgctgggctgggagctgaacgtgctggagagcgtgaccatcagcgtggccgtgggcctgagcgtggacttcgccgtgcactacggcgtggcctacagactggcccccgaccccgacagagagggcaaggtgatcttcagcctgagcagagtgggcagcgccatggccatggccgccctgaccaccttcgtggccggcgccatgatgatgcccagcaccgtgctggcctacacccagctgggcaccttcatgatgctgatcatgtgcatcagctgggccttcgccaccttcttcttccagtgcatgtgcagatgcctgggcccccagggcacctgcggccagatccccctgcccaagaagctgcagtgcagcgccttcagccacgccctgagcaccagccccagcgacaagggccagagcaagacccacaccatcaacgcctaccacctggaccccagaggccccaagagcgagctggagcacgagttctacgagctggagcccctggccagccacagctgcaccgcccccgagaagaccacctacgaggagacccacatctgcagcgagttcttcaacagccaggccaagaacctgggcatgcccgtgcacgccgcctacaacagcgagctgagcaagagcaccgagagcgacgccggcagcgccctgctgcagccccccctggagcagcacaccgtgtgccacttcttcagcctgaaccagagatgcagctgccccgacgcctacaagcacctgaactacggcccccacagctgccagcagatgggcgactgcctgtgccaccagtgcagccccaccaccagcagcttcgtgcagatccagaacggcgtggcccccctgaaggccacccaccaggccgtggagggcttcgtgcaccccatcacccacatccaccactgcccctgcctgcagggcagagtgaagcccgccggcatgcagaacagcctgcccagaaacttcttcctgcaccccgtgcagcacatccaggcccaggagaagatcggcaagaccaacgtgcacagcctgcagagaagcatcgaggagcacctgcccaagatggccgagcccagcagcttcgtgtgcagaagcaccggcagcctgctgaagacctgctgcgaccccgagaacaagcagagagagctgtgcaagaacagagacgtgagcaacctggagagcagcggcggcaccgagaacaaggccggcggcaaggtggagctgagcctgagccagaccgacgccagcgtgaacagcgagcacttcaaccagaacgagcccaaggtgctgttcaaccacctgatgggcgaggccggctgcagaagctgccccaacaacagccagagctgcggcagaatcgtgagagtgaagtgcaacagcgtggactgccagatgcccaacatggaggccaacgtgcccgccgtgctgacccacagcgagctgagcggcgagagcctgctgatcaagaccctgtag

SEQ ID NO: 17925 - DNA, 555 bp, Artificial Sequence
  Description of Artificial Sequence: Synthetic coding sequence
atggccatgagcaacggcaacaacgacttcgtggtgctgagcaacagcagcatcgccaccagcgccgccaaccccagccccctgaccccctgcgacggcgaccacgccgcccagcagctgacccccaaggaggccaccagaaccaaggtgagccccaacggctgcctgcagctgaacggcaccgtgaagagcagcttcctgcccctggacaaccagagaatgccccagatgctgccccagtgctgccacccctgcccctaccaccaccccctgaccagccacagcagccaccaggagtgccaccccgaggccggccccgccgcccccagcgccctggccagctgctgcatgcagccccacagcgagtacagcgccagcctgtgccccaaccacagccccgtgtaccagaccacctgctgcctgcagcccagccccagcttctgcctgcaccacccctggcccgaccacttccagcaccagcccgtgcagcagcacatcgccaacatcagattcaccagaaagaccaagtgcgccagctggctgctgcagatgtag

SEQ ID NO: 17926 - DNA, 4206 bp, Artificial Sequence
  Description of Artificial Sequence: Synthetic coding sequence
atggacggcgacagcagcagcagcagcggcggcagcggccccgcccccggccccggccccgagggcgagcagagacccgagggcgagcccctggcccccgacggcggcagccccgacagcacccagaccaaggccgtgccccccgaggccagccccgagagaagctgcagcctgcacagctgccccctggaggaccccagcagcagcagcggccccccccccaccaccagcaccctgcagcccgtgggccccagcagccccctggcccccgcccacttcacctaccccagagccctgcaggagtaccagggcggcagcagcctgcccggcctgggcgacagagccgccctgtgcagccacggcagcagcctgagccccagccccgcccccagccagagagacggcacctggaagccccccgccgtgcagcaccacgtggtgagcgtgagacaggagagagccttccagatgcccaagagctacagccagctgatcgccgagtggcccgtggccgtgctgatgctgtgcctggccgtgatcttcctgtgcaccctggccggcctgctgggcgccagactgcccgacttcagcaagcccctgctgggcttcgagcccagagacaccgacatcggcagcaagctggtggtgtggagagccctgcaggccctgaccggccccagaaagctgctgttcctgagccccgacctggagctgaacagcagcagcagccacaacaccctgagacccgcccccagaggcagcgcccaggagagcgccgtgagacccagaagaatggtggagcccctggaggacagaagacaggagaacttcttctgcggcccccccgagaagagctacgccaagctggtgttcatgagcaccagcagcggcagcctgtggaacctgcacgccatccacagcatgtgcagaatggagcaggaccagatcagaagccacaccagcttcggcgccctgtgccagagaaccgccgccaaccagtgctgccccagctggagcctgggcaactacctggccgtgctgagcaacagaagcagctgcctggacaccacccaggccgacgccgccagaaccctggccctgctgagaacctgcgccctgtactaccacagcggcgccctggtgcccagctgcctgggccccggccagaacaagagccccagatgcgcccaggtgcccaccaagtgcagccagagcagcgccatctaccagctgctgcacttcctgctggacagagacttcctgagcccccagaccaccgactaccaggtgcccagcctgaagtacagcctgctgttcctgcccacccccaagggcgccagcctgatggacatctacctggacagactggccaccccctggggcctggccgacaactacaccagcgtgaccggcatggacctgggcctgaagcaggagctgctgagacacttcctggtgcaggacaccgtgtaccccctgctggccctggtggccatcttcttcggcatggccctgtacctgagaagcctgttcctgaccctgatggtgctgctgggcgtgctgggcagcctgctggtggccttcttcctgtaccaggtggccttcagaatggcctacttccccttcgtgaacctggccgccctgctgctgctgagcagcgtgtgcgccaaccacaccctgatcttcttcgacctgtggagactgagcaagagccagctgcccagcggcggcctggcccagagagtgggcagaaccatgcaccacttcggctacctgctgctggtgagcggcctgaccaccagcgccgccttctacgccagctacctgagcagactgcccgccgtgagatgcctggccctgttcatgggcaccgccgtgctggtgcacctggccctgaccctggtgtggctgcccgccagcgccgtgctgcacgagagatacctggccagaggctgcgccagaagagccagaggcagatgggagggcagcgcccccagaagactgctgctggccctgcacagaagactgagaggcctgagaagagccgccgccggcaccagcagactgctgttccagagactgctgccctgcggcgtgatcaagttcagatacatctggatctgctggttcgccgccctggccgccggcggcgcctacatcgccggcgtgagccccagactgagactgcccaccctgcccccccccggcggccaggtgttcagacccagccaccccttcgagagattcgacgccgagtacagacagctgttcctgttcgagcagctgccccagggcgagggcggccacatgcccgtggtgctggtgtggggcgtgctgcccgtggacaccggcgaccccctggaccccagaagcaacagcagcctggtgagagaccccgccttcagcgccagcggccccgaggcccagagatggctgctggccctgtgccacagagccagaaaccagagcttcttcgacaccctgcaggagggctggcccaccctgtgcttcgtggagaccctgcagagatggatggagagccccagctgcgccagactgggccccgacctgtgctgcggccacagcgacttcccctgggccccccagttcttcctgcactgcctgaagatgatggccctggagcagggccccgacggcacccaggacctgggcctgagattcgacgcccacggcagcctggccgccctggtgctgcagttccagaccaacttcagaaacagccccgactacaaccagacccagctgttctacaacgaggtgagccactggctggccgccgagctgggcatggccccccccggcctgagaagaggctggttcaccagcagactggagctgtacagcctgcagcacagcctgagcaccgagcccgccgtggtgctgggcctggccctggccctggccttcgccaccctgctgctgggcacctggaacgtgcccctgagcctgttcagcgtggccgccgtggccggcaccgtgctgctgaccgtgggcctgctggtgctgctggagtggcagctgaacaccgccgaggccctgttcctgagcgccagcgtgggcctgagcgtggacttcaccgtgaactactgcatcagctaccacctgtgcccccaccccgacagactgagcagagtggccttcagcctgagacagaccagctgcgccaccgccgtgggcgccgccgccctgttcgccgccggcgtgctgatgctgcccgccaccgtgctgctgtacagaaagctgggcatcatcctgatgatggtgaagtgcgtgagctgcggcttcgccagcttcttcttccagagcctgtgctgcttcttcggccccgagaagaactgcggccagatcctgtggccctgcgcccacctgccctgggacgccggcaccggcgaccccggcggcgagaaggccggcagacccagacccggcagcgtgggcggcatgcccggcagctgcagcgagcagtacgagctgcagcccctggccagaagaagaagccccagcttcgacaccagcaccgccaccagcaagctgagccacagacccagcgtgctgagcgaggacctgcagctgcacgacggcccctgctgcagcagacccccccccgcccccgccagccccagagagctgctgctggaccaccaggccgtgttcagccagtgccccgccctgcagaccagcagcccctacaagcaggccggccccagccccaagaccagagccagacaggacagccagggcgaggaggccgagcccctgcccgccagccccgaggcccccgcccacagccccaaggccaaggccgccgacccccccgacggcttctgcagcagcgccagcaccctggagggcctgagcgtgagcgacgagacctgcctgagcaccagcgagcccagcgccagagtgcccgacagcgtgggcgtgagccccgacgacctggacgacaccggccagcccgtgctggagagaggccagctgaacggcaagagagacaccctgtggctggccctgagagagaccgtgtacgaccccagcctgcccgccagccaccacagcagcctgagctggaagggcagaggcggccccggcgacggcagccccgtggtgctgcccaacagccagcccgacctgcccgacgtgtggctgagaagacccagcacccacaccagcggctacagcagctag

SEQ ID NO: 17927 - DNA, 1416 bp, Artificial Sequence
  Description of Artificial Sequence: Synthetic coding sequence
atgggcggcacccaggtgaagtgcctgaccagccccagccccatccacagcgccaagagcgagagcatcatcacccagagcgaggagaaggccgacttcgtgatcatccccgccgagggcatcgagaacagaaccgagggcaccgacagccccctgagcagagactggagacccggccccggcacctacctggagaccagctgggaggagcagctgctggagcagcaggagtacctggagaaggagatggaggaggccaagaagatgatcagcggcctgcaggccctgctgctgaacggcagcctgcccgaggacgagcaggagagacccctggccctgtgcgagcccggcgtgaaccccgaggagcagctgatcatcatccagagcagactggaccagagcatggaggagaaccaggacctgaagaaggagctgctgaagtgcaagcaggaggccagaaacctgcagggcatcaaggacgccctgcagcagagactgacccagcaggacaccagcgtgctgcagctgaagcaggagctgctgagagccaacatggacaaggacgagctgcacaaccagaacgtggacctgcagagaaagctggacgagagaaacagactgctgggcgagtacaagaaggagctgggccagaaggacagactgctgcagcagcaccaggccaagctggaggaggccctgagaaagctgagcgacgtgagctaccaccaggtggacctggagagagagctggagcacaaggacgtgctgctggcccactgcatgaagagagaggccgacgaggccaccaactacaacagccacaacagccagagcaacggcttcctgctgcccaccgccggcaagggcgccaccagcgtgagcaacagaggcaccagcgacctgcagctggtgagagacgccctgagaagcctgagaaacagcttcagcggccacgacccccagcaccacaccatcgacagcctggagcagggcatcagcagcctgatggagagactgcacgtgatggagacccagaagaagcaggagagaaaggtgagagtgaagagccccagaacccaggtgggcagcgagtacagagagagctggccccccaacagcaagctgccccacagccagagcagccccaccgtgagcagcacctgcaccaaggtgctgtacttcaccgacagaagcctgacccccttcatggtgaacatccccaagagactggaggaggtgaccctgaaggacttcaaggccgccatcgacagagagggcaaccacagataccacttcaaggccctggaccccgagttcggcaccgtgaaggaggagatcttccacgacgacgacgccatccccggctgggagggcaagatcgtggcctgggtggaggaggaccacggcgagaactag

SEQ ID NO: 17928 - DNA, 2049 bp, Artificial Sequence
  Description of Artificial Sequence: Synthetic coding sequence
atgctggcctgcctgaccagaggcaacctgctggacgtgctgcaggagggcttcaacgagcagcagctgcaggcctacgtggcctgggtgaacgcccagctgaagaagagacccgccgtgaagcccgtgcaggacctgagacaggacctgagagacggcgtgatcctggcctacctgatcgagatcgtggccggcgagaagctgagcggcgtgcagctgagccccggcaaccagcaggagatgaagaacaacgtggagaaggtgctgcagttcgtggccagcaagaagatcagaatgcaccagaccagcgccaaggacatcgtggacggcaacctgaagagcatcatgagactggtgctggccctggccgcccacttcaagcccggcagcagcagaaccgtgaaccagggcagagacagcagagcccccctgcagagccacagaccccactgcgccaccgccgtggcccagggcgccgccgccgccctggccgacgtgtgccacgacatgagcagaagcggcagagacgtgttcagatacagacagagaaacagcagcatggacgaggagatcgagaacccctactggagcgtgagagccctggtgcagcagtacgagggccagcagagaagccccagcgagagcagctgcagcagcctgaccagccccagccccatccacagcgccaagagcgagagcatcatcacccagagcgaggagaaggccgacttcgtgatcatccccgccgagggcatcgagaacagaaccgagggcaccgacagccccctgagcagagactggagacccggccccggcacctacctggagaccagctgggaggagcagctgctggagcagcaggagtacctggagaaggagatggaggaggccaagaagatgatcagcggcctgcaggccctgctgctgaacggcagcctgcccgaggacgagcaggagagacccctggccctgtgcgagcccggcgtgaaccccgaggagcagctgatcatcatccagagcagactggaccagagcatggaggagaaccaggacctgaagaaggagctgctgaagtgcaagcaggaggccagaaacctgcagggcatcaaggacgccctgcagcagagactgacccagcaggacaccagcgtgctgcagctgaagcaggagctgctgagagccaacatggacaaggacgagctgcacaaccagaacgtggacctgcagagaaagctggacgagagaaacagactgctgggcgagtacaagaaggagctgggccagaaggacagactgctgcagcagcaccaggccaagctggaggaggccctgagaaagctgagcgacgtgagctaccaccaggtggacctggagagagagctggagcacaaggacgtgctgctggcccactgcatgaagagagaggccgacgaggccaccaactacaacagccacaacagccagagcaacggcttcctgctgcccaccgccggcaagggcgccaccagcgtgagcaacagaggcaccagcgacctgcagctggtgagagacgccctgagaagcctgagaaacagcttcagcggccacgacccccagcaccacaccatcgacagcctggagcagggcatcagcagcctgatggagagactgcacgtgatggagacccagaagaagcaggagagaaaggtgagagtgaagagccccagaacccaggtgggcagcgagtacagagagagctggccccccaacagcaagctgccccacagccagagcagccccaccgtgagcagcacctgcaccaaggtgctgtacttcaccgacagaagcctgacccccttcatggtgaacatccccaagagactggaggaggtgaccctgaaggacttcaaggccgccatcgacagagagggcaaccacagataccacttcaaggccctggaccccgagttcggcaccgtgaaggaggagatcttccacgacgacgacgccatccccggctgggagggcaagatcgtggcctgggtggaggaggaccacggcgagaactag

SEQ ID NO: 17929 - DNA, 660 bp, Artificial Sequence
  Description of Artificial Sequence: Synthetic coding sequence
atgctggcctgcctgaccagaggcaacctgctggacgtgctgcaggagggcttcaacgagcagcagctgcaggcctacgtggcctgggtgaacgcccagctgaagaagagacccgccgtgaagcccgtgcaggacctgagacaggacctgagagacggcgtgatcctggcctacctgatcgagatcgtggccggcgagaagctgagcggcgtgcagctgagccccggcaaccagcaggagatgaagaacaacgtggagaaggtgctgcagttcgtggccagcaagaagatcagaatgcaccagaccagcgccaaggacatcgtggacggcaacctgaagagcatcatgagactggtgctggccctggccgcccacttcaagcccggcagcagcagaaccgtgaaccagggcagagacagcagagcccccctgcagagccacagaccccactgcgccaccgccgtggcccagggcgccgccgccgccctggccgacgtgtgccacgacatgagcagaagcggcagagacgtgttcagatacagacagagaaacagcagcatggacgaggagatcgagaacccctactggagcgtgagagccctggtgcagcagtacgagggccagcagagaagccccagcgagagcagctgcagcagatag

SEQ ID NO: 17930 - DNA, 1140 bp, Artificial Sequence
  Description of Artificial Sequence: Synthetic coding sequence
atggagggcaacagagacgaggccgagaagtgcgtggagatcgccagagaggccctgaacgccggcaacagagagaaggcccagagattcctgcagaaggccgagaagctgtaccccctgcccagcgccagagccctgctggagatcatcatgaagaacggcagcaccgccggcaacagcccccactgcagaaagcccagcggcagcggcgaccagagcaagcccaactgcaccaaggacagcaccagcggcagcggcgagggcggcaagggctacaccaaggaccaggtggacggcgtgctgagcatcaacaagtgcaagaactactacgaggtgctgggcgtgaccaaggacgccggcgacgaggacctgaagaaggcctacagaaagctggccctgaagttccaccccgacaagaaccacgcccccggcgccaccgacgccttcaagaagatcggcaacgcctacgccgtgctgagcaaccccgagaagagaaagcagtacgacctgaccggcaacgaggagcaggcctgcaaccaccagaacaacggcagattcaacttccacagaggctgcgaggccgacatcacccccgaggacctgttcaacatcttcttcggcggcggcttccccagcggcagcgtgcacagcttcagcaacggcagagccggctacagccagcagcaccagcacagacacagcggccacgagagagaggaggagagaggcgacggcggcttcagcgtgttcatccagctgatgcccatcatcgtgctgatcctggtgagcctgctgagccagctgatggtgagcaaccccccctacagcctgtaccccagaagcggcaccggccagaccatcaagatgcagaccgagaacctgggcgtggtgtactacgtgaacaaggacttcaagaacgagtacaagggcatgctgctgcagaaggtggagaagagcgtggaggaggactacgtgaccaacatcagaaacaactgctggaaggagagacagcagaagaccgacatgcagtacgccgccaaggtgtacagagacgacagactgagaagaaaggccgacgccctgagcatggacaactgcaaggagctggagagactgaccagcctgtacaagggcggctag

SEQ ID NO: 17931 - DNA, 1014 bp, Artificial Sequence
  Description of Artificial Sequence: Synthetic coding sequence
atgggcaaggactactactgcatcctgggcatcgagaagggcgccagcgacgaggacatcaagaaggcctacagaaagcaggccctgaagttccaccccgacaagaacaagagcccccaggccgaggagaagttcaaggaggtggccgaggcctacgaggtgctgagcgaccccaagaagagagagatctacgaccagttcggcgaggagggcctgaagggcggcgccggcggcaccgacggccagggcggcaccttcagatacaccttccacggcgacccccacgccaccttcgccgccttcttcggcggcagcaaccccttcgagatcttcttcggcagaagaatgggcggcggcagagacagcgaggagatggagatcgacggcgaccccttcagcgccttcggcttcagcatgaacggctaccccagagacagaaacagcgtgggccccagcagactgaagcaggacccccccgtgatccacgagctgagagtgagcctggaggagatctacagcggctgcaccaagagaatgaagatcagcagaaagagactgaacgccgacggcagaagctacagaagcgaggacaagatcctgaccatcgagatcaagaagggctggaaggagggcaccaagatcaccttccccagagagggcgacgagacccccaacagcatccccgccgacatcgtgttcatcatcaaggacaaggaccaccccaagttcaagagagacggcagcaacatcatctacaccgccaagatcagcctgagagaggccctgtgcggctgcagcatcaacgtgcccaccctggacggcagaaacatccccatgagcgtgaacgacatcgtgaagcccggcatgagaagaagaatcatcggctacggcctgcccttccccaagaaccccgaccagagaggcgacctgctgatcgagttcgaggtgagcttccccgacaccatcagcagcagcagcaaggaggtgctgagaaagcacctgcccgccagctag

SEQ ID NO: 17932 - DNA, 519 bp, Artificial Sequence
  Description of Artificial Sequence: Synthetic coding sequence
atgggcaaggactactactgcatcctgggcatcgagaagggcgccagcgacgaggacatcaagaaggcctacagaaagcaggccctgaagttccaccccgacaagaacaagagcccccaggccgaggagaagttcaaggaggtggccgaggcctacgaggtgctgagcgaccccaagaagagagagatctacgaccagttcggcgaggagggcctgaagggcggcgccggcggcaccgacggccagggcggcaccttcagatacaccttccacggcgacccccacgccaccttcgccgccttcttcggcggcagcaaccccttcgagatcttcttcggcagaagaatgggcggcggcagagacagcgaggagatggagatcgacggcgaccccttcagcgccttcggcttcagcatgaacggctaccccagagacagaaacagcgtgggccccagcagactgaagcaggacccccccgtgatccacgagctgagagtgagcctggaggagatctactag

SEQ ID NO: 17933 - DNA, 1083 bp, Artificial Sequence
  Description of Artificial Sequence: Synthetic coding sequence
atgggcgcccccctgctgagccccggctggggcgccggcgccgccggcagaagatggtggatgctgctggcccccctgctgcccgccctgctgctggtgagacccgccggcgccctggtggagggcctgtactgcggcaccagagactgctacgaggtgctgggcgtgagcagaagcgccggcaaggccgagatcgccagagcctacagacagctggccagaagataccaccccgacagatacagaccccagcccggcgacgagggccccggcagaaccccccagagcgccgaggaggccttcctgctggtggccaccgcctacgagaccctgaaggacgaggagaccagaaaggactacgactacatgctggaccaccccgaggagtactacagccactactaccactactacagcagaagactggcccccaaggtggacgtgagagtggtgatcctggtgagcgtgtgcgccatcagcgtgttccagttcttcagctggtggaacagctacaacaaggccatcagctacctggccaccgtgcccaagtacagaatccaggccaccgagatcgccaagcagcagggcctgctgaagaaggccaaggagaagggcaagaacaagaagagcaaggaggagatcagagacgaggaggagaacatcatcaagaacatcatcaagagcaagatcgacatcaagggcggctaccagaagccccagatctgcgacctgctgctgttccagatcatcctggcccccttccacctgtgcagctacatcgtgtggtactgcagatggatctacaacttcaacatcaagggcaaggagtacggcgaggaggagagactgtacatcatcagaaagagcatgaagatgagcaagagccagttcgacagcctggaggaccaccagaaggagaccttcctgaagagagagctgtggatcaaggagaactacgaggtgtacaagcaggagcaggaggaggagctgaagaagaagctggccaacgaccccagatggaagagatacagaagatggatgaagaacgagggccccggcagactgaccttcgtggacgactag

SEQ ID NO: 17934 - DNA, 462 bp, Artificial Sequence
  Description of Artificial Sequence: Synthetic coding sequence
atgggcgcccccctgctgagccccggctggggcgccggcgccgccggcagaagatggtggatgctgctggcccccctgctgcccgccctgctgctggtgagacccgccggcgccctggtggagggcctgtactgcggcaccagagactgctacgaggtgctgggcgtgagcagaagcgccggcaaggccgagatcgccagagcctacagacagctggccagaagataccaccccgacagatacagaccccagcccggcgacgagggccccggcagaaccccccagagcgccgaggaggccttcctgctggtggccaccgcctacgagaccctgaaggtgagccaggccgccgccgagctgcagcagtactgcatgcagaacgcctgcaaggacgccctgctggtgggcgtgcccgccggcagcaaccccttcagagagcccagaagctgcgccctgctgtag

SEQ ID NO: 17935 - DNA, 330 bp, Artificial Sequence
  Description of Artificial Sequence: Synthetic coding sequence
atgaccgccccctgcagccagcccgcccagctgcccggcagaagacagctgggcctggtgcccttccccccccccccccccagaacccccctgctgtggctgctgctgctgctgctggccgccgtggcccccgccagaggctgggagagcggcgacctggagctgttcgacctggtggaggaggtgcagctgaacttctaccagttcctgggcgtgcagcaggacgccagcagcgccgacatcagaaaggcctacagaaagctgagcctgaccctgcaccccgacaagaacaaggacgagaacgccgagacccagttcagacaggtgtag

SEQ ID NO: 17936 - DNA, 1665 bp, Artificial Sequence
  Description of Artificial Sequence: Synthetic coding sequence
atgaccgccccctgcagccagcccgcccagctgcccggcagaagacagctgggcctggtgcccttccccccccccccccccagaacccccctgctgtggctgctgctgctgctgctggccgccgtggcccccgccagaggctgggagagcggcgacctggagctgttcgacctggtggaggaggtgcagctgaacttctaccagttcctgggcgtgcagcaggacgccagcagcgccgacatcagaaaggcctacagaaagctgagcctgaccctgcaccccgacaagaacaaggacgagaacgccgagacccagttcagacagctggtggccatctacgaggtgctgaaggacgacgagagaagacagagatacgacgacatcctgatcaacggcctgcccgactggagacagcccgtgttctactacagaagagtgagaaagatgagcaacgccgagctggccctgctgctgttcatcatcctgaccgtgggccactacgccgtggtgtggagcatctacctggagaagcagctggacgagctgctgagcagaaagaagagagagaagaagaagaagaccggcagcaagagcgtggacgtgagcaagctgggcgccagcgagaagaacgagagactgctgatgaagccccagtggcacgacctgctgccctgcaagctgggcatctggttctgcctgaccctgaaggccctgccccacctgatccaggacgccggccagttctacgccaagtacaaggagaccagactgaaggagaaggaggacgccctgaccagaaccgagctggagaccctgcagaagcagaagaaggtgaagaagcccaagcccgagttccccgtgtacacccccctggagaccacctacatccagagctacgaccacggcaccagcatcgaggagatcgaggagcagatggacgactggctggagaacagaaacagaacccagaagaagcaggcccccgagtggaccgaggaggacctgagccagctgaccagaagcatggtgaagttccccggcggcacccccggcagatgggagaagatcgcccacgagctgggcagaagcgtgaccgacgtgaccaccaaggccaagcagctgaaggacagcgtgacctgcagccccggcatggtgagactgagcgagctgaagagcaccgtgcagaacagcagacccatcaagaccgccaccaccctgcccgacgacatgatcacccagagagaggacgccgagggcgtggccgccgaggaggagcaggagggcgacagcggcgagcaggagaccggcgccaccgacgccagacccagaagaagaaagcccgccagactgctggaggccaccgccaagcccgagcccgaggagaagagcagagccaagagacagaaggacttcgacatcgccgagcagaacgagagcagcgacgaggagagcctgagaaaggagagagccagaagcgccgaggagccctggacccagaaccagcagaagctgctggagctggccctgcagcagtaccccagaggcagcagcgacagatgggacaagatcgccagatgcgtgcccagcaagagcaaggaggactgcatcgccagatacaagctgctggtggagctggtgcagaagaagaagcaggccaagagctag

SEQ ID NO: 17937 - DNA, 351 bp, Artificial Sequence
  Description of Artificial Sequence: Synthetic coding sequence
tgaggcagaagacagctgggcctggtgcccttccccccccccccccccagaacccccctgctgtggctgctgctgctgctgctggccgccgtggcccccgccagaggctgggagagcggcgacctggagctgttcgacctggtggaggaggtgcagctgaacttctaccagttcctgggcgtgcagcaggacgccagcagcgccgacatcagaaaggcctacagaaagctgagcctgaccctgcaccccgacaagaacaaggacgagaacgccgagacccagttcagacagctggtggccatctacgaggtgctgaaggacgacgagagaagacagagaatgaactactag

SEQ ID NO: 17938 - DNA, 1524 bp, Artificial Sequence
  Description of Artificial Sequence: Synthetic coding sequence
atggccaccgccctgagcgaggaggagctggacaacgaggactactacagcctgctgaacgtgagaagagaggccagcagcgaggagctgaaggccgcctacagaagactgtgcatgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggagatggggcatccagagcgccatgaacaccagcatcgtgagagacaccaagaccagccacttcaccgtggccctgcagctgggcatcccccacagcttcgccctgatcagctaccagcacaagttccaggacgacgaccagaccagagtgaagggcagcctgaaggccggcttcttcggcaccgtggtggagtacggcgccgagagaaagatcagcagacacagcgtgctgggcgccgccgtgagcgtgggcgtgccccagggcgtgagcctgaaggtgaaggagctggagaagcagagagagagcgccgccaccgacgtgctgcagaagaagcaggaggccgagagcgccgtgagactgatgcaggagagcgtgagaagaatcatcgaggccgaggagagcagaatgggcctgatcatcgtgaacgcctggtacggcaagttcgtgaacgacaagagcagaaagagcgagaaggtgaaggtgatcgacgtgaccgtgcccctgcagtgcctggtgaaggacagcaagctgatcctgaccgaggccagcaaggccggcctgcccggcttctacgacccctgcgtgggcgaggagaagaacctgaaggtgctgtaccagttcagaggcgtgctgcaccaggtgatggtgctggacagcgaggccctgagaatccccaagcagagccacagaatcgacaccgacggctag

SEQ ID NO: 17939 - DNA, 957 bp, Artificial Sequence
  Description of Artificial Sequence: Synthetic coding sequence
atgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggcactgcagcagccccctgctgcaggtgcagagaccccacagaaacaccagagcctgcgcccccgagcccagcttcagacccttcctgcacgtgcccacctgggacgccgagtgcagcggcgccagaacccccagcaccgcctggaccagcgccgccgtgaagctgagagaggcctgcctgagcggccccggcagcggcagccaccagctgctgctgctgacccccagaagcaagagaagaaccggcggcggctag

SEQ ID NO: 17940 - DNA, 1410 bp, Artificial Sequence
  Description of Artificial Sequence: Synthetic coding sequence
atgaaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggagatggggcatccagagcgccatgaacaccagcatcgtgagagacaccaagaccagccacttcaccgtggccctgcagctgggcatcccccacagcttcgccctgatcagctaccagcacaagttccaggacgacgaccagaccagagtgaagggcagcctgaaggccggcttcttcggcaccgtggtggagtacggcgccgagagaaagatcagcagacacagcgtgctgggcgccgccgtgagcgtgggcgtgccccagggcgtgagcctgaaggtgaagctgaacagagccagccagacctacttcttccccatccacctgaccgaccagctgctgcccagcgccatgttctacgccaccgtgggccccctggtggtgtacttcgccatgcacagactgatcatcaagccctacctgagagcccagaaggagaaggagctggagaagcagagagagagcgccgccaccgacgtgctgcagaagaagcaggaggccgagagcgccgtgagactgatgcaggagagcgtgagaagaatcatcgaggccgaggagagcagaatgggcctgatcatcgtgaacgcctggtacggcaagttcgtgaacgacaagagcagaaagagcgagaaggtgaaggtgatcgacgtgaccgtgcccctgcagtgcctggtgaaggacagcaagctgatcctgaccgaggccagcaaggccggcctgcccggcttctacgacccctgcgtgggcgaggagaagaacctgaaggtgctgtaccagttcagaggcgtgctgcaccaggtgatggtgctggacagcgaggccctgagaatccccaagcagagccacagaatcgacaccgacggctag

SEQ ID NO: 17941 - DNA, 1680 bp, Artificial Sequence
  Description of Artificial Sequence: Synthetic coding sequence
atggccaccgccctgagcgaggaggagctggacaacgaggactactacagcctgctgaacgtgagaagagaggccagcagcgaggagctgaaggccgcctacagaagactgtgcatgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggagatggggcatccagagcgccatgaacaccagcatcgtgagagacaccaagaccagccacttcaccgtggccctgcagctgggcatcccccacagcttcgccctgatcagctaccagcacaagttccaggacgacgaccagaccagagtgaagggcagcctgaaggccggcttcttcggcaccgtggtggagtacggcgccgagagaaagatcagcagacacagcgtgctgggcgccgccgtgagcgtgggcgtgccccagggcgtgagcctgaaggtgaagctgaacagagccagccagacctacttcttccccatccacctgaccgaccagctgctgcccagcgccatgttctacgccaccgtgggccccctggtggtgtacttcgccatgcacagactgatcatcaagccctacctgagagcccagaaggagaaggagctggagaagcagagagagagcgccgccaccgacgtgctgcagaagaagcaggaggccgagagcgccgtgagactgatgcaggagagcgtgagaagaatcatcgaggccgaggagagcagaatgggcctgatcatcgtgaacgcctggtacggcaagttcgtgaacgacaagagcagaaagagcgagaaggtgaaggtgatcgacgtgaccgtgcccctgcagtgcctggtgaaggacagcaagctgatcctgaccgaggccagcaaggccggcctgcccggcttctacgacccctgcgtgggcgaggagaagaacctgaaggtgctgtaccagttcagaggcgtgctgcaccaggtgatggtgctggacagcgaggccctgagaatccccaagcagagccacagaatcgacaccgacggctag

SEQ ID NO: 17942 - DNA, 975 bp, Artificial Sequence
  Description of Artificial Sequence: Synthetic coding sequence
atggccaccgccctgagcgaggaggagctggacaacgaggactactacagcctgctgaacgtgagaagagaggccagcagcgaggagctgaaggccgcctacagaagactgtgcatgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagagaatgaccgactgcctgatcatcggcctgatcgacatctgccagagatgcagcccccagcccgccagcgccagctgcagactgtgctgctgccacgtgaccctgctggagctgtacatccccgtgcccagcagaaccaccgccgtgagcagcttccccatctgcttcgtgaccaccaactgcgccctgcagttcagcagcagaggcatcagacccggcctgaccaccgtgctggccagaaacctggacaagaacaccgtgggctacctgcagtggagatggggcatccagagcgccatgaacaccagcatcgtgagagacaccaagaccagccacttcacctag

SEQ ID NO: 17943 - DNA, 999 bp, Artificial Sequence
  Description of Artificial Sequence: Synthetic coding sequence
gccagcagcgaggagctgaaggccgcctacagaagactgtgcatgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggcactgcagcagccccctgctgcaggtgcagagaccccacagaaacaccagagcctgcgcccccgagcccagcttcagacccttcctgcacgtgcccacctgggacgccgagtgcagcggcgccagaacccccagcaccgcctggaccagcgccgccgtgaagctgagagaggcctgcctgagcggccccggcagcggcagccaccagctgctgctgctgacccccagaagcaagagaagaaccggcggcggctag

SEQ ID NO: 17944 - DNA, 1566 bp, Artificial Sequence
  Description of Artificial Sequence: Synthetic coding sequence
atgctgtaccaccccgacaagcacagagaccccgagctgaagagccaggccgagagactgttcaacctggtgcaccaggcctacgaggtgctgagcgacccccagaccagagccatctacgacatctacggcaagagaggcctggagatggagggctgggaggtggtggagagaagaagaacccccgccgagatcagagaggagttcgagagactgcagagagagagagaggagagaagactgcagcagagaaccaaccccaagggcaccatcagcgtgggcgtggacgccaccgacctgttcgacagatacgacgaggagtacgaggacgtgagcggcagcagcttcccccagatcgagatcaacaagatgcacatcagccagagcatcgaggcccccctgaccgccaccgacaccgccatcctgagcggcagcctgagcacccagaacggcaacggcggcggcagcatcaacttcgccctgagaagagtgaccagcgccaagggctggggcgagctggagttcggcgccggcgacctgcagggccccctgttcggcctgaagctgttcagaaacctgacccccagatgcttcgtgaccaccaactgcgccctgcagttcagcagcagaggcatcagacccggcctgaccaccgtgctggccagaaacctggacaagaacaccgtgggctacctgcagtggagatggggcatccagagcgccatgaacaccagcatcgtgagagacaccaagaccagccacttcaccgtggccctgcagctgggcatcccccacagcttcgccctgatcagctaccagcacaagttccaggacgacgaccagaccagagtgaagggcagcctgaaggccggcttcttcggcaccgtggtggagtacggcgccgagagaaagatcagcagacacagcgtgctgggcgccgccgtgagcgtgggcgtgccccagggcgtgagcctgaaggtgaagctgaacagagccagccagacctacttcttccccatccacctgaccgaccagctgctgcccagcgccatgttctacgccaccgtgggccccctggtggtgtacttcgccatgcacagactgatcatcaagccctacctgagagcccagaaggagaaggagctggagaagcagagagagagcgccgccaccgacgtgctgcagaagaagcaggaggccgagagcgccgtgagactgatgcaggagagcgtgagaagaatcatcgaggccgaggagagcagaatgggcctgatcatcgtgaacgcctggtacggcaagttcgtgaacgacaagagcagaaagagcgagaaggtgaaggtgatcgacgtgaccgtgcccctgcagtgcctggtgaaggacagcaagctgatcctgaccgaggccagcaaggccggcctgcccggcttctacgacccctgcgtgggcgaggagaagaacctgaaggtgctgtaccagttcagaggcgtgctgcaccaggtgatggtgctggacagcgaggccctgagaatccccaagcagagccacagaatcgacaccgacggctag

SEQ ID NO: 17945 - DNA, 2109 bp, Artificial Sequence
  Description of Artificial Sequence: Synthetic coding sequence
atggcccagaagcaccccggcgagagaggcctgtacggcgcccaccacagcggcggcgccagcctgagaaccctgggccccagcgtggaccccgagatccccagcttcagcggcctgagagacagcgccggcaccgcccccaacggcaccagatgcctgaccgagcacagcggccccaagcacacccagcaccccaaccccgcccactggctggaccccagccacggcccccccggcggccccggcccccccagagacgccgaggaccccgaccagagcgagaccagcagcgaggaggagagcggcgtggaccaggagctgagcaaggagaacgagaccggcaaccagaaggacggcaacagcttcctgagcatccccagcgcctgcaactgccagggcacccccggcatccccgagggcccctacagcgagggcggcaacggcagcagcagcaacttctgccaccactgcaccagccccgccctgggcgaggacgagctggaggaggagtacgacgacgaggagagcctgaagttccccagcgacttcagcagagtgagcagcggcaagaagccccccagcagaagacagagacacagattccccaccaaggaggacaccagagagggcggcagaagagaccccagaagccccggcagacacagactgggcagaaagagaagccaggccgacaagagaaagggcctgggcctgtggggcgccgaggagctgtgccagctgggccaggccggcttctggtggctgatcgagctgctggtgctggtgggcgagtacgtggagacctgcggccacctgatctacgcctgcagacagctgaagagcagcgacctggacctgttcagagtgtggatgggcgtgtggaccggcagactgggcggctgggcccaggtgatgttccagttcctgagccagggcttctactgcggcgtgggcctgttcaccagattcctgaagctgctgggcgccctgctgctgctggccctggccctgttcctgggcttcctgcagctgggctggagattcctggtgggcctgggcgacagactgggctggagagacaaggccacctggctgttcagctggctggacagccccgccctgcagagatgcctgaccctgctgagagacagcagaccctggcagagactggtgagaatcgtgcagtggggctggctggagctgccctgggtgaagcagaacatcaacagacagggcaacgcccccgtggccagcggcagatactgccagcccgaggaggaggtggccagactgctgaccatggccggcgtgcccgaggacgagctgaaccccttccacgtgctgggcgtggaggccaccgccagcgacgtggagctgaagaaggcctacagacagctggccgtgatggtgcaccccgacaagaaccaccaccccagagccgaggaggccttcaaggtgctgagagccgcctgggacatcgtgagcaacgccgagaagagaaaggagtacgagatgaagagaatggccgagaacgagctgagcagaagcgtgaacgagttcctgagcaagctgcaggacgacctgaaggaggccatgaacaccatgatgtgcagcagatgccagggcaagcacagaagattcgagatggacagagagcccaagagcgccagatactgcgccgagtgcaacagactgcaccccgccgaggagggcgacttctgggccgagagcagcatgctgggcctgaagatcacctacttcgccctgatggacggcaaggtgtacgacatcaccgagtgggccggctgccagagagtgggcatcagccccgacacccacagagtgccctaccacatcagcttcggcagcagaatccccggcaccagaggcagacagagagccacccccgacgccccccccgccgacctgcaggacttcctgagcagaatcttccaggtgccccccggccagatgcccaacggcaacttcttcgccgccccccagcccgcccccggcgccgccgccgccagcaagcccaacagcaccgtgcccaagggcgaggccaagcccaagagaagaaagaaggtgagaagacccttccagagatag

SEQ ID NO: 17946 - DNA, 2109 bp, Artificial Sequence; identical to SEQ ID NO: 17945
  Description of Artificial Sequence: Synthetic coding sequence

SEQ ID NO: 17947 - DNA, 2109 bp, Artificial Sequence; identical to SEQ ID NO: 17945
  Description of Artificial Sequence: Synthetic coding sequence

SEQ ID NO: 17948 - DNA, 1239 bp, Artificial Sequence
  Description of Artificial Sequence: Synthetic coding sequence
atgggcgtgtggaccggcagactgggcggctgggcccaggtgatgttccagttcctgagccagggcttctactgcggcgtgggcctgttcaccagattcctgaagctgctgggcgccctgctgctgctggccctggccctgttcctgggcttcctgcagctgggctggagattcctggtgggcctgggcgacagactgggctggagagacaaggccacctggctgttcagctggctggacagccccgccctgcagagatgcctgaccctgctgagagacagcagaccctggcagagactggtgagaatcgtgcagtggggctggctggagctgccctgggtgaagcagaacatcaacagacagggcaacgcccccgtggccagcggcagatactgccagcccgaggaggaggtggccagactgctgaccatggccggcgtgcccgaggacgagctgaaccccttccacgtgctgggcgtggaggccaccgccagcgacgtggagctgaagaaggcctacagacagctggccgtgatggtgcaccccgacaagaaccaccaccccagagccgaggaggccttcaaggtgctgagagccgcctgggacatcgtgagcaacgccgagaagagaaaggagtacgagatgaagagaatggccgagaacgagctgagcagaagcgtgaacgagttcctgagcaagctgcaggacgacctgaaggaggccatgaacaccatgatgtgcagcagatgccagggcaagcacagaagattcgagatggacagagagcccaagagcgccagatactgcgccgagtgcaacagactgcaccccgccgaggagggcgacttctgggccgagagcagcatgctgggcctgaagatcacctacttcgccctgatggacggcaaggtgtacgacatcaccgagtgggccggctgccagagagtgggcatcagccccgacacccacagagtgccctaccacatcagcttcggcagcagaatccccggcaccagaggcagacagagagccacccccgacgccccccccgccgacctgcaggacttcctgagcagaatcttccaggtgccccccggccagatgcccaacggcaacttcttcgccgccccccagcccgcccccggcgccgccgccgccagcaagcccaacagcaccgtgcccaagggcgaggccaagcccaagagaagaaagaaggtgagaagacccttccagagatag

SEQ ID NO: 17949 - DNA, 576 bp, Artificial Sequence
  Description of Artificial Sequence: Synthetic coding sequence
agaaagagaatggccgagaacgagctgagcagaagcgtgaacgagttcctgagcaagctgcaggacgacctgaaggaggccatgaacaccatgatgtgcagcagatgccagggcaagcacagaagattcgagatggacagagagcccaagagcgccagatactgcgccgagtgcaacagactgcaccccgccgaggagggcgacttctgggccgagagcagcatgctgggcctgaagatcacctacttcgccctgatggacggcaaggtgtacgacatcaccgagtgggccggctgccagagagtgggcatcagccccgacacccacagagtgccctaccacatcagcttcggcagcagaatccccggcaccagaggcagacagagagccacccccgacgccccccccgccgacctgcaggacttcctgagcagaatcttccaggtgccccccggccagatgcccatgggcaccagcctgcagctgctgagcctgcccctggagcccctgcagcccctgagccccaccgcccagtaccccagagagaagcccaacctgagcggcggcagaaagtag

SEQ ID NO: 17950 - DNA, 240 bp, Artificial Sequence
  Description of Artificial Sequence: Synthetic coding sequence
atggcccagaagcaccccggcgagagaggcctgtacggcgcccaccacagcggcggcgccagcctgagaaccctgggccccagcgtggaccccgagatccccagcttcagcggcctgagagacagcgccggcaccgcccccaacggcaccagatgcctgaccgagcacagcggccccaagcacacccagcaccccaaccccgcccactggctggaccccagccacggcccccccggctag

SEQ ID NO: 17951 - DNA, 456 bp, Artificial Sequence
  Description of Artificial Sequence: Synthetic coding sequence
atggcccagaagcaccccggcgagagaggcctgtacggcgcccaccacagcggcggcgccagcctgagaaccctgggccccagcgtggaccccgagatccccagcttcagcggcctgagagacagcgccggcaccgcccccaacggcaccagatgcctgaccgagcacagcggccccaagcacacccagcaccccaaccccgcccactggctggaccccagccacggcccccccggcggccccggcccccccagagacgccgaggaccccgaccagagcgagaccagcagcgaggaggagagcggcgtggaccaggagctgagcaaggagaacgagaccggcaaccagaaggacggcaacagcttcctgagcatccccagcgcctgcaactgccagggcacccccggcatccccgagggcccctacagcgagggcggcaacggcagcagcagctag

SEQ ID NO: 17952 - DNA, 453 bp, Artificial Sequence
  Description of Artificial Sequence: Synthetic coding sequence
atggccgccagaggcgtgatcgcccccgtgggcgagagcctgagatacgccgagtacctgcagcccagcgccaagagacccgacgccgacgtggaccagcagagactggtgagaagcctgatcgccgtgggcctgggcgtggccgccctggccttcgccggcagatacgccttcagaatctggaagcccctggagcaggtgatcaccgagaccgccaagaagatcagcacccccagcttcagcagctactacaagggcggcttcgagcagaagatgagcagaagagaggccggcctgatcctgggcgtgagccccagcgccggcaaggccaagatcagaaccgcccacagaagagtgatgatcctgaaccaccccgacaagggcggcagcccctacgtggccgccaagatcaacgaggccaaggacctgctggagaccaccaccaagcactag

SEQ ID NO: 17953 - DNA, 1788 bp, Artificial Sequence
  Description of Artificial Sequence: Synthetic coding sequence
atggaggtgagaaagctgagcatcagctggcagttcctgatcgtgctggtgctgatcctgcagatcctgagcgccctggacttcgacccctacagagtgctgggcgtgagcagaaccgccagccaggccgacatcaagaaggcctacaagaagctggccagagagtggcaccccgacaagaacaaggaccccggcgccgaggacaagttcatccagatcagcaaggcctacgagatcctgagcaacgaggagaagagaagcaactacgaccagtacggcgacgccggcgagaaccagggctaccagaagcagcagcagcagagagagtacagattcagacacttccacgagaacttctacttcgacgagagcttcttccacttccccttcaacagcgagagaagagacagcatcgacgagaagtacctgctgcacttcagccactacgtgaacgaggtggtgcccgacagcttcaagaagccctacctgatcaagatcaccagcgactggtgcttcagctgcatccacatcgagcccgtgtggaaggaggtgatccaggagctggaggagctgggcgtgggcatcggcgtggtgcacgccggctacgagagaagactggcccaccacctgggcgcccacagcacccccagcatcctgggcatcatcaacggcaagatcagcttcttccacaacgccgtggtgagagagaacctgagacagttcgtggagagcctgctgcccggcaacctggtggagaaggtgaccaacaagaactacgtgagattcctgagcggctggcagcaggagaacaagccccacgtgctgctgttcgaccagacccccatcgtgcccctgctgtacaagctgaccgccttcgcctacaaggactacctgagcttcggctacgtgtacgtgggcctgagaggcaccgaggagatgaccagaagatacaacatcaacatctacgcccccaccctgctggtgttcaaggagcacatcaacagacccgccgacgtgatccaggccagaggcatgaagaagcagatcatcgacgacttcatcaccagaaacaagtacctgctggccgccagactgaccagccagaagctgttccacgagctgtgccccgtgaagagaagccacagacagagaaagtactgcgtggtgctgctgaccgccgagaccaccaagctgagcaagcccttcgaggccttcctgagcttcgccctggccaacacccaggacaccgtgagattcgtgcacgtgtacagcaacagacagcaggagttcgccgacaccctgctgcccgacagcgaggccttccagggcaagagcgccgtgagcatcctggagagaagaaacaccgccggcagagtggtgtacaagaccctggaggacccctggatcggcagcgagagcgacaagttcatcctgctgggctacctggaccagctgagaaaggaccccgccctgctgagcagcgaggccgtgctgcccgacctgaccgacgagctggcccccgtgttcctgctgagatggttctacagcgccagcgactacatcagcgactgctgggacagcatcttccacaacaactggagagagatgatgcccctgctgagcctgatcttcagcgccctgttcatcctgttcggcaccgtgatcgtgcaggccttcagcgacagcaacgacgagagagagagcagcccccccgagaaggaggaggcccaggagaagaccggcaagaccgagcccagcttcaccaaggagaacagcagattcctgtag

SEQ ID NO: 17954 - DNA, 2349 bp, Artificial Sequence
  Description of Artificial Sequence: Synthetic coding sequence
atggaggtgagaaagctgagcatcagctggcagttcctgatcgtgctggtgctgatcctgcagatcctgagcgccctggacttcgacccctacagagtgctgggcgtgagcagaaccgccagccaggccgacatcaagaaggcctacaagaagctggccagagagtggcaccccgacaagaacaaggaccccggcgccgaggacaagttcatccagatcagcaaggcctacgagatcctgagcaacgaggagaagagaagcaactacgaccagtacggcgacgccggcgagaaccagggctaccagaagcagcagcagcagagagagtacagattcagacacttccacgagaacttctacttcgacgagagcttcttccacttccccttcaacagcgagagaagagacagcatcgacgagaagtacctgctgcacttcagccactacgtgaacgaggtggtgcccgacagcttcaagaagccctacctgatcaagatcaccagcgactggtgcttcagctgcatccacatcgagcccgtgtggaaggaggtgatccaggagctggaggagctgggcgtgggcatcggcgtggtgcacgccggctacgagagaagactggcccaccacctgggcgcccacagcacccccagcatcctgggcatcatcaacggcaagatcagcttcttccacaacgccgtggtgagagagaacctgagacagttcgtggagagcctgctgcccggcaacctggtggagaaggtgaccaacaagaactacgtgagattcctgagcggctggcagcaggagaacaagccccacgtgctgctgttcgaccagacccccatcgtgcccctgctgtacaagctgaccgccttcgcctacaaggactacctgagcttcggctacgtgtacgtgggcctgagaggcaccgaggagatgaccagaagatacaacatcaacatctacgcccccaccctgctggtgttcaaggagcacatcaacagacccgccgacgtgatccaggccagaggcatgaagaagcagatcatcgacgacttcatcaccagaaacaagtacctgctggccgccagactgaccagccagaagctgttccacgagctgtgccccgtgaagagaagccacagacagagaaagtactgcgtggtgctgctgaccgccgagaccaccaagctgagcaagcccttcgaggccttcctgagcttcgccctggccaacacccaggacaccgtgagattcgtgcacgtgtacagcaacagacagcaggagttcgccgacaccctgctgcccgacagcgaggccttccagggcaagagcgccgtgagcatcctggagagaagaaacaccgccggcagagtggtgtacaagaccctggaggacccctggatcggcagcgagagcgacaagttcatcctgctgggctacctggaccagctgagaaaggaccccgccctgctgagcagcgaggccgtgctgcccgacctgaccgacgagctggcccccgtgttcctgctgagatggttctacagcgccagcgactacatcagcgactgctgggacagcatcttccacaacaactggagagagatgatgcccctgctgagcctgatcttcagcgccctgttcatcctgttcggcaccgtgatcgtgcaggccttcagcgacagcaacgacgagagagagagcagcccccccgagaaggaggaggcccaggagaagaccggcaagaccgagcccagcttcaccaaggagaacagcagcaagatccccaagaagggcttcgtggaggtgaccgagctgaccgacgtgacctacaccagcaacctggtgagactgagacccggccacatgaacgtggtgctgatcctgagcaacagcaccaagaccagcctgctgcagaagttcgccctggaggtgtacaccttcaccggcagcagctgcctgcacttcagcttcctgagcctggacaagcacagagagtggctggagtacctgctggagttcgcccaggacgccgcccccatccccaaccagtacgacaagcacttcatggagagagactacaccggctacgtgctggccctgaacggccacaagaagtacttctgcctgttcaagccccagaagaccgtggaggaggaggaggccatcggcagctgcagcgacgtggacagcagcctgtacctgggcgagagcagaggcaagcccagctgcggcctgggcagcagacccatcaagggcaagctgagcaagctgagcctgtggatggagagactgctggagggcagcctgcagagattctacatccccagctggcccgagctggactag

SEQ ID NO: 17955 - DNA, 1968 bp, Artificial Sequence
  Description of Artificial Sequence: Synthetic coding sequence
atggaggtgagaaagctgagcatcagctggcagttcctgatcgtgctggtgctgatcctgcagatcctgagcgccctggacttcgacccctacagagtgctgggcgtgagcagaaccgccagccaggccgacatcaagaaggcctacaagaagctggccagagagtggcaccccgacaagaacaaggaccccggcgccgaggacaagttcatccagatcagcaaggcctacgagatcctgagcaacgaggagaagagaagcaactacgaccagtacggcgacgccggcgagaaccagggctaccagaagcagcagcagcagagagagtacagattcagacacttccacgagaacttctacttcgacgagagcttcttccacttccccttcaacagcgagagaagagacagcatcgacgagaagtacctgctgcacttcagccactacgtgaacgaggtggtgcccgacagcttcaagaagccctacctgatcaagatcaccagcgactggtgcttcagctgcatccacatcgagcccgtgtggaaggaggtgatccaggagctggaggagctgggcgtgggcatcggcgtggtgcacgccggctacgagagaagactggcccaccacctgggcgcccacagcacccccagcatcctgggcatcatcaacggcaagatcagcttcttccacaacgccgtggtgagagagaacctgagacagttcgtggagagcctgctgcccggcaacctggtggagaaggtgaccaacaagaactacgtgagattcctgagcggctggcagcaggagaacaagccccacgtgctgctgttcgaccagacccccatcgtgcccctgctgtacaagctgaccgccttcgcctacaaggactacctgagcttcggctacgtgtacgtgggcctgagaggcaccgaggagatgaccagaagatacaacatcaacatctacgcccccaccctgctggtgttcaaggagcacatcaacagacccgccgacgtgatccaggccagaggcatgaagaagcagatcatcgacgacttcatcaccagaaacaagtacctgctggccgccagactgaccagccagaagctgttccacgagctgtgccccgtgaagagaagccacagacagagaaagtactgcgtggtgctgctgaccgccgagaccaccaagctgagcaagcccttcgaggccttcctgagcttcgccctggccaacacccaggacaccgtgagattcgtgcacgtgtacagcaacagacagcaggagttcgccgacaccctgctgcccgacagcgaggccttccagggcaagagcgccgtgagcatcctggagagaagaaacaccgccggcagagtggtgtacaagaccctggaggacccctggatcggcagcgagagcgacaagttcatcctgctgggctacctggaccagctgagaaaggaccccgccctgctgagcagcgaggccgtgctgcccgacctgaccgacgagctggcccccgtgttcctgctgagatggttctacagcgccagcgactacatcagcgactgctgggacagcatcttccacaacaactggagagagatgatgcccctgctgagcctgatcttcagcgccctgttcatcctgttcggcaccgtgatcgtgcaggccttcagcgacagcaacgacgagagagagagcagcccccccgagaaggaggaggcccaggagaagaccggcaagaccgagcccagcttcaccaaggagaacagcagcaagatccccaagaagggcttcgtggaggtgaccgagctgaccgacgtgacctacaccagcaacctggtgagactgagacccggccacatgaacgtggtgctgatcctgagcaacagcaccaagaccagcctgctgcagaagttcgccctggaggtgtacaccttcaccggcaagatcatcagatggtag

SEQ ID NO: 17956 - DNA, 1788 bp, Artificial Sequence; identical to SEQ ID NO: 17953
  Description of Artificial Sequence: Synthetic coding sequence

SEQ ID NO: 17957 - DNA, 1077 bp, Artificial Sequence
  Description of Artificial Sequence: Synthetic coding sequence
atggccgccaccctgggcagcggcgagagatggaccgaggcctacatcgacgccgtgagaagaaacaagtaccccgaggacaccccccccgagagccacgacccctgcggctgctgcaactgcatgaaggcccagaaggagaagaagagcgagaacgagtggacccagaccagacagggcgagggcaacagcacctacagcgaggagcagctgctgggcgtgcagagaatcaagaagtgcagaaactactacgagatcctgggcgtgagcagagacgccagcgacgaggagctgaagaaggcctacagaaagctggccctgaagttccaccccgacaagaactgcgcccccggcgccaccgacgccttcaaggccatcggcaacgccttcgccgtgctgagcaaccccgacaagagactgagatacgacgagtacggcgacgagcaggtgaccttcaccgcccccagagccagaccctacaactactacagagacttcgaggccgacatcacccccgaggagctgttcaacgtgttcttcggcggccacttccccaccggcaacatccacatgttcagcaacgtgaccgacgacacctactactacagaagaagacacagacacgagagaacccagacccagaaggaggaggaggaggagaagccccagaccacctacagcgccttcatccagctgctgcccgtgctggtgatcgtgatcatcagcgtgatcacccagctgctggccaccaaccccccctacagcctgttctacaagagcaccctgggctacaccatcagcagagagacccagaacctgcaggtgccctacttcgtggacaagaacttcgacaaggcctacagaggcgccagcctgcacgacctggagaagaccatcgagaaggactacatcgactacatccagaccagctgctggaaggagaagcagcagaagagcgagctgaccaacctggccggcctgtacagagacgagagactgaagcagaaggccgagagcctgaagctggagaactgcgagaagctgagcaagctgatcggcctgagaagaggcggctag

SEQ ID NO: 17958 - DNA, 78 bp, Artificial Sequence
  Description of Artificial Sequence: Synthetic coding sequence
atggccgccaccctgggcagcggcgagagatggaccgaggcctacatcgacgccgtgagaagaaacaagtacccctag

SEQ ID NO: 17959 - DNA, 522 bp, Artificial Sequence
  Description of Artificial Sequence: Synthetic coding sequence
atggccgccaccctgggcagcggcgagagatggaccgaggcctacatcgacgccgtgagaagaaacaagtaccccgaggacaccccccccgagagccacgacccctgcggctgctgcaactgcatgaaggcccagaaggagaagaagagcgagaacgagtggacccagaccagacagggcgagggcaacagcacctacagcgaggagcagctgctgggcgtgcagagaatcaagaagtgcagaaactactacgagatcctgggcgtgagcagagacgccagcgacgaggagctgaagaaggcctacagaaagctggccctgaagttccaccccgacaagaactgcgcccccggcgccaccgacgccttcaaggccatcggcaacgccttcgccgtgctgagcaaccccgacaagagactgagatacgacgagtacggcgacgagcaggtgaccttcaccgcccccagagccagaccctacaactactacagagacttcgaggccgacatcacccccgagtag

SEQ ID NO: 17960 - DNA, 546 bp, Artificial Sequence
  Description of Artificial Sequence: Synthetic coding sequence
atggccgccaccctgggcagcggcgagagatggaccgaggcctacatcgacgccgtgagaagaaacaagtaccccgaggacaccccccccgagagccacgacccctgcggctgctgcaactgcatgaaggcccagaaggagaagaagagcgagaacgagtggacccagaccagacagggcgagggcaacagcacctacagcgaggagcagctgctgggcgtgcagagaatcaagaagtgcagaaactactacgagatcctgggcgtgagcagagacgccagcgacgaggagctgaagaaggcctacagaaagctggccctgaagttccaccccgacaagaactgcgcccccggcgccaccgacgccttcaaggccatcggcaacgccttcgccgtgctgagcaaccccgacaagagactgagatacgacgagtacggcgacgagcaggtgaccttcaccgcccccagagccagaccctacaactactacagagacttcgaggccgacatcacccccgaggagctgttcaacgtgttcttcggctag

SEQ ID NO: 17961 - DNA, 1026 bp, Artificial Sequence
  Description of Artificial Sequence: Synthetic coding sequence
atggccaagggcctgctggtgacctacgccctgtgggccgtgggcggccccgccggcctgcaccacctgtacctgggcagagacagccacgccctgctgtggatgctgaccctgggcggcggcggcctgggctggctgtgggagttctggaagctgcccagcttcgtggcccaggccaacagagcccagggccagagacagagccccagaggcgtgaccccccccctgagccccatcagattcgccgcccaggtgatcgtgggcatctacttcggcctggtggccctgatcagcctgagcagcatggtgaacttctacatcgtggccctgcccctggccgtgggcctgggcgtgctgctggtggccgccgtgggcaaccagaccagcgacttcaagaacaccctgggcagcgccttcctgaccagccccatcttctacggcagacccatcgccatcctgcccatcagcgtggccgccagcatcaccgcccagagacacagaagatacaaggccctggtggccagcgagcccctgagcgtgagactgtacagactgggcctggcctacctggccttcaccggccccctggcctacagcgccctgtgcaacaccgccgccaccctgagctacgtggccgagaccttcggcagcttcctgaactggttcagcttcttccccctgctgggcagactgatggagttcgtgctgctgctgccctacagaatctggagactgctgatgggcgagaccggcttcaacagcagctgcttccaggagtgggccaagctgtacgagttcgtgcacagcttccaggacgagaagagacagctggcctaccaggtgctgggcctgagcgagggcgccaccaacgaggagatccacagaagctaccaggagctggtgaaggtgtggcaccccgaccacaacctggaccagaccgaggaggcccagagacacttcctggagatccaggccgcctacgaggtgctgagccagcccagaaagccctggggcagcagaagatag

SEQ ID NO: 17962 - DNA, 1026 bp, Artificial Sequence; identical to SEQ ID NO: 17961
  Description of Artificial Sequence: Synthetic coding sequence

SEQ ID NO: 17963 - DNA, 681 bp, Artificial Sequence
  Description of Artificial Sequence: Synthetic coding sequence
atggccgccatgagatggagatggtggcagagactgctgccctggagactgctgcaggccagaggcttcccccagaacagcgcccccagcctgggcctgggcgccagaacctacagccagggcgactgcagctacagcagaaccgccctgtacgacctgctgggcgtgcccagcaccgccacccaggcccagatcaaggccgcctactacagacagtgcttcctgtaccaccccgacagaaacagcggcagcgccgaggccgccgagagattcaccagaatcagccaggcctacgtggtgctgggcagcgccaccctgagaagaaagtacgacagaggcctgctgagcgacgaggacctgagaggccccggcgtgagacccagcagaacccccgcccccgaccccggcagccccagaacccccccccccaccagcagaacccacgacggcagcagagccagccccggcgccaacagaaccatgttcaacttcgacgccttctaccaggcccactacggcgagcagctggagagagagagaagactgagagccagaagagaggccctgagaaagagacaggagtacagaagcatgaagggcctgagatgggaggacaccagagacaccgccgccatcttcctgatcttcagcatcttcatcatcatcggcttctacatctag

SEQ ID NO: 17964 - DNA, 522 bp, Artificial Sequence
  Description of Artificial Sequence: Synthetic coding sequence
atgagatggagatggtggcagagactgctgccctggagactgctgcaggccagaggcttcccccagaacagcgcccccagcctgggcctgggcgccagaacctacagccagggcgactgcagctacagcagaaccgccctgtacgacctgctgggcgtgcccagcaccgccacccaggcccagatcaaggccgcctactacagacagtgcttcctgtaccaccccgacagaaacagcggcagcgccgaggccgccgagagattcaccagaatcagccaggcctacgtggtgctgggcagcgccaccctgagaagaaagtacgacagaggcctgctgagcgacgaggacctgagaggccccggcgtgagacccagcagaacccccgcccccgaccccggcagccccagaacccccccccccaccagcagaagcatgaagggcctgagatgggaggacaccagagacaccgccgccatcttcctgatcttcagcatcttcatcatcatcggcttctacatctag

SEQ ID NO: 17965 - DNA, 726 bp, Artificial Sequence
  Description of Artificial Sequence: Synthetic coding sequence
atgccccccctgctgcccctgagactgtgcagactgtggcccagaaacccccccagcagactgctgggcgccgccgccggccagagaagcagacccagcacctactacgagctgctgggcgtgcaccccggcgccagcaccgaggaggtgaagagagccttcttcagcaagagcaaggagctgcaccccgacagagaccccggcaaccccagcctgcacagcagattcgtggagctgagcgaggcctacagagtgctgagcagagagcagagcagaagaagctacgacgaccagctgagaagcggcagcccccccaagagccccagaaccaccgtgcacgacaagagcgcccaccagacccacagcagctggaccccccccaacgcccagtactggagccagttccacagcgtgagaccccagggcccccagctgagacagcagcagcacaagcagaacaagcaggtgctgggctactgcctgctgctgatgctggccggcatgggcctgcactacatcgccttcagaaaggtgaagcagatgcacctgaacttcatggacgagaaggacagaatcatcaccgccttctacaacgaggccagagccagagccagagccaacagaggcatcctgcagcaggagagacagagactgggccagagacagcccccccccagcgagcccacccagggccccgagatcgtgcccagaggcgccggcccctag

SEQ ID NO: 17966 - DNA, 537 bp, Artificial Sequence
  Description of Artificial Sequence: Synthetic coding sequence
atgctgagaaccgccctgagaggcgcccccagactgctgagcagagtgcagcccagagccccctgcctgagaagactgtggggcagaggcgccagacccgaggtggccggcagaagaagagcctgggcctggggctggagaagaagcagcagcgagcagggccccggccccgccgccgccctgggcagagtggaggccgcccactaccagctggtgtacacctgcaaggtgtgcggcaccagaagcagcaagagaatcagcaagctggcctaccaccagggcgtggtgatcgtgacctgccccggctgccagaaccaccacatcatcgccgacaacctgggctggttcagcgacctgaacggcaagagaaacatcgaggagatcctgaccgccagaggcgagcaggtgcacagagtggccggcgagggcgccctggagctggtgctggaggccgccggcgcccccaccagcaccgccgcccccgaggccggcgaggacgagggcccccccagccccggcaagaccgagcccagctag

SEQ ID NO: 17967 - DNA, 1617 bp, Artificial Sequence
  Description of Artificial Sequence: Synthetic coding sequence
atgaccagagagtgccccagccccgcccccggccccggcgcccccctgagcggcagcgtgctggccgaggccgccgtggtgttcgccgtggtgctgagcatccacgccaccgtgtgggacagatacagctggtgcgccgtggccctggccgtgcaggccttctacgtgcagtacaagtgggacagactgctgcagcagggcagcgccgtgttccagttcagaatgagcgccaacagcggcctgctgcccgccagcatggtgatgcccctgctgggcctggtgatgaaggagagatgccagaccgccggcaaccccttcttcgagagattcggcatcgtggtggccgccaccggcatggccgtggccctgttcagcagcgtgctggccctgggcatcaccagacccgtgcccaccaacacctgcgtgatcctgggcctggccggcggcgtgatcatctacatcatgaagcacagcctgagcgtgggcgaggtgatcgaggtgctggaggtgctgctgatcttcgtgtacctgaacatgatcctgctgtacctgctgcccagatgcttcacccccggcgaggccctgctggtgctgggcggcatcagcttcgtgctgaaccagctgatcaagagaagcctgaccctggtggagagccagggcgaccccgtggacttcttcctgctggtggtggtggtgggcatggtgctgatgggcatcttcttcagcaccctgttcgtgttcatggacagcggcacctgggccagcagcatcttcttccacctgatgacctgcgtgctgagcctgggcgtggtgctgccctggctgcacagactgatcagaagaaaccccctgctgtggctgctgcagttcctgttccagaccgacaccagaatctacctgctggcctactggagcctgctggccaccctggcctgcctggtggtgctgtaccagaacgccaagagaagcagcagcgagagcaagaagcaccaggcccccaccatcgccagaaagtacttccacctgatcgtggtggccacctacatccccggcatcatcttcgacagacccctgctgtacgtggccgccaccgtgtgcctggccgtgttcatcttcctggagtacgtgagatacttcagaatcaagcccctgggccacaccctgagaagcttcctgagcctgttcctggacgagagagacagcggccccctgatcctgacccacatctacctgctgctgggcatgagcctgcccatctggctgatccccagaccctgcacccagaagggcagcctgggcggcgccagagccctggtgccctacgccggcgtgctggccgtgggcgtgggcgacaccgtggccagcatcttcggcagcaccatgggcgagatcagatggcccggcaccaagaagaccttcgagggcaccatgaccagcatcttcgcccagatcatcagcgtggccctgatcctgatcttcgacagcggcgtggacctgaactacagctacgcctggatcctgggcagcatcagcaccgtgagcctgctggaggcctacaccacccagatcgacaacctgctgctgcccctgtacctgctgatcctgctgatggcctag

SEQ ID NO: 17968 - DNA, 801 bp, Artificial Sequence
  Description of Artificial Sequence: Synthetic coding sequence
atgaccagagagtgccccagccccgcccccggccccggcgcccccctgagcggcagcgtgctggccgaggccgccgtggtgttcgccgtggtgctgagcatccacgccaccgtgtgggacagatacagctggtgcgccgtggccctggccgtgcaggccttctacgtgcagtacaagtgggacagactgctgcagcagggcagcgccgtgttccagttcagaatgagcgccaacagcggcctgctgcccgccagcatggtgatgcccctgctgggcctggtgatgaaggagagatgccagaccgccggcaaccccttcttcgagagattcggcatcgtggtggccgccaccggcatggccgtggccctgttcagcagcgtgctggccctgggcatcaccagacccgtgcccaccaacacctgcgtgatcctgggcctggccggcggcgtgatcatctacatcatgaagcacagcctgagcgtgggcgaggtgatcgaggtgctggaggtgctgctgatcttcgtgtacctgaacatgatcctgctgtacctgctgcccagatgcttcacccccggcgaggccctgctggtgctgggcggcatcagcttcgtgctgaaccagctgatcaagagaagcctgaccctggtggagagccagggcgaccccgtggacttcttcctgctggtggtggtggtgggcatggtgctgatgggcatcttcttcagcaccctgttcgtgttcatggacagcggcaccagacccccccccagccccgagagcatcagcaccagcctgtggtag

SEQ ID NO: 17969 - DNA, 717 bp, Artificial Sequence
  Description of Artificial Sequence: Synthetic coding sequence
atggccgccgacggccagtgcagcctgcccgccagctggagacccgtgaccctgacccacgtggagtaccccgccggcgacctgagcggccacctgctggcctacctgagcctgagccccgtgttcgtgatcgtgggcttcgtgaccctgatcatcttcaagagagagctgcacaccatcagcttcctgggcggcctggccctgaacgagggcgtgaactggctgatcaagaacgtgatccaggagcccagaccctgcggcggcccccacaccgccgtgggcaccaagtacggcatgcccagcagccacagccagttcatgtggttcttcagcgtgtacagcttcctgttcctgtacctgagaatgcaccagaccaacaacgccagattcctggacctgctgtggagacacgtgctgagcctgggcctgctggccgtggccttcctggtgagctacagcagagtgtacctgctgtaccacacctggagccaggtgctgtacggcggcatcgccggcggcctgatggccatcgcctggttcatcttcacccaggaggtgctgacccccctgttccccagaatcgccgcctggcccgtgagcgagttcttcctgatcagagacaccagcctgatccccaacgtgctgtggttcgagtacaccgtgaccagagccgaggccagaaacagacagagaaagctgggcaccaagctgcagtag

SEQ ID NO: 17970 - DNA, 588 bp, Artificial Sequence
  Description of Artificial Sequence: Synthetic coding sequence
atggccgccgacggccagtgcagcctgcccgccagctggagacccgtgaccctgacccacgtggagtaccccgccggcgacctgagcggccacctgctggcctacctgagcctgagccccgtgttcgtgatcgtgggcttcgtgaccctgatcatcttcaagagagagctgcacaccatcagcttcctgggcggcctggccctgaacgagggcgtgaactggctgatcaagaacgtgatccaggagcccagaccctgcggcggcccccacaccgccgtgggcaccaagtacggcatgcccagcagccacagccagttcatgtggttcttcagcgtgtacagcttcctgttcctgtacctgagaatgcaccagaccaacaacgccagattcctggacctgctgtggagacacgtgctgagcctgggcctgctggccgtggccttcctggtgagctacagcagacccgtgagcgagttcttcctgatcagagacaccagcctgatccccaacgtgctgtggttcgagtacaccgtgaccagagccgaggccagaaacagacagagaaagctgggcaccaagctgcagtag

SEQ ID NO: 17971 - DNA, 294 bp, Artificial Sequence
  Description of Artificial Sequence: Synthetic coding sequence
atgcccagcagccacagccagttcatgtggttcttcagcgtgtacagcttcctgttcctgtacctgagaatgcaccagaccaacaacgccagattcctggacctgctgtggagacacgtgctgagcctgggcctgctggccgtggccttcctggtgagctacagcagacccgtgagcgagttcttcctgatcagagacaccagcctgatccccaacgtgctgtggttcgagtacaccgtgaccagagccgaggccagaaacagacagagaaagctgggcaccaagctgcagtag

SEQ ID NO: 17972 - DNA, 1227 bp, Artificial Sequence
  Description of Artificial Sequence: Synthetic coding sequence
atgtgggccttcagcgagctgcccatgcccctgctgatcaacctgatcgtgagcctgctgggcttcgtggccaccgtgaccctgatccccgccttcagaggccacttcatcgccgccagactgtgcggccaggacctgaacaagaccagcagacagcagatccccgagagccagggcgtgatcagcggcgccgtgttcctgatcatcctgttctgcttcatccccttccccttcctgaactgcttcgtgaaggagcagtgcaaggccttcccccaccacgagttcgtggccctgatcggcgccctgctggccatctgctgcatgatcttcctgggcttcgccgacgacgtgctgaacctgagatggagacacaagctgctgctgcccaccgccgccagcctgcccctgctgatggtgtacttcaccaacttcggcaacaccaccatcgtggtgcccaagcccttcagacccatcctgggcctgcacctggacctgggcatcctgtactacgtgtacatgggcctgctggccgtgttctgcaccaacgccatcaacatcctggccggcatcaacggcctggaggccggccagagcctggtgatcagcgccagcatcatcgtgttcaacctggtggagctggagggcgactgcagagacgaccacgtgttcagcctgtacttcatgatccccttcttcttcaccaccctgggcctgctgtaccacaactggtaccccagcagagtgttcgtgggcgacaccttctgctacttcgccggcatgaccttcgccgtggtgggcatcctgggccacttcagcaagaccatgctgctgttcttcatgccccaggtgttcaacttcctgtacagcctgccccagctgctgcacatcatcccctgccccagacacagaatccccagactgaacatcaagaccggcaagctggagatgagctacagcaagttcaagaccaagagcctgagcttcctgggcaccttcatcctgaaggtggccgagagcctgcagctggtgaccgtgcaccagagcgagaccgaggacggcgagttcaccgagtgcaacaacatgaccctgatcaacctgctgctgaaggtgctgggccccatccacgagagaaacctgaccctgctgctgctgctgctgcagatcctgggcagcgccatcaccttcagcatcagataccagctggtgagactgttctacgacgtgtag

SEQ ID NO: 17973 - DNA, 1227 bp, Artificial Sequence; identical to SEQ ID NO: 17972
  Description of Artificial Sequence: Synthetic coding sequence

SEQ ID NO: 17974 - DNA, 984 bp, Artificial Sequence
  Description of Artificial Sequence: Synthetic coding sequence
atgatcttcctgggcttcgccgacgacgtgctgaacctgagatggagacacaagctgctgctgcccaccgccgccagcctgcccctgctgatggtgtacttcaccaacttcggcaacaccaccatcgtggtgcccaagcccttcagacccatcctgggcctgcacctggacctgggcatcctgtactacgtgtacatgggcctgctggccgtgttctgcaccaacgccatcaacatcctggccggcatcaacggcctggaggccggccagagcctggtgatcagcgccagcatcatcgtgttcaacctggtggagctggagggcgactgcagagacgaccacgtgttcagcctgtacttcatgatccccttcttcttcaccaccctgggcctgctgtaccacaactggtaccccagcagagtgttcgtgggcgacaccttctgctacttcgccggcatgaccttcgccgtggtgggcatcctgggccacttcagcaagaccatgctgctgttcttcatgccccaggtgttcaacttcctgtacagcctgccccagctgctgcacatcatcccctgccccagacacagaatccccagactgaacatcaagaccggcaagctggagatgagctacagcaagttcaagaccaagagcctgagcttcctgggcaccttcatcctgaaggtggccgagagcctgcagctggtgaccgtgcaccagagcgagaccgaggacggcgagttcaccgagtgcaacaacatgaccctgatcaacctgctgctgaaggtgctgggccccatccacgagagaaacctgaccctgctgctgctgctgctgcaggtgagaatgggcatcgagttcatccccccctgcctgcccttctgcgtgatcctgacccccgtgcacttcagcctgcagatcctgggcagcgccatcaccttcagcatcagataccagctggtgagactgttctacgacgtgtag

SEQ ID NO: 17975 - DNA, 255 bp, Artificial Sequence
  Description of Artificial Sequence: Synthetic coding sequence
atggccaccggcaccgaccaggtggtgggcctgggcctggtggccgtgagcctgatcatcttcacctactacaccgcctgggtgatcctgctgcccttcatcgacagccagcacgtgatccacaagtacttcctgcccagagcctacgccgtggccatccccctggccgccggcctgctgctgctgctgttcgtgggcctgttcatcagctacgtgatgctgaagaccaagagagtgaccaagaaggcccagtag

SEQ ID NO: 17976 - DNA, 393 bp, Artificial Sequence
  Description of Artificial Sequence: Synthetic coding sequence
atggccaccggcaccgaccaggtggtgggcctgggcctggtggccgtgagcctgatcatcttcacctactacaccgcctgggtgatcctgctgcccttcatcgacagccagcacgtgatccacaagtacttcctgcccagagcctacgccgtggccatccccctggccgccggcctgctgctgctgctgttcgtgggcaagagcagccccccccccctggaccccggccagggcttcggcaagaccccccccctgaacatgctgccccacttcggcggcgccggcagctgcctgcccagaacccacccctggggcttccccgtgcaccccagcagactgcccgtgagcaacctgtgggtgagctggtgccccagactgttcggcctgcagtag

SEQ ID NO: 17977 - DNA, 7110 bp, Artificial Sequence
  Description of Artificial Sequence: Synthetic coding sequence
atgaacaccgaggagctggagctgctgagcgacagcaagtacagaaactacgtggccgccatcgacaaggccctgaagaacttcgagtacagcagcgagtgggccgacctgatcagcgccctgggcaagctgaacaaggtgctgcagaacaacgccaagtaccaggtggtgcccaagaagctgaccatcggcaagagactggcccagtgcctgcaccccgccctgcccggcggcgtgcacagaaaggccctggagacctacgagatcatcttcaagatcatcggccccaagagactggccaaggacctgttcctgtacagcagcggcctgttccccctgctggccaacgccgccatgagcgtgaagcccaccctgctgagcctgtacgagatctactacctgcccctgggcaagaccctgaagcccggcctgcagggcctgctgaccggcatcctgcccggcctggaggagggcagcgagtactacgagagaaccaacatgctgctggagaaggtggccgccgccgtggaccagagcgccttctacagcgccctgtggggcagcctgctgaccagccccgccgtgagactgcccggcatcacctacgtgctggcccacctgaacagaaagctgagcatggaggaccagctgtacatcatcggcagcgacatcgagctgatggtggaggccgtgagcaccagcgtgcaggacagcagcgtgctggtgcagagaagcaccctggacctgatcctgttctgcttccccttccacatgagccaggccaccagacccgacatgatcagaatcctgagcgccgccctgcacgtggtgctgagaagagacatgagcctgaacagaagactgtacgcctggctgctgggccccagaagcaccagacacagcaaccccgaggagcacgccacctactacttcaccaccttcagcaaggagctgctggtgcaggccatggtgggcatcctgcaggtgaacggcttcggcgaggagaacaccctgatgcaggacctgaagcccttcagaatcctgatcagcctgctggacaagcccgagctgggccccgtgatcctggaggacgtgctgatcgaggtgttcagaaccctgtacagccagtgcaaggccgagctggacctgcagaccgagccccccttcagcaaggaccacgcccagctgagcagcaagctgagagagaacaagaagaccgccgagctgatcaagaccgccaacctgctgttcaacagcttcgagccctactacatgtgggactacgtggccagatggttcgaggagtgctgcagaagaaccctgcacgtgagactgcagatcggccccggcgacagcaacgacagcagcgagctgcagctgaccaacttctgcctgctggtggacttcctgctggacatcgtgagcctggagacctacatcgagatccagaccgagcacctgccccagctgctgctgagaatgatcagcgccctgaccagccacctgcagaccctgcacctgagcgagctgaccgacagcctgagactgtgcagcaagatcctgagcaaggtgcagccccccctgctgagcgccagcaccggcggcgtgctgcagttccccagcggccagaacaacagcgtgaaggagtgggaggacaagaaggtgagcagcgtgagccacgagaaccccaccgaggtgttcgaggacggcgagaacccccccagcagcagaagcagcgagagcggcttcaccgagttcatccagtaccaggccgacagaaccgacgacatcgacagagagctgagcgagggccagggcgccgccgccatccccatcggcagcaccagcagcgagaccgagaccgccagcaccgtgggcagcgaggagaccatcatccagacccccagcgtggtgacccagggcaccgccaccagaagcagaaagaccgcccagaagaccgccatgcagtgctgcctggagtacgtgcagcagttcctgaccagactgatcaacctgtacatcatccagaacaacagcttcagccagagcctggccaccgagcaccagggcgacctgggcagagagcagggcgagaccagcaagtgggacagaaacagccagggcgacgtgaaggagaagaacatcagcaagcagaagaccagcaaggagtacctgagcgccttcctggccgcctgccagctgttcctggagtgcagcagcttccccgtgtacatcgccgagggcaaccacaccagcgagctgagaagcgagaagctggagaccgactgcgagcacgtgcagcccccccagtggctgcagaccctgatgaacgcctgcagccaggccagcgacttcagcgtgcagagcgtggccatcagcctggtgatggacctggtgggcctgacccagagcgtggccatggtgaccggcgagaacatcaacagcgtggagcccgcccagcccctgagccccaaccagggcagagtggccgtggtgatcagaccccccctgacccagggcaacctgagatacatcgccgagaagaccgagttcttcaagcacgtggccctgaccctgtgggaccagctgggcgacggcaccccccagcaccaccagaagagcgtggagctgttctaccagctgcacaacctggtgcccagcagcagcatctgcgaggacgtgatcagccagcagctgacccacaaggacaagaagatcagaatggaggcccacgccaagttcgccgtgctgtggcacctgaccagagacctgcacatcaacaagagcagcagcttcgtgagaagcttcgacagaagcctgttcatcatgctggacagcctgaacagcctggacggcagcaccagcagcgtgggccaggcctggctgaaccaggtgctgcagagacacgacatcgccagagtgctggagcccctgctgctgctgctgctgcaccccaagacccagagagtgagcgtgcagagagtgcaggccgagagatactggaacaagagcccctgctaccccggcgaggagagcgacaagcacttcatgcagaacttcgcctgcagcaacgtgagccaggtgcagctgatcaccagcaagggcaacggcgagaagcccctgaccatggacgagatcgagaacttcagcctgaccgtgaaccccctgagcgacagactgagcctgctgagcaccagcagcgagaccatccccatggtggtgagcgacttcgacctgcccgaccagcagatcgagatcctgcagagcagcgacagcggctgcagccagagcagcgccggcgacaacctgagctacgaggtggaccccgagaccgtgaacgcccaggaggacagccagatgcccaaggagagcagccccgacgacgacgtgcagcaggtggtgttcgacctgatctgcaaggtggtgagcggcctggaggtggagagcgccagcgtgaccagccagctggagatcgaggccatgccccccaagtgcagcgacatcgaccccgacgaggagaccatcaagatcgaggacgacagcatccagcagagccagaacgccctgctgagcaacgagagcagccagttcctgagcgtgagcgccgagggcggccacgagtgcgtggccaacggcatcagcagaaacagcagcagcccctgcatcagcggcaccacccacaccctgcacgacagcagcgtggccagcatcgagaccaagagcagacagagaagccacagcagcatccagttcagcttcaaggagaagctgagcgagaaggtgagcgagaaggagaccatcgtgaaggagagcggcaagcagcccggcgccaagcccaaggtgaagctggccagaaagaaggacgacgacaagaagaagagcagcaacgagaagctgaagcagaccagcgtgttcttcagcgacggcctggacctggagaactggtacagctgcggcgagggcgacatcagcgagatcgagagcgacatgggcagccccggcagcagaaagagccccaacttcaacatccaccccctgtaccagcacgtgctgctgtacctgcagctgtacgacagcagcagaaccctgtacgccttcagcgccatcaaggccatcctgaagaccaaccccatcgccttcgtgaacgccatcagcaccaccagcgtgaacaacgcctacaccccccagctgagcctgctgcagaacctgctggccagacacagaatcagcgtgatgggcaaggacttctacagccacatccccgtggacagcaaccacaacttcagaagcagcatgtacatcgagatcctgatcagcctgtgcctgtactacatgagaagccactaccccacccacgtgaaggtgaccgcccaggacctgatcggcaacagaaacatgcagatgatgagcatcgagatcctgaccctgctgttcaccgagctggccaaggtgatcgagagcagcgccaagggcttccccagcttcatcagcgacatgctgagcaagtgcaaggtgcagaaggtgatcctgcactgcctgctgagcagcatcttcagcgcccagaagtggcacagcgagaagatggccggcaagaacctggtggccgtggaggagggcttcagcgaggacagcctgatcaacttcagcgaggacgagttcgacaacggcagcaccctgcagagccagctgctgaaggtgctgcagagactgatcgtgctggagcacagagtgatgaccatccccgaggagaacgagaccggcttcgacttcgtggtgagcgacctggagcacatcagcccccaccagcccatgaccagcctgcagtacctgcacgcccagcccatcacctgccagggcatgttcctgtgcgccgtgatcagagccctgcaccagcactgcgcctgcaagatgcacccccagtggatcggcctgatcaccagcaccctgccctacatgggcaaggtgctgcagagagtggtggtgagcgtgaccctgcagctgtgcagaaacctggacaacctgatccagcagtacaagtacgagaccggcctgagcgacagcagacccctgtggatggccagcatcatcccccccgacatgatcctgaccctgctggagggcatcaccgccatcatccactactgcctgctggaccccaccacccagtaccaccagctgctggtgagcgtggaccagaagcacctgttcgaggccagaagcggcatcctgagcatcctgcacatgatcatgagcagcgtgaccctgctgtggagcatcctgcaccaggccgacagcagcgagaagatgaccatcgccgccagcgccagcctgaccaccatcaacctgggcgccaccaagaacctgagacagcagatcctggagctgctgggccccatcagcatgaaccacggcgtgcacttcatggccgccatcgccttcgtgtggaacgagagaagacagaacaagaccaccaccagaaccaaggtgatccccgccgccagcgaggagcagctgctgctggtggagctggtgagaagcatcagcgtgatgagagccgagaccgtgatccagaccgtgaaggaggtgctgaagcagccccccgccatcgccaaggacaagaagcacctgagcctggaggtgtgcatgctgcagttcttctacgcctacatccagagagtgctgaacgagttcatcatgaagaaccccagcctggagaacaagaaggaccagagagacctgcaggacgtgacccacaagatcgtggacgccatcggcgccatcgccggcagcagcctggagcagaccacctggctgagaagaaacctggaggtgaagcccagccccaagatcatggtggacggcaccaacctggagagcgacgtggagggcatcctggtgaagcacctgggcctgctgagcgtgctggcccacctgctggacatggtgttctacagcgacgagaaggagagagtgatccccctgctggtgaacatcatgcactacgtggtgccctacctgagaaaccacagcgcccacaacgcccccagctacagagcctgcgtgcagctgctgagcagcctgagcggctaccagtacaccagaagagcctggaagaaggaggccttcgacctgttcatggaccccagcttcttccagatggacgccagctgcgtgaaccactggagagccatcatggacaacctgatgacccacgacaagaccaccttcagagacctgatgaccagagtggccgtggcccagagcagcagcctgaacctgttcgccaacagagacgtggagctggagcagagagccatgctgctgaagagactggccttcgccatcttcagcagcgagatcgaccagtaccagaagtacctgcccgacatccagggcatccccgtgagcaagtgggtgcagctgctgaccgccctgagccccgcctacagaaccagcggccccagcgtggccggcctggagaccacctacaccggcggcaacggcttcagcaccagctacaacagccagagatggctgaacctgtacctgagcgcctgcaagttcctggacctggccctggccctgcccagcgagaacctgccccagttccagatgtacagatgggccttcatccccgaggccagcgacgacagcggcctggaggtgagaagacagggcatccaccagagagagttcaagccctacgtggtgagactggccaagctgctgagaaagagagccaaggacaaggaggaggacttcaagaccgtgatcctggagggcctggagatggccaagcaccagaagaaccccgaggaggacaacagcggcagaaccctgggctgggagcccggccacctgctgctgaccatctgcaccgtgagaagcatggagcagctgctgcccttcttcaacgtgctgagccaggtgttcaacagcaaggtgaccagcagatgcggcggccacagcggcagccccatcctgtacagcaacgccttccccaacaaggacatgaagctggagaaccacaagccctgcagcagcaaggccagacagaagatcgaggagatggtggagaaggacttcctggagggcatgatcaagacctag

SEQ ID NO: 17978 - DNA, 7398 bp, Artificial Sequence
  Description of Artificial Sequence: Synthetic coding sequence
atgaacaccgaggagctggagctgctgagcgacagcaagtacagaaactacgtggccgccatcgacaaggccctgaagaacttcgagtacagcagcgagtgggccgacctgatcagcgccctgggcaagctgaacaaggtgctgcagaacaacgccaagtaccaggtggtgcccaagaagctgaccatcggcaagagactggcccagtgcctgcaccccgccctgcccggcggcgtgcacagaaaggccctggagacctacgagatcatcttcaagatcatcggccccaagagactggccaaggacctgttcctgtacagcagcggcctgttccccctgctggccaacgccgccatgagcgtgaagcccaccctgctgagcctgtacgagatctactacctgcccctgggcaagaccctgaagcccggcctgcagggcctgctgaccggcatcctgcccggcctggaggagggcagcgagtactacgagagaaccaacatgctgctggagaaggtggccgccgccgtggaccagagcgccttctacagcgccctgtggggcagcctgctgaccagccccgccgtgagactgcccggcatcacctacgtgctggcccacctgaacagaaagctgagcatggaggaccagctgtacatcatcggcagcgacatcgagctgatggtggaggccgtgagcaccagcgtgcaggacagcagcgtgctggtgcagagaagcaccctggacctgatcctgttctgcttccccttccacatgagccaggccaccagacccgacatgatcagaatcctgagcgccgccctgcacgtggtgctgagaagagacatgagcctgaacagaagactgtacgcctggctgctgggcttcgacaacaacggcgccatcatcggccccagaagcaccagacacagcaaccccgaggagcacgccacctactacttcaccaccttcagcaaggagctgctggtgcaggccatggtgggcatcctgcaggtgaacggcttcggcgaggagaacaccctgatgcaggacctgaagcccttcagaatcctgatcagcctgctggacaagcccgagctgggccccgtgatcctggaggacgtgctgatcgaggtgttcagaaccctgtacagccagtgcaaggccgagctggacctgcagaccgagccccccttcagcaaggaccacgcccagctgagcagcaagctgagagagaacaagaagaccgccgagctgatcaagaccgccaacctgctgttcaacagcttcgagccctactacatgtgggactacgtggccagatggttcgaggagtgctgcagaagaaccctgcacgtgagactgcagatcggccccggcgacagcaacgacagcagcgagctgcagctgaccaacttctgcctgctggtggacttcctgctggacatcgtgagcctgcccaccagaagcatgagagtgctgtgccaggagacctacatcgagatccagaccgagcacctgccccagctgctgctgagaatgatcagcgccctgaccagccacctgcagaccctgcacctgagcgagctgaccgacagcctgagactgtgcagcaagatcctgagcaaggtgcagccccccctgctgagcgccagcaccggcggcgtgctgcagttccccagcggccagaacaacagcgtgaaggagtgggaggacaagaaggtgagcagcgtgagccacgagaaccccaccgaggtgttcgaggacggcgagaacccccccagcagcagaagcagcgagagcggcttcaccgagttcatccagtaccaggccgacagaaccgacgacatcgacagagagctgagcgagggccagggcgccgccgccatccccatcggcagcaccagcagcgagaccgagaccgccagcaccgtgggcagcgaggagaccatcatccagacccccagcgtggtgacccagggcaccgccaccagaagcagaaagaccgcccagaagaccgccatgcagtgctgcctggagtacgtgcagcagttcctgaccagactgatcaacctgtacatcatccagaacaacagcttcagccagagcctggccaccgagcaccagggcgacctgggcagagagcagggcgagaccagcaagtgggacagaaacagccagggcgacgtgaaggagaagaacatcagcaagcagaagaccagcaaggagtacctgagcgccttcctggccgcctgccagctgttcctggagtgcagcagcttccccgtgtacatcgccgagggcaaccacaccagcgagctgagaagcgagaagctggagaccgactgcgagcacgtgcagcccccccagtggctgcagaccctgatgaacgcctgcagccaggccagcgacttcagcgtgcagagcgtggccatcagcctggtgatggacctggtgggcctgacccagagcgtggccatggtgaccggcgagaacatcaacagcgtggagcccgcccagcccctgagccccaaccagggcagagtggccgtggtgatcagaccccccctgacccagggcaacctgagatacatcgccgagaagaccgagttcttcaagcacgtggccctgaccctgtgggaccagctgggcgacggcaccccccagcaccaccagaagagcgtggagctgttctaccagctgcacaacctggtgcccagcagcagcatctgcgaggacgtgatcagccagcagctgacccacaaggacaagaagatcagaatggaggcccacgccaagttcgccgtgctgtggcacctgaccagagacctgcacatcaacaagagcagcagcttcgtgagaagcttcgacagaagcctgttcatcatgctggacagcctgaacagcctggacggcagcaccagcagcgtgggccaggcctggctgaaccaggtgctgcagagacacgacatcgccagagtgctggagcccctgctgctgctgctgctgcaccccaagacccagagagtgagcgtgcagagagtgcaggccgagagatactggaacaagagcccctgctaccccggcgaggagagcgacaagcacttcatgcagaacttcgcctgcagcaacgtgagccaggtgcagctgatcaccagcaagggcaacggcgagaagcccctgaccatggacgagatcgagaacttcagcctgaccgtgaaccccctgagcgacagactgagcctgctgagcaccagcagcgagaccatccccatggtggtgagcgacttcgacctgcccgaccagcagatcgagatcctgcagagcagcgacagcggctgcagccagagcagcgccggcgacaacctgagctacgaggtggaccccgagaccgtgaacgcccaggaggacagccagatgcccaaggagagcagccccgacgacgacgtgcagcaggtggtgttcgacctgatctgcaaggtggtgagcggcctggaggtggagagcgccagcgtgaccagccagctggagatcgaggccatgccccccaagtgcagcgacatcgaccccgacgaggagaccatcaagatcgaggacgacagcatccagcagagccagaacgccctgctgagcaacgagagcagccagttcctgagcgtgagcgccgagggcggccacgagtgcgtggccaacggcatcagcagaaacagcagcagcccctgcatcagcggcaccacccacaccctgcacgacagcagcgtggccagcatcgagaccaagagcagacagagaagccacagcagcatccagttcagcttcaaggagaagctgagcgagaaggtgagcgagaaggagaccatcgtgaaggagagcggcaagcagcccggcgccaagcccaaggtgaagctggccagaaagaaggacgacgacaagaagaagagcagcaacgagaagctgaagcagaccagcgtgttcttcagcgacggcctggacctggagaactggtacagctgcggcgagggcgacatcagcgagatcgagagcgacatgggcagccccggcagcagaaagagccccaacttcaacatccaccccctgtaccagcacgtgctgctgtacctgcagctgtacgacagcagcagaaccctgtacgccttcagcgccatcaaggccatcctgaagaccaaccccatcgccttcgtgaacgccatcagcaccaccagcgtgaacaacgcctacaccccccagctgagcctgctgcagaacctgctggccagacacagaatcagcgtgatgggcaaggacttctacagccacatccccgtggacagcaaccacaacttcagaagcagcatgtacatcgagatcctgatcagcctgtgcctgtactacatgagaagccactaccccacccacgtgaaggtgaccgcccaggacctgatcggcaacagaaacatgcagatgatgagcatcgagatcctgaccctgctgttcaccgagctggccaaggtgatcgagagcagcgccaagggcttccccagcttcatcagcgacatgctgagcaagtgcaaggtgcagaaggtgatcctgcactgcctgctgagcagcatcttcagcgcccagaagtggcacagcgagaagatggccggcaagaacctggtggccgtggaggagggcttcagcgaggacagcctgatcaacttcagcgaggacgagttcgacaacggcagcaccctgcagagccagctgctgaaggtgctgcagagactgatcgtgctggagcacagagtgatgaccatccccgaggagaacgagaccggcttcgacttcgtggtgagcgacctggagcacatcagcccccaccagcccatgaccagcctgcagtacctgcacgcccagcccatcacctgccagggcatgttcctgtgcgccgtgatcagagccctgcaccagcactgcgcctgcaagatgcacccccagtggatcggcctgatcaccagcaccctgccctacatgggcaaggtgctgcagagagtggtggtgagcgtgaccctgcagctgtgcagaaacctggacaacctgatccagcagtacaagtacgagaccggcctgagcgacagcagacccctgtggatggccagcatcatcccccccgacatgatcctgaccctgctggagggcatcaccgccatcatccactactgcctgctggaccccaccacccagtaccaccagctgctggtgagcgtggaccagaagcacctgttcgaggccagaagcggcatcctgagcatcctgcacatgatcatgagcagcgtgaccctgctgtggagcatcctgcaccaggccgacagcagcgagaagatgaccatcgccgccagcgccagcctgaccaccatcaacctgggcgccaccaagaacctgagacagcagatcctggagctgctgggccccatcagcatgaaccacggcgtgcacttcatggccgccatcgccttcgtgtggaacgagagaagacagaacaagaccaccaccagaaccaaggtgatccccgccgccagcgaggagcagctgctgctggtggagctggtgagaagcatcagcgtgatgagagccgagaccgtgatccagaccgtgaaggaggtgctgaagcagccccccgccatcgccaaggacaagaagcacctgagcctggaggtgtgcatgctgcagttcttctacgcctacatccagagaatccccgtgcccaacctggtggacagctgggccagcctgctgatcctgctgaaggacagcatccagctgagcctgcccgcccccggccagttcctgatcctgggcgtgctgaacgagttcatcatgaagaaccccagcctggagaacaagaaggaccagagagacctgcaggacgtgacccacaagatcgtggacgccatcggcgccatcgccggcagcagcctggagcagaccacctggctgagaagaaacctggaggtgaagcccagccccaagatcatggtggacggcaccaacctggagagcgacgtggaggacatgctgagccccgccatggagaccgccaacatcacccccagcgtgtacagcgtgcacgccctgaccctgctgagcgaggtgctggcccacctgctggacatggtgttctacagcgacgagaaggagagagtgatccccctgctggtgaacatcatgcactacgtggtgccctacctgagaaaccacagcgcccacaacgcccccagctacagagcctgcgtgcagctgctgagcagcctgagcggctaccagtacaccagaagagcctggaagaaggaggccttcgacctgttcatggaccccagcttcttccagatggacgccagctgcgtgaaccactggagagccatcatggacaacctgatgacccacgacaagaccaccttcagagacctgatgaccagagtggccgtggcccagagcagcagcctgaacctgttcgccaacagagacgtggagctggagcagagagccatgctgctgaagagactggccttcgccatcttcagcagcgagatcgaccagtaccagaagtacctgcccgacatccaggagagactggtggagagcctgagactgccccaggtgcccaccctgcacagccaggtgttcctgttcttcagagtgctgctgctgagaatgagcccccagcacctgaccagcctgtggcccaccatgatcaccgagctggtgcaggtgttcctgctgatggagcaggagctgaccgccgacgaggacatcagcagaaccagcggccccagcgtggccggcctggagaccacctacaccggcggcaacggcttcagcaccagctacaacagccagagatggctgaacctgtacctgagcgcctgcaagttcctggacctggccctggccctgcccagcgagaacctgccccagttccagatgtacagatgggccttcatccccgaggccagcgacgacagcggcctggaggtgagaagacagggcatccaccagagagagttcaagccctacgtggtgagactggccaagctgctgagaaagagagccaagaagaaccccgaggaggacaacagcggcagaaccctgggctgggagcccggccacctgctgctgaccatctgcaccgtgagaagcatggagcagctgctgcccttcttcaacgtgctgagccaggtgttcaacagcaaggtgaccagcagatgcggcggccacagcggcagccccatcctgtacagcaacgccttccccaacaaggacatgaagctggagaaccacaagccctgcagcagcaaggccagacagaagatcgaggagatggtggagaaggacttcctggagggcatgatcaagacctag

SEQ ID NO: 17979 - DNA, 7110 bp, Artificial Sequence; identical to SEQ ID NO: 17977
  Description of Artificial Sequence: Synthetic coding sequence

SEQ ID NO: 17980 - DNA, 690 bp, Artificial Sequence
  Description of Artificial Sequence: Synthetic coding sequence
atgaacaccgaggagctggagctgctgagcgacagcaagtacagaaactacgtggccgccatcgacaaggccctgaagaacttcgagtacagcagcgagtgggccgacctgatcagcgccctgggcaagctgaacaaggtgctgcagaacaacgccaagtaccaggtggtgcccaagaagctgaccatcggcaagagactggcccagtgcctgcaccccgccctgcccggcggcgtgcacagaaaggccctggagacctacgagatcatcttcaagatcatcggccccaagagactggccaaggacctgttcctgtacagcagcggcctgttccccctgctggccaacgccgccatgagcgtgaagcccaccctgctgagcctgtacgagatctactacctgcccctgggcaagaccctgaagcccggcctgcagggcctgctgaccggcatcctgcccggcctggaggagggcagcgagtactacgagagaaccaacatgctgctggagaaggtggccgccgccgtggaccagagcgccttctacagcgccctgtggggcagcctgctgaccagccccgccgtgagactgcccggcatcacctacgtgctggcccacctgaacagaaagctgagcatggaggaccagctgtacatcatcggcagcgacatcgagctgatgaagcagtag

SEQ ID NO: 17981 - DNA, 423 bp, Artificial Sequence
  Description of Artificial Sequence: Synthetic coding sequence
atgcagagactgaacatcggctacgtgatcaacgtgaccacccacctgcccctgtaccactacgagaagggcctgttcaactacaagagactgcccgccaccgacagcaacaagcagaacctgagacagtacttcgaggaggccttcgagttcatcgaggaggcccaccagtgcggcaagggcctgctgatccactgccaggccggcgtgagcagaagcgccaccatcgtgatcgcctacctgatgaagcacaccagaatgaccatgaccgacgcctacaagttcgtgaagggcaagagacccatcatcagccccaacctgaacttcatgggccagctgctggagttcgaggaggacctgaacaacggcgtgacccccagaatcctgacccccaagctgatgggcgtggagaccgtggtgtag

SEQ ID NO: 17982 - DNA, 1449 bp, Artificial Sequence
  Description of Artificial Sequence: Synthetic coding sequence
atgccccccagccccctggacgacagagtggtggtggccctgagcagacccgtgagaccccaggacctgaacctgtgcctggacagcagctacctgggcagcgccaaccccggcagcaacagccacccccccgtgatcgccaccaccgtggtgagcctgaaggccgccaacctgacctacatgcccagcagcagcggcagcgccagaagcctgaactgcggctgcagcagcgccagctgctgcaccgtggccacctacgacaaggacaaccaggcccagacccaggccatcgccgccggcaccaccaccaccgccatcggcaccagcaccacctgccccgccaaccagatggtgaacaacaacgagaacaccggcagcctgagccccagcagcggcgtgggcagccccgtgagcggcacccccaagcagctggccagcatcaagatcatctaccccaacgacctggccaagaagatgaccaagtgcagcaagagccacctgcccagccagggccccgtgatcatcgactgcagacccttcatggagtacaacaagagccacatccagggcgccgtgcacatcaactgcgccgacaagatcagcagaagaagactgcagcagggcaagatcaccgtgctggacctgatcagctgcagagagggcaaggacagcttcaagagaatcttcagcaaggagatcatcgtgtacgacgagaacaccaacgagcccagcagagtgatgcccagccagcccctgcacatcgtgctggagagcctgaagagagagggcaaggagcccctggtgctgaagggcggcctgagcagcttcaagcagaaccacgagaacctgtgcgacaacagcctgcagctgcaggagtgcagagaggtgggcggcggcgccagcgccgccagcagcctgctgccccagcccatccccaccacccccgacatcgagaacgccgagctgacccccatcctgcccttcctgttcctgggcaacgagcaggacgcccaggacctggacaccatgcagagactgaacatcggctacgtgatcaacgtgaccacccacctgcccctgtaccactacgagaagggcctgttcaactacaagagactgcccgccaccgacagcaacaagcagaacctgagacagtacttcgaggaggccttcgagttcatcgaggaggcccaccagtgcggcaagggcctgctgatccactgccaggccggcgtgagcagaagcgccaccatcgtgatcgcctacctgatgaagcacaccagaatgaccatgaccgacgcctacaagttcgtgaagggcaagagacccatcatcagccccaacctgaacttcatgggccagctgctggagttcgaggaggacctgaacaacggcgtgacccccagaatcctgacccccaagctgatgggcgtggagaccgtggtgtag

SEQ ID NO: 17983 - DNA, 1284 bp, Artificial Sequence
  Description of Artificial Sequence: Synthetic coding sequence
atgccccccagccccctggacgacagagtggtggtggccctgagcagacccgtgagaccccaggacctgaacctgtgcctggacagcagctacctgggcagcgccaaccccggcagcaacagccacccccccgtgatcaccaccaccgccatcggcaccagcaccacctgccccgccaaccagatggtgaacaacaacgagaacaccggcagcctgagccccagcagcggcgtgggcagccccgtgagcggcacccccaagcagctggccagcatcaagatcatctaccccaacgacctggccaagaagatgaccaagtgcagcaagagccacctgcccagccagggccccgtgatcatcgactgcagacccttcatggagtacaacaagagccacatccagggcgccgtgcacatcaactgcgccgacaagatcagcagaagaagactgcagcagggcaagatcaccgtgctggacctgatcagctgcagagagggcaaggacagcttcaagagaatcttcagcaaggagatcatcgtgtacgacgagaacaccaacgagcccagcagagtgatgcccagccagcccctgcacatcgtgctggagagcctgaagagagagggcaaggagcccctggtgctgaagggcggcctgagcagcttcaagcagaaccacgagaacctgtgcgacaacagcctgcagctgcaggagtgcagagaggtgggcggcggcgccagcgccgccagcagcctgctgccccagcccatccccaccacccccgacatcgagaacgccgagctgacccccatcctgcccttcctgttcctgggcaacgagcaggacgcccaggacctggacaccatgcagagactgaacatcggctacgtgatcaacgtgaccacccacctgcccctgtaccactacgagaagggcctgttcaactacaagagactgcccgccaccgacagcaacaagcagaacctgagacagtacttcgaggaggccttcgagttcatcgaggaggcccaccagtgcggcaagggcctgctgatccactgccaggccggcgtgagcagaagcgccaccatcgtgatcgcctacctgatgaagcacaccagaatgaccatgaccgacgcctacaagttcgtgaagggcaagagacccatcatcagccccaacctgaacttcatgggccagctgctggagttcgaggaggacctgaacaacggcgtgacccccagaatcctgacccccaagctgatgggcgtggagaccgtggtgtag

SEQ ID NO: 17984 - DNA, 423 bp, Artificial Sequence; identical to SEQ ID NO: 17981
  Description of Artificial Sequence: Synthetic coding sequence

SEQ ID NO: 17985 - DNA, 888 bp, Artificial Sequence
  Description of Artificial Sequence: Synthetic coding sequence
atgaccgagggcgtgctgcccggcctgtacctgggcaacttcatcgacgccaaggacctggaccagctgggcagaaacaagatcacccacatcatcagcatccacgagagcccccagcccctgctgcaggacatcacctacctgagaatccccgtggccgacacccccgaggtgcccatcaagaagcacttcaaggagtgcatcaacttcatccactgctgcagactgaacggcggcaactgcctggtgcactgcttcgccggcatcagcagaagcaccaccatcgtgaccgcctacgtgatgaccgtgaccggcctgggctggagagacgtgctggaggccatcaaggccaccagacccatcgccaaccccaaccccggcttcagacagcagctggaggagttcggctgggccagcagccagaagggcgccagacacagaaccagcaagaccagcggcgcccagtgcccccccatgaccagcgccacctgcctgctggccgccagagtggccctgctgagcgccgccctggtgagagaggccaccggcagaaccgcccagagatgcagactgagccccagagccgccgccgagagactgctgggcccccccccccacgtggccgccggctggagccccgaccccaagtaccagatctgcctgtgcttcggcgaggaggaccccggccccacccagcaccccaaggagcagctgatcatggccgacgtgcaggtgcagctgagacccggcagcagcagctgcaccctgagcgccagcaccgagagacccgacggcagcagcacccccggcaaccccgacggcatcacccacctgcagtgcagctgcctgcaccccaagagagccgccagcagcagctgcaccagatag

SEQ ID NO: 17986 - DNA, 708 bp, Artificial Sequence
  Description of Artificial Sequence: Synthetic coding sequence
atgggcaacggcatgaccaaggtgctgcccggcctgtacctgggcaacttcatcgacgccaaggacctggaccagctgggcagaaacaagatcacccacatcatcagcatccacgagagcccccagcccctgctgcaggacatcacctacctgagaatccccgtggccgacacccccgaggtgcccatcaagaagcacttcaaggagtgcatcaacttcatccactgctgcagactgaacggcggcaactgcctggtgcactgcttcgccggcatcagcagaagcaccaccatcgtgaccgcctacgtgatgaccgtgaccggcctgggctggagagacgtgctggaggccatcaaggccaccagacccatcgccaaccccaaccccggcttcagacagcagctggaggagttcggctgggccagcagccagaagctgagaagacagctggaggagagattcggcgagagccccttcagagacgaggaggagctgagagccctgctgcccctgtgcaagagatgcagacagggcagcgccaccagcgccagcagcgccggcccccacagcgccgccagcgagggcaccgtgcagagactggtgcccagaacccccagagaggcccacagacccctgcccctgctggccagagtgaagcagaccttcagctgcctgcccagatgcctgagcagaaagggcggcaagtag

SEQ ID NO: 17987 - DNA, 264 bp, Artificial Sequence
  Description of Artificial Sequence: Synthetic coding sequence
atgggcaacggcatgaccaagatgcccaagacctggatcagctgggccgagatcagaagccacaccagcagcctgagcatgagccaccccagcctgtgctgcagaatcagccccaccttcgccagcagaagcctgatccccctgagataccccagcaagagcaccagcaagaacgtgagcaccagcagcaccgccgccgccctgatgggcggcaccgccctgtgcaccgccctgcaggccagcctggccgcccccagactgtag

SEQ ID NO: 17988 - DNA, 699 bp, Artificial Sequence
  Description of Artificial Sequence: Synthetic coding sequence
atgaccgagggcgtgctgcccggcctgtacctgggcaacttcatcgacgccaaggacctggaccagctgggcagaaacaagatcacccacatcatcagcatccacgagagcccccagcccctgctgcaggacatcacctacctgagaatccccgtggccgacacccccgaggtgcccatcaagaagcacttcaaggagtgcatcaacttcatccactgctgcagactgaacggcggcaactgcctggtgcactgcttcgccggcatcagcagaagcaccaccatcgtgaccgcctacgtgatgaccgtgaccggcctgggctggagagacgtgctggaggccatcaaggccaccagacccatcgccaaccccaaccccggcttcagacagcagctggaggagttcggctgggccagcagccagaagctgagaagacagctggaggagagattcggcgagagccccttcagagacgaggaggagctgagagccctgctgcccctgtgcaagagatgcagacagggcagcgccaccagcgccagcagcgccggcccccacagcgccgccagcgagggcaccgtgcagagactggtgcccagaacccccagagaggcccacagacccctgcccctgctggccagagtgaagcagaccttcagctgcctgcccagatgcctgagcagaaagggcggcaagtag

SEQ ID NO: 17989 - DNA, 399 bp, Artificial Sequence
  Description of Artificial Sequence: Synthetic coding sequence
atgaccgtgaccggcctgggctggagagacgtgctggaggccatcaaggccaccagacccatcgccaaccccaaccccggcttcagacagcagctggaggagttcggctgggccagcagccagaagctgagaagacagctggaggagagattcggcgagagccccttcagagacgaggaggagctgagagccctgctgcccctgtgcaagagatgcagacagggcagcgccaccagcgccagcagcgccggcccccacagcgccgccagcgagggcaccgtgcagagactggtgcccagaacccccagagaggcccacagacccctgcccctgctggccagagtgaagcagaccttcagctgcctgcccagatgcctgagcagaaagggcggcaagtag

SEQ ID NO: 17990 - DNA, 399 bp, Artificial Sequence; identical to SEQ ID NO: 17989
  Description of Artificial Sequence: Synthetic coding sequence

SEQ ID NO: 17991 - DNA, 282 bp, Artificial Sequence
  Description of Artificial Sequence: Synthetic coding sequence
tgaaccagactgccccccggcggctggagccccgaccccaagtaccagatctgcctgtgcttcggcgaggaggaccccggccccacccagcaccccaaggagcagctgatcatggccgacgtgcaggtgcagctgagacccggcagcagcagctgcaccctgagcgccagcaccgagagacccgacggcagcagcacccccggcaaccccgacggcatcacccacctgcagtgcagctgcctgcaccccaagagagccgccagcagcagctgcaccagatag

SEQ ID NO: 17992 - DNA, 399 bp, Artificial Sequence; identical to SEQ ID NO: 17989
  Description of Artificial Sequence: Synthetic coding sequence

SEQ ID NO: 17993 - DNA, 2514 bp, Artificial Sequence
  Description of Artificial Sequence: Synthetic coding sequence
atggccaaggccgccgccagcagcagcctggaggacctggacctgagcggcgaggaggtgcagagactgaccagcgccttccaggaccccgagttcagaagaatgttcagccagtacgccgaggagctgaccgaccccgagaacagaagaagatacgaggccgagatcaccgccctggagagagagagaggcgtggaggtgagattcgtgcaccccgagcccggccacgtgctgagaaccagcctggacggcgccagaagatgcttcgtgaacgtgtgcagcaacgccctggtgggcgcccccagcagcagacccggcagcggcggcgacagaggcgccgcccccggcagccactggagcctgccctacagcctggcccccggcagagagtacgccggcagaagcagcagcagatacatggtgtacgacgtggtgttccaccccgacgccctggccctggccagaagacacgagggcttcagacagatgctggacgccaccgccctggaggccgtggagaagcagttcggcgtgaagctggacagaagaaacgccaagaccctgaaggccaagtacaagggcacccccgaggccgccgtgctgagaacccccctgcccggcgtgatccccgccagacccgacggcgagcccaagggccccctgcccgacttcccctacccctaccagtaccccgccgcccccggccccagagcccccagcccccccgaggccgccctgcagcccgcccccaccgagcccagatacagcgtggtgcagagacaccacgtggacctgcaggactacagatgcagcagagacagcgcccccagccccgtgccccacgagctggtgatcaccatcgagctgcccctgctgagaagcgccgagcaggccgccctggaggtgaccagaaagctgctgtgcctggacagcagaaagcccgactacagactgagactgagcctgccctaccccgtggacgacggcagaggcaaggcccagttcaacaaggccagaagacagctggtggtgaccctgcccgtggtgctgcccgccgccagaagagagcccgccgtggccgtggccgccgccgcccccgaggagagcgccgacagaagcggcaccgacggccaggcctgcgccagcgccagagagggcgaggccggccccgccagaagcagagccgaggacggcggccacgacacctgcgtggccggcgccgccggcagcggcgtgaccaccctgggcgaccccgaggtggcccccccccccgccgccgccggcgaggagagagtgcccaagcccggcgagcaggacctgagcagacacgccggcagcccccccggcagcgtggaggagcccagccccggcggcgagaacagccccggcggcggcggcagcccctgcctgagcagcagaagcctggcctggggcagcagcgccggcagagagagcgccagaggcgacagcagcgtggagaccagagaggagagcgagggcaccggcggccagagaagcgcctgcgccatgggcggccccggcaccaagagcggcgagcccctgtgcccccccctgctgtgcaaccaggacaaggagaccctgaccctgctgatccaggtgcccagaatccagccccagagcctgcagggcgacctgaaccccctgtggtacaagctgagattcagcgcccaggacctggtgtacagcttcttcctgcagttcgcccccgagaacaagctgagcaccaccgagcccgtgatcagcatcagcagcaacaacgccgtgatcgagctggccaagagccccgagagccacggccactggagagagtggtactacggcgtgaacaacgacagcctggaggagagactgttcgtgaacgaggagaacgtgaacgagttcctggaggaggtgctgagcagccccttcaagcagagcatgagcctgaccccccccctgatcgaggtgctgcaggtgaccgacaacaagatccagatcaacgccaagctgcaggagtgcagcaacagcgaccagctgcagggcaaggaggagagagtgaacgaggagagccacctgaccgagaaggagtacatcgagcactgcaacacccccaccaccgacagcgacagcagcatcgccgtgaaggccctgcagatcgacagcttcggcctggtgacctgcttccagcaggagagcctggacgtgagccagatgatcctgggcaagagccagcagcccgagagcaagatgcagagcgagttcatcaaggagaagagcgccacctgcagcaacgaggagaaggacaacctgaacgagagcgtgatcaccgaggagaaggagaccgacggcgaccacctgagcagcctgctgaacaagaccaccgtgcacaacatccccggcttcgacagcatcaaggagaccaacatgcaggacggcagcgtgcaggtgatcaaggaccacgtgaccaactgcgccttcagcttccagaacagcctgctgtacgacctggactag

SEQ ID NO: 17994 - DNA, 2370 bp, Artificial Sequence
  Description of Artificial Sequence: Synthetic coding sequence
atggccaaggccgccgccagcagcagcctggaggacctggacctgagcggcgaggaggtgcagagactgaccagcgccttccaggaccccgagttcagaagaatgttcagccagtacgccgaggagctgaccgaccccgagaacagaagaagatacgaggccgagatcaccgccctggagagagagagaggcgtggaggtgagattcgtgcaccccgagcccggccacgtgctgagaaccagcctggacggcgccagaagatgcttcgtgaacgtgtgcagcaacgccctggtgggcgcccccagcagcagacccggcagcggcggcgacagaggcgccgcccccggcagccactggagcctgccctacagcctggcccccggcagagagtacgccggcagaagcagcagcagatacatggtgtacgacgtggtgttccaccccgacgccctggccctggccagaagacacgagggcttcagacagatgctggacgccaccgccctggaggccgtggagaagcagttcggcgtgaagctggacagaagaaacgccaagaccctgaaggccaagtacaagggcacccccgaggccgccgtgctgagaacccccctgcccggcgtgatccccgccagacccgacggcgagcccaagggccccctgcccgacttcccctacccctaccagtaccccgccgcccccggccccagagcccccagcccccccgaggccgccctgcagcccgcccccaccgagcccagatacagcgtggtgcagagacaccacgtggacctgcaggactacagatgcagcagagacagcgcccccagccccgtgccccacgagctggtgatcaccatcgagctgcccctgctgagaagcgccgagcaggccgccctggaggtgaccagaaagctgctgtgcctggacagcagaaagcccgactacagactgagactgagcctgccctaccccgtggacgacggcagaggcaaggcccagttcaacaaggccagaagacagctggtggtgaccctgcccgtggtgctgcccgccgccagaagagagcccgccgtggccgtggccgccgccgcccccgaggagagcgccgacagaagcggcaccgacggccaggcctgcgccagcgccagagagggcgaggccggccccgccagaagcagagccgaggacggcggccacgacacctgcgtggccggcgccgccggcagcggcgtgaccaccctgggcgaccccgaggtggcccccccccccgccgccgccggcgaggagagagtgcccaagcccggcgagcaggacctgagcagacacgccggcagcccccccggcagcgtggaggagcccagccccggcggcgagaacagccccggcggcggcggcagcccctgcctgagcagcagaagcctggcctggggcagcagcgccggcagagagagcgccagaggcgacagcagcgtggagaccagagaggagagcgagggcaccggcggccagagaagcgcctgcgccatgggcggccccggcaccaagagcggcgagcccctgtgcccccccctgctgtgcaaccaggacaaggagaccctgaccctgctgatccaggtgcccagaatccagccccagagcctgcagggcgacctgaaccccctgtggtacaagctgagattcagcgcccaggacctggtgtacagcttcttcctgcagttcgcccccgagaacaagctgagcaccaccgagcccgtgatcagcatcagcagcaacaacgccgtgatcgagctggccaagagccccgagagccacggccactggagagagtggtactacggcgtgaacaacgacagcctggagctgcaggagtgcagcaacagcgaccagctgcagggcaaggaggagagagtgaacgaggagagccacctgaccgagaaggagtacatcgagcactgcaacacccccaccaccgacagcgacagcagcatcgccgtgaaggccctgcagatcgacagcttcggcctggtgacctgcttccagcaggagagcctggacgtgagccagatgatcctgggcaagagccagcagcccgagagcaagatgcagagcgagttcatcaaggagaagagcgccacctgcagcaacgaggagaaggacaacctgaacgagagcgtgatcaccgaggagaaggagaccgacggcgaccacctgagcagcctgctgaacaagaccaccgtgcacaacatccccggcttcgacagcatcaaggagaccaacatgcaggacggcagcgtgcaggtgatcaaggaccacgtgaccaactgcgccttcagcttccagaacagcctgctgtacgacctggactag

SEQ ID NO: 17995 - DNA, 2154 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagcgagagcagcagagccagcggcctggtgggcagaaaggccaccgaggacttcctgggcagcagcagcggctacagcagcgaggacgactacgtgggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagaagattcagcagcctgaagaccttcctgtggttcctgctgcccctgctgctgctgacctgcctgacctacggcgcctggtacttctacccctacggcctgcagaccttccaccccgccctggtgagctggtgggccgccaaggacagcagaagacccgacgagggctgggaggccagagacagcagcccccacttccaggccgagcagagagtgatgagcagagtgcacagcctggagagaagactggaggccctggccgccgagttcagcagcaactggcagaaggaggccatgagactggagagactggagctgagacagggcgcccccggccagggcggcggcggcggcctgagccacgaggacaccctggccctgctggagggcctggtgagcagaagagaggccgccctgaaggaggacttcagaagagagaccgccgccagaatccaggaggagctgagcgccctgagagccgagcaccagcaggacagcgaggacctgttcaagaagatcgtgagagccagccaggagagcgaggccagaatccagcagctgaagagcgagtggcagagcatgacccaggagagcttccaggagagcagcgtgaaggagctgagaagactggaggaccagctggccggcctgcagcaggagctggccgccctggccctgaagcagagcagcgtggccgaggaggtgggcctgctgccccagcagatccaggccgtgagagacgacgtggagagccagttccccgcctggatcagccagttcctggccagaggcggcggcggcagagtgggcctgctgcagagagaggagatgcaggcccagctgagagagctggagagcaagatcctgacccacgtggccgagatgcagggcaagagcgccagagaggccgccgccagcctgagcctgaccctgcagaaggagggcgtgatcggcgtgaccgaggagcaggtgcaccacatcgtgaagcaggccctgcagagatacagcgaggacagaatcggcctggccgactacgccctggagagcggcggcgccagcgtgatcagcaccagatgcagcgagacctacgagaccaagaccgccctgctgagcctgttcggcatccccctgtggtaccacagccagagccccagagtgatcctgcagcccgacgtgcaccccggcaactgctgggccttccagggcccccagggcttcgccgtggtgagactgagcgccagaatcagacccaccgccgtgaccctggagcacgtgcccaaggccctgagccccaacagcaccatcagcagcgcccccaaggacttcgccatcttcggcttcgacgaggacctgcagcaggagggcaccctgctgggcaagttcacctacgaccaggacggcgagcccatccagaccttccacttccaggcccccaccatggccacctaccaggtggtggagctgagaatcctgaccaactggggccaccccgagtacacctgcatctacagattcagagtgcacggcgagcccgcccactag

SEQ ID NO: 17996 - DNA, 1572 bp, Artificial Sequence
  Description of Artificial Sequence: Synthetic coding sequence
atggccgccgtgggcagagtgggcagcttcggcagcagcccccccggcctgagcagcacctacaccggcggccccctgggcaacgagatcgccagcggcaacggcggcgccgccgccggcgacgacgaggacggccagaacctgtggagctgcatcctgagcgaggtgagcaccagaagcagaagcaagctgcccgccggcaagaacgtgctgctgctgggcgaggacggcgccggcaagaccagcctgatcagaaagatccagggcatcgaggagtacaagaagggcagaggcctggagtacctgtacctgaacgtgcacgacgaggacagagacgaccagaccagatgcaacgtgtggatcctggacggcgacctgtaccacaagggcctgctgaagttcagcctggacgccgtgagcctgaaggacaccctggtgatgctggtggtggacatgagcaagccctggaccgccctggacagcctgcagaagtgggccagcgtggtgagagagcacgtggacaagctgaagatcccccccgaggagatgaagcagatggagcagaagctgatcagagacttccaggagtacgtggagcccggcgaggacttccccgccagcccccagagaagaaacaccgccagccaggaggacaaggacgacagcgtggtgctgcccctgggcgccgacaccctgacccacaacctgggcatccccgtgctggtggtgtgcaccaagtgcgacgccatcagcgtgctggagaaggagcacgactacagagacgagcacttcgacttcatccagagccacatcagaaagttctgcctgcagtacggcgccgccctgatctacaccagcgtgaaggagaacaagaacatcgacctggtgtacaagtacatcgtgcagaagctgtacggcttcccctacaagatccccgccgtggtggtggagaaggacgccgtgttcatccccgccggctgggacaacgacaagaagatcggcatcctgcacgagaacttccagaccctgaaggccgaggacaacttcgaggacatcatcaccaagccccccgtgagaaagttcgtgcacgagaaggagatcatggccgaggacgaccaggtgttcctgatgaagctgcagagcctgctggccaagcagccccccaccgccgccggcagacccgtggacgccagccccagagtgcccggcggcagccccagaacccccaacagaagcgtgagcagcaacgtggccagcgtgagccccatccccgccggcagcaagaagatcgaccccaacatgaaggccggcgccaccagcgagggcgtgctggccaacttcttcaacagcctgctgagcaagaagaccggcagccccggcggccccggcgtgagcggcggcagccccgccggcggcgccggcggcggcagcagcggcctgccccccagcaccaagaagagcggccagaagcccgtgctggacgtgcacgccgagctggacagaatcaccagaaagcccgtgaccgtgagccccaccacccccaccagccccaccgagggcgaggccagctag

SEQ ID NO: 17997 - DNA, 351 bp, Artificial Sequence
  Description of Artificial Sequence: Synthetic coding sequence
atggaggagtaccacagacactgcgacgaggtgggcttcaacgccgaggaggcccacaacatcgtgaaggagtgcgtggacggcgtgctgggcggcgaggactacaaccacaacaacatcaaccagtggaccgccagcatcgtggagcagagcctgacccacctggtgaagctgggcaaggcctacaagtacatcgtgacctgcgccgtggtgcagaagagcgcctacggcttccacaccgccagcagctgcttctgggacaccaccagcgacggcacctgcaccgtgagatgggagaacagaaccatgaactgcatcgtgaacgtgttcgccatcgccatcgtgctgtag

SEQ ID NO: 17998 - DNA, 459 bp, Artificial Sequence
  Description of Artificial Sequence: Synthetic coding sequence
atggaggagtaccacagacactgcgacgaggtgggcttcaacgccgaggaggcccacaacatcgtgaaggagtgcgtggacggcgtgctgggcggcgaggactacaaccacaacaacatcaaccagtggaccgccagcatcgtggagcagagcctgacccacctggtgaagctgggcaaggcctacaagtacatcgtgacctgcgccgtggtgcagaagagcgcctacggcttccacaccgccagcagctgcttctgggacaccaccagcgacggcacctgcaccgtgagatgggagaacagaaccatgaactgcggcgtgctgctgtgcagacccggctggagcgccgtgatgcagttcagactgaccgccaccagcgccagccaggtgcaggtgatcctgctgccccagccccccgagtacctggagctgcaggcccacgccatcacccccggctag

SEQ ID NO: 17999 - DNA, 369 bp, Artificial Sequence
  Description of Artificial Sequence: Synthetic coding sequence
atggccagaagcctgggcgtgctggtggccctgcccttccccctgcccgtgggcttcaacgccgaggaggcccacaacatcgtgaaggagtgcgtggacggcgtgctgggcggcgaggactacaaccacaacaacatcaaccagtggaccgccagcatcgtggagcagagcctgacccacctggtgaagctgggcaaggcctacaagtacatcgtgacctgcgccgtggtgcagaagagcgcctacggcttccacaccgccagcagctgcttctgggacaccaccagcgacggcacctgcaccgtgagatgggagaacagaaccatgaactgcatcgtgaacgtgttcgccatcgccatcgtgctgtag

SEQ ID NO: 18000 - DNA, 1737 bp, Artificial Sequence
  Description of Artificial Sequence: Synthetic coding sequence
atggaccccgacaagcaggacgccctgaacagcatcgagaacagcatctacagaaccgccttcaagctgcagagcgtgcagaccctgtgccagctggacctgatcgacagcagcctgatccagcaggtgctgctgagacccagcttctgggaggccagaaagcacagcctgagcgtgcagcagctgagccaggccctgcaggagctgttccagaaggccagagaggagaaccccggccaggtgcaccccagagcccccgagctgaccctgagcctgctgaccaccatgtacaacagcaagggcaccggcttcctgcagctgatgcccgccgccgccgccctgatcaccctgagcggcgacagccccctgagcaagtacagagccctgttccagctgtacgccgagaacagcagaggcggctacgacagcggccccagaatgaccagaagagtgctgagaaagctgctgaccgacctgcagcagatccccaccttcgtgggcgagagcagagccctgtgccccgtggagagcgccaccagaagctgcttccagggcgtgctgagccccgccatcaaggaggagaagttcctgagctgggtgcagagcgagccccccatcctgctgtggctgcccacctgccacagactgagcgccgccgagagagtgacccaccccgccagatgcaccctgtgcagaaccttccccatcaccggcctgagatacagatgcctgaagtgcctgaacttcgacatctgccagatgtgcttcctgagcggcctgcacagcaagagccaccagaagagccaccccgtgatcgagcactgcatccagatgagcgccatgcagaacaccaagctgctgttcagaaccctgagaaacaacctgctgcagggcagatgcagaaagaaggaggccgccagaagacagcagctgctggaccaggtgaaccccaagggcgtgccccaccacgcccaggccagactgctgaagaagcagctgaaccagtacaaggacaagctgcaggccatctacaccagccaggaggagagaatctgcagattcgagaccagaatccacaagctgaagaccaaccaggacagcctgtggaccaagctgcagcagatcagaagagacctgcaggccagactgcagccccccggccccagcagcagcagcttccagaacgtgggcaacaaggtggaccacagcagcaccgagaaggtgcccaagggcggcgactacctgcagatcaagaacgccaccgaggacgccagcaccggcgagcccctgcccaagctggacgaggtggacagaagccacagaagccacaccaacgccgagcacgccctgagaaaccccgagagccccgagaccaccctgcacagcaccagagcccagagccagacccagaagatgccccagaaggtgatcagcgccctgcccagctaccaggagggcctgaagcaggacatccccaagatggtgcccgccgagatgagcagccccgccctggccgccgtggagaagaaggaggccggcaacatcaaggagagaaaggacgagctggaggaggaggagctgcaggagctgctgagcaagctgatggacgccttcaacctggagacccccagcggccccgagagcagcgtgaacatggacctgtacagcggcgcccagagagtgtgcagagccttcagcgccctggtggaccagatcgccctgcccaacctgaagtag

SEQ ID NO: 18001 - DNA, 858 bp, Artificial Sequence
  Description of Artificial Sequence: Synthetic coding sequence
atgaacagactgcccgacgactacgacccctacgccgtggaggagcccagcgacgaggagcccgccctgagcagcagcgaggacgaggtggacgtgctgctgcacggcacccccgaccagaagagaaagctgatcagagagtgcctgaccggcgagagcgagagcagcagcgaggacgagttcgagaaggagatggaggccgagctgaacagcaccatgaagaccatggaggacaagctgagcagcctgggcaccggcagcagcagcggcaacggcaaggtggccaccgcccccaccagatactacgacgacatctacttcgacagcgacagcgaggacgaggacagagccgtgcaggtgaccaagaagaagaagaagaagcagcacaagatccccaccaacgacgagctgctgtacgaccccgagaaggacaacagagaccaggcctgggtggacgcccagagaagaggctaccacggcctgggcccccagagaagcagacagcagcagcccgtgcccaacagcgacgccgtgctgaactgccccgcctgcatgaccaccctgtgcctggactgccagagacacgagagctacaagacccagtacagagccatgttcgtgatgaactgcagcatcaacaaggaggaggtgctgagatacaaggccagcgagaacagaaagaagagaagagtgcacaagaagatgagaagcaacagagaggacgccgccgagaaggccgagaccgacgtggaggagatctaccaccccgtgatgtgcaccgagtgcagcaccgaggtggccgtgtacgacaaggacgaggtgttccacttcttcaacgtgctggccagccacagctag

SEQ ID NO: 18002 - DNA, 4236 bp, Artificial Sequence
  Description of Artificial Sequence: Synthetic coding sequence
atgctgagaagaatcctgcagagaacccccggcagagtgggcagccagggcagcgacctggacagcagcgccacccccatcaacaccgtggacgtgaacaacgagagcagcagcgagggcttcatctgcccccagtgcatgaagagcctgggcagcgccgacgagctgttcaagcactacgaggccgtgcacgacgccggcaacgacagcggccacggcggcgagagcaacctggccctgaagagagacgacgtgaccctgctgagacaggaggtgcaggacctgcaggccagcctgaaggaggagaagtggtacagcgaggagctgaagaaggagctggagaagtaccagggcctgcagcagcaggaggccaagcccgacggcctggtgaccgacagcagcgccgagctgcagagcctggagcagcagctggaggaggcccagaccgagaacttcaacatcaagcagatgaaggacctgttcgagcagaaggccgcccagctggccaccgagatcgccgacatcaagagcaagtacgacgaggagagaagcctgagagaggccgccgagcagaaggtgaccagactgaccgaggagctgaacaaggaggccaccgtgatccaggacctgaagaccgagctgctgcagagacccggcatcgaggacgtggccgtgctgaagaaggagctggtgcaggtgcagaccctgatggacaacatgaccctggagagagagagagagagcgagaagctgaaggacgagtgcaagaagctgcagagccagtacgccagcagcgaggccaccatcagccagctgagaagcgagctggccaagggcccccaggaggtggccgtgtacgtgcaggagctgcagaagctgaagagcagcgtgaacgagctgacccagaagaaccagaccctgaccgagaacctgctgaagaaggagcaggactacaccaagctggaggagaagcacaacgaggagagcgtgagcaagaagaacatccaggccaccctgcaccagaaggacctggactgccagcagctgcagagcagactgagcgccagcgagaccagcctgcacagaatccacgtggagctgagcgagaagggcgaggccacccagaagctgaaggaggagctgagcgaggtggagaccaagtaccagcacctgaaggccgagttcaagcagctgcagcagcagagagaggagaaggagcagcacggcctgcagctgcagagcgagatcaaccagctgcacagcaagctgctggagaccgagagacagctgggcgaggcccacggcagactgaaggagcagagacagctgagcagcgagaagctgatggacaaggagcagcaggtggccgacctgcagctgaagctgagcagactggaggagcagctgaaggagaaggtgaccaacagcaccgagctgcagcaccagctggacaagaccaagcagcagcaccaggagcagcaggccctgcagcagagcaccaccgccaagctgagagaggcccagaacgacctggagcaggtgctgagacagatcggcgacaaggaccagaagatccagaacctggaggccctgctgcagaagagcaaggagaacatcagcctgctggagaaggagagagaggacctgtacgccaagatccaggccggcgagggcgagaccgccgtgctgaaccagctgcaggagaagaaccacaccctgcaggagcaggtgacccagctgaccgagaagctgaagaaccagagcgagagccacaagcaggcccaggagaacctgcacgaccaggtgcaggagcagaaggcccacctgagagccgcccaggacagagtgctgagcctggagaccagcgtgaacgagctgaacagccagctgaacgagagcaaggagaaggtgagccagctggacatccagatcaaggccaagaccgagctgctgctgagcgccgaggccgccaagaccgcccagagagccgacctgcagaaccacctggacaccgcccagaacgccctgcaggacaagcagcaggagctgaacaagatcaccacccagctggaccaggtgaccgccaagctgcaggacaagcaggagcactgcagccagctggagagccacctgaaggagtacaaggagaagtacctgagcctggagcagaagaccgaggagctggagggccagatcaagaagctggaggccgacagcctggaggtgaaggccagcaaggagcaggccctgcaggacctgcagcagcagagacagctgaacaccgacctggagctgagagccaccgagctgagcaagcagctggagatggagaaggagatcgtgagcagcaccagactggacctgcagaagaagagcgaggccctggagagcatcaagcagaagctgaccaagcaggaggaggagaagaagatcctgaagcaggacttcgagaccctgagccaggagaccaagatccagcacgaggagctgaacaacagaatccagaccaccgtgaccgagctgcagaaggtgaagatggagaaggaggccctgatgaccgagctgagcaccgtgaaggacaagctgagcaaggtgagcgacagcctgaagaacagcaagagcgagttcgagaaggagaaccagaagggcaaggccgccatcctggacctggagaagacctgcaaggagctgaagcaccagctgcaggtgcagatggagaacaccctgaaggagcagaaggagctgaagaagagcctggagaaggagaaggaggccagccaccagctgaagctggagctgaacagcatgcaggagcagctgatccaggcccagaacaccctgaagcagaacgagaaggaggagcagcagctgcagggcaacatcaacgagctgaagcagagcagcgagcagaagaagaagcagatcgaggccctgcagggcgagctgaagatcgccgtgctgcagaagaccgagctggagaacaagctgcagcagcagctgacccaggccgcccaggagctggccgccgagaaggagaagatcagcgtgctgcagaacaactacgagaagagccaggagaccttcaagcagctgcagagcgacttctacggcagagagagcgagctgctggccaccagacaggacctgaagagcgtggaggagaagctgagcctggcccaggaggacctgatcagcaacagaaaccagatcggcaaccagaacaagctgatccaggagctgaagaccgccaaggccaccctggagcaggacagcgccaagaaggagcagcagctgcaggagagatgcaaggccctgcaggacatccagaaggagaagagcctgaaggagaaggagctggtgaacgagaagagcaagctggccgagatcgaggagatcaagtgcagacaggagaaggagatcaccaagctgaacgaggagctgaagagccacaagctggagagcatcaaggagatcaccaacctgaaggacgccaagcagctgctgatccagcagaagctggagctgcagggcaaggccgacagcctgaaggccgccgtggagcaggagaagagaaaccagcagatcctgaaggaccaggtgaagaaggaggaggaggagctgaagaaggagttcatcgagaaggaggccaagctgcacagcgagatcaaggagaaggaggtgggcatgaagaagcacgaggagaacgaggccaagctgaccatgcagatcaccgccctgaacgagaacctgggcaccgtgaagaaggagtggcagagcagccagagaagagtgagcgagctggagaagcagaccgacgacctgagaggcgagatcgccgtgctggaggccaccgtgcagaacaaccaggacgagagaagagccctgctggagagatgcctgaagggcgagggcgagatcgagaagctgcagaccaaggtgctggagctgcagagaaagctggacaacaccaccgccgccgtgcaggagctgggcagagagaaccagagcctgcagatcaagcacacccaggccctgaacagaaagtgggccgaggacaacgaggtgcagaactgcatggcctgcggcaagggcttcagcgtgaccgtgagaagacaccactgcagacagtgcggcaacatcttctgcgccgagtgcagcgccaagaacgccctgacccccagcagcaagaagcccgtgagagtgtgcgacgcctgcttcaacgacctgcagggctag

SEQ ID NO: 18003 - DNA, 933 bp, Artificial Sequence
  Description of Artificial Sequence: Synthetic coding sequence
ctgagaagagtggaccacgagacccccggcagagtgggcagccagggcagcgacctggacagcagcgccacccccatcaacaccgtggacgtgaacaacgagagcagcagcgagggcttcatctgcccccagtgcatgaagagcctgggcagcgccgacgagctgttcaagcactacgaggccgtgcacgacgccggcaacgacagcggccacggcggcgagagcaacctggccctgaagagagacgacgtgaccctgctgagacaggaggtgcaggacctgcaggccagcctgaaggaggagaagtggtacagcgaggagctgaagaaggagctggagaagtaccagggcctgcagcagcaggaggccaagcccgacggcctggtgaccgacagcagcgccgagctgcagagcctggagcagcagctggaggaggcccagaccgagaacttcaacatcaagcagatgaaggacctgttcgagcagaaggccgcccagctggccaccgagatcgccgacatcaagagcaagtacgacgaggagagaagcctgagagaggccgccgagcagaaggtgaccagactgaccgaggagctgaacaaggaggccaccgtgatccaggacctgaagaccgagctgctgcagagacccggcatcgaggacgtggccgtgctgaagaaggagctggtgcaggtgcagaccctgatggacaacatgaccctggagagagagagagagagcgagaagctgaaggacgagtgcaagaagctgcagagccagtacgccagcagcgaggccaccatcagccagctgagaagcgagctggccaagggcccccaggaggtggccgtgtacgtgcaggagctgcagaagctgaagagcagcgtgaacgagctgacccagaagaaccagaagaagaagaagaagaagtag

SEQ ID NO: 18004 - DNA, 1716 bp, Artificial Sequence
  Description of Artificial Sequence: Synthetic coding sequence
atgggcagaatcggcatcagctgcctgttccccgccagctggcacttcagcatcagccccgtgggctgccccagaatcctgaacaccaacctgagacagatcatggtgatcagcgtgctggccgccgccgtgagcctgctgtacttcagcgtggtgatcatcagaaacaagtacggcagactgaccagagacaagaagttccagagatacctggccagagtgaccgacatcgaggccaccgacaccaacaaccccaacgtgaactacggcatcgtggtggactgcggcagcagcggcagcagagtgttcgtgtactgctggcccagacacaacggcaacccccacgacctgctggacatcagacagatgagagacaagaacagaaagcccgtggtgatgaagatcaagcccggcatcagcgagttcgccaccagccccgagaaggtgagcgactacatcagccccctgctgaacttcgccgccgagcacgtgcccagagccaagcacaaggagacccccctgtacatcctgtgcaccgccggcatgagaatcctgcccgagagccagcagaaggccatcctggaggacctgctgaccgacatccccgtgcacttcgacttcctgttcagcgacagccacgccgaggtgatcagcggcaagcaggagggcgtgtacgcctggatcggcatcaacttcgtgctgggcagattcgagcacatcgaggacgacgacgaggccgtggtggaggtgaacatccccggcagcgagagcagcgaggccatcgtgagaaagagaaccgccggcatcctggacatgggcggcgtgagcacccagatcgcctacgaggtgcccaagaccgaggaggtggccaagaacctgctggccgagttcaacctgggctgcgacgtgcaccagaccgagcacgtgtacagagtgtacgtggccaccttcctgggcttcggcggcaacgccgccagacagagatacgaggacagaatcttcgccaacaccatccagaagaacagactgctgggcaagcagaccggcctgacccccgacatgccctacctggacccctgcctgcccctggacatcaaggacgagatccagcagaacggccagaccatctacctgagaggcaccggcgacttcgacctgtgcagagagaccatccagcccttcatgaacaagaccaacgagacccagaccagcctgaacggcgtgtaccagccccccatccacttccagaacagcgagttctacggcttcagcgagttctactactgcaccgaggacgtgctgagaatgggcggcgactacaacgccgccaagttcaccaaggccgccaaggactactgcgccaccaagtggagcatcctgagagagagattcgacagaggcctgtacgccagccacgccgacctgcacagactgaagtaccagtgcttcaagagcgcctggatgttcgaggtgttccacagaggcttcagcttccccgtgaactacaagagcctgaagaccgccctgcaggtgtacgacaaggaggtgcagtggaccctgggcgccatcctgtacagaaccagattcctgcccctgagaaagatcggcatgctgatcatcccctgcagcggcggctgccccaagctgtgctgcgccgtgtggcagccccccccctacggcgccaccaagcacctgcagtgcgccgcctggaactag

SEQ ID NO: 18005 - DNA, 1851 bp, Artificial Sequence
  Description of Artificial Sequence: Synthetic coding sequence
atgggcagaatcggcatcagctgcctgttccccgccagctggcacttcagcatcagccccgtgggctgccccagaatcctgaacaccaacctgagacagatcatggtgatcagcgtgctggccgccgccgtgagcctgctgtacttcagcgtggtgatcatcagaaacaagtacggcagactgaccagagacaagaagttccagagatacctggccagagtgaccgacatcgaggccaccgacaccaacaaccccaacgtgaactacggcatcgtggtggactgcggcagcagcggcagcagagtgttcgtgtactgctggcccagacacaacggcaacccccacgacctgctggacatcagacagatgagagacaagaacagaaagcccgtggtgatgaagatcaagcccggcatcagcgagttcgccaccagccccgagaaggtgagcgactacatcagccccctgctgaacttcgccgccgagcacgtgcccagagccaagcacaaggagacccccctgtacatcctgtgcaccgccggcatgagaatcctgcccgagagccagcagaaggccatcctggaggacctgctgaccgacatccccgtgcacttcgacttcctgttcagcgacagccacgccgaggtgatcagcggcaagcaggagggcgtgtacgcctggatcggcatcaacttcgtgctgggcagattcgagcacatcgaggacgacgacgaggccgtggtggaggtgaacatccccggcagcgagagcagcgaggccatcgtgagaaagagaaccgccggcatcctggacatgggcggcgtgagcacccagatcgcctacgaggtgcccaagaccgtgagcttcgccagcagccagcaggaggaggtggccaagaacctgctggccgagttcaacctgggctgcgacgtgcaccagaccgagcacgtgtacagagtgtacgtggccaccttcctgggcttcggcggcaacgccgccagacagagatacgaggacagaatcttcgccaacaccatccagaagaacagactgctgggcaagcagaccggcctgacccccgacatgccctacctggacccctgcctgcccctggacatcaaggacgagatccagcagaacggccagaccatctacctgagaggcaccggcgacttcgacctgtgcagagagaccatccagcccttcatgaacaagaccaacgagacccagaccagcctgaacggcgtgtaccagccccccatccacttccagaacagcgagttctacggcttcagcgagttctactactgcaccgaggacgtgctgagaatgggcggcgactacaacgccgccaagttcaccaaggccgccaaggactactgcgccaccaagtggagcatcctgagagagagattcgacagaggcctgtacgccagccacgccgacctgcacagactgaagtaccagtgcttcaagagcgcctggatgttcgaggtgttccacagaggcttcagcttccccgtgaactacaagagcctgaagaccgccctgcaggtgtacgacaaggaggtgcagtggaccctgggcgccatcctgtacagaaccagattcctgcccctgagagacatccagcaggaggccttcagagccagccacacccactggagaggcgtgagcttcgtgtacaaccactacctgttcagcggctgcttcctggtggtgctgctggccatcctgctgtacctgctgagactgagaagaatccacagaagaacccccagaagcagcagcgccgccgccctgtggatggaggagggcctgcccgcccagaacgcccccggcaccctgtag

SEQ ID NO: 18006 - DNA, 1827 bp, Artificial Sequence
  Description of Artificial Sequence: Synthetic coding sequence
atgggcagaatcggcatcagctgcctgttccccgccagctggcacttcagcatcagccccgtgggctgccccagaatcctgaacaccaacctgagacagatcatggtgatcagcgtgctggccgccgccgtgagcctgctgtacttcagcgtggtgatcatcagaaacaagtacggcagactgaccagagacaagaagttccagagatacctggccagagtgaccgacatcgaggccaccgacaccaacaaccccaacgtgaactacggcatcgtggtggactgcggcagcagcggcagcagagtgttcgtgtactgctggcccagacacaacggcaacccccacgacctgctggacatcagacagatgagagacaagaacagaaagcccgtggtgatgaagatcaagcccggcatcagcgagttcgccaccagccccgagaaggtgagcgactacatcagccccctgctgaacttcgccgccgagcacgtgcccagagccaagcacaaggagacccccctgtacatcctgtgcaccgccggcatgagaatcctgcccgagagccagcagaaggccatcctggaggacctgctgaccgacatccccgtgcacttcgacttcctgttcagcgacagccacgccgaggtgatcagcggcaagcaggagggcgtgtacgcctggatcggcatcaacttcgtgctgggcagattcgagcacatcgaggacgacgacgaggccgtggtggaggtgaacatccccggcagcgagagcagcgaggccatcgtgagaaagagaaccgccggcatcctggacatgggcggcgtgagcacccagatcgcctacgaggtgcccaagaccgaggaggtggccaagaacctgctggccgagttcaacctgggctgcgacgtgcaccagaccgagcacgtgtacagagtgtacgtggccaccttcctgggcttcggcggcaacgccgccagacagagatacgaggacagaatcttcgccaacaccatccagaagaacagactgctgggcaagcagaccggcctgacccccgacatgccctacctggacccctgcctgcccctggacatcaaggacgagatccagcagaacggccagaccatctacctgagaggcaccggcgacttcgacctgtgcagagagaccatccagcccttcatgaacaagaccaacgagacccagaccagcctgaacggcgtgtaccagccccccatccacttccagaacagcgagttctacggcttcagcgagttctactactgcaccgaggacgtgctgagaatgggcggcgactacaacgccgccaagttcaccaaggccgccaaggactactgcgccaccaagtggagcatcctgagagagagattcgacagaggcctgtacgccagccacgccgacctgcacagactgaagtaccagtgcttcaagagcgcctggatgttcgaggtgttccacagaggcttcagcttccccgtgaactacaagagcctgaagaccgccctgcaggtgtacgacaaggaggtgcagtggaccctgggcgccatcctgtacagaaccagattcctgcccctgagagacatccagcaggaggccttcagagccagccacacccactggagaggcgtgagcttcgtgtacaaccactacctgttcagcggctgcttcctggtggtgctgctggccatcctgctgtacctgctgagactgagaagaatccacagaagaacccccagaagcagcagcgccgccgccctgtggatggaggagggcctgcccgcccagaacgcccccggcaccctgtag

SEQ ID NO: 18007 - DNA, 1815 bp, Artificial Sequence
  Description of Artificial Sequence: Synthetic coding sequence
atggccagaatcagcttcagctacctgtgccccgccagctggtacttcaccgtgcccaccgtgagccccttcctgagacagagagtggccttcctgggcctgttcttcatcagctgcctgctgctgctgatgctgatcatcgacttcagacactggagcgccagcctgcccagagacagacagtacgagagatacctggccagagtgggcgagctggaggccaccgacaccgaggaccccaacctgaactacggcctggtggtggactgcggcagcagcggcagcagaatcttcgtgtacttctggcccagacacaacggcaacccccacgacctgctggacatcaagcagatgagagacagaaacagccagcccgtggtgaagaagatcaagcccggcatcagcgccatggccgacacccccgagcacgccagcgactacctgagacccctgctgagcttcgccgccgcccacgtgcccgtgaagaagcacaaggagacccccctgtacatcctgtgcaccgccggcatgagactgctgcccgagagaaagcagctggccatcctggccgacctggtgaaggacctgcccctggagttcgacttcctgttcagccagagccaggccgaggtgatcagcggcaagcaggagggcgtgtacgcctggatcggcatcaacttcgtgctgggcagattcgaccacgaggacgagagcgacgccgaggccacccaggagctggccgccggcagaagaagaaccgtgggcatcctggacatgggcggcgccagcctgcagatcgcctacgaggtgcccaccagcaccagcgtgctgcccgccaagcaggaggaggccgccaagatcctgctggccgagttcaacctgggctgcgacgtgcagcacaccgagcacgtgtacagagtgtacgtgaccaccttcctgggcttcggcggcaacttcgccagacagagatacgaggacctggtgctgaacgagaccctgaacaagaacagactgctgggccagaagaccggcctgagccccgacaaccccttcctggacccctgcctgcccgtgggcctgaccgacgtggtggagagaaacagccaggtgctgcacgtgagaggcagaggcgactgggtgagctgcggcgccatgctgagccccctgctggccagaagcaacaccagccaggccagcctgaacggcatctaccagagccccatcgacttcaacaacagcgagttctacggcttcagcgagttcttctactgcaccgaggacgtgctgagaatcggcggcagataccacggccccaccttcgccaaggccgcccaggactactgcggcatggcctggagcgtgctgacccagagattcaagaacggcctgttcagcagccacgccgacgagcacagactgaagtaccagtgcttcaagagcgcctggatgtaccaggtgctgcacgagggcttccacttcccctacgactaccccaacctgagaaccgcccagctggtgtacgacagagaggtgcagtggaccctgggcgccatcctgtacaagaccagattcctgcccctgagagacctgagacaggagggcgtgagacaggcccacggcagctggttcagactgagcttcgtgtacaaccactacctgttcttcgcctgcatcctggtggtgctgctggccatcttcctgtacctgctgagactgagaagaatccaccacagacagaccagagccagcgcccccctggacctgctgtggctggaggaggtggtgcccatgatgggcgtgcaggtgggcccctag

SEQ ID NO: 18008 - DNA, 1377 bp, Artificial Sequence
  Description of Artificial Sequence: Synthetic coding sequence
atgggcctgagcagaaaggagcaggtgttcctggccctgctgggcgccagcggcgtgagcggcctgaccgccctgatcctgctgctggtggaggccaccagcgtgctgctgcccaccgacatcaagttcggcatcgtgttcgacgccggcagcagccacaccagcctgttcctgtaccagtggctggccaacaaggagaacggcaccggcgtggtgagccaggccctggcctgccaggtggagggccccggcatcagcagctacaccagcaacgccgcccaggccggcgagagcctgcagggctgcctggaggaggccctggtgctgatccccgaggcccagcacagaaagacccccaccttcctgggcgccaccgccggcatgagactgctgagcagaaagaacagcagccaggccagagacatcttcgccgccgtgacccaggtgctgggcagaagccccgtggacttctggggcgccgagctgctggccggccaggccgagggcgccttcggctggatcaccgtgaactacggcctgggcaccctggtgaagtacagcttcaccggcgagtggatccagccccccgaggagatgctggtgggcgccctggacatgggcggcgccagcacccagatcaccttcgtgcccggcggccccatcctggacaagagcacccaggccgacttcagactgtacggcagcgactacagcgtgtacacccacagctacctgtgcttcggcagagaccagatgctgagcagactgctggtgggcctggtgcagagcagacccgccgccctgctgagacacccctgctacctgagcggctaccagaccaccctggccctgggccccctgtacgagagcccctgcgtgcacgccaccccccccctgagcctgccccagaacctgaccgtggagggcaccggcaaccccggcgcctgcgtgagcgccatcagagagctgttcaacttcagcagctgccagggccaggaggactgcgccttcgacggcgtgtaccagccccccctgagaggccagttctacgtggaggccagctaccccggccaggacagatggctgagagactactgcgccagcggcctgtacatcctgaccctgctgcacgagggctacggcttcagcgaggagacctggcccagcctggagttcagaaagcaggccggcggcgtggacatcggctggaccctgggctacatgctgaacctgaccggcatgatccccgccgacgcccccgcccagtggagagccgagagctacggcgtgtgggtggccaaggtggtgttcatggtgctggccctggtggccgtggtgggcgccgccctggtgcagctgttctggctgcaggactag

SEQ ID NO: 18009 - DNA, 1488 bp, Artificial Sequence
  Description of Artificial Sequence: Synthetic coding sequence
atgggcctgagcagaaaggagcaggtgttcctggccctgctgggcgccagcggcgtgagcggcctgaccgccctgatcctgctgctggtggaggccaccagcgtgctgctgcccaccgacatcaagttcggcatcgtgttcgacgccggcagcagccacaccagcctgttcctgtaccagtggctggccaacaaggagaacggcaccggcgtggtgagccaggccctggcctgccaggtggagggccccggcatcagcagctacaccagcaacgccgcccaggccggcgagagcctgcagggctgcctggaggaggccctggtgctgatccccgaggcccagcacagaaagacccccaccttcctgggcgccaccgccggcatgagactgctgagcagaaagaacagcagccaggccagagacatcttcgccgccgtgacccaggtgctgggcagaagccccgtggacttctggggcgccgagctgctggccggccaggccgagggcgccttcggctggatcaccgtgaactacggcctgggcaccctggtgaagtacagcttcaccggcgagtggatccagccccccgaggagatgctggtgggcgccctggacatgggcggcgccagcacccagatcaccttcgtgcccggcggccccatcctggacaagagcacccaggccgacttcagactgtacggcagcgactacagcgtgtacacccacagctacctgtgcttcggcagagaccagatgctgagcagactgctggtgggcctggtgcagagcagacccgccgccctgctgagacacccctgctacctgagcggctaccagaccaccctggccctgggccccctgtacgagagcccctgcgtgcacgccaccccccccctgagcctgccccagaacctgaccgtggagggcaccggcaaccccggcgcctgcgtgagcgccatcagagagctgttcaacttcagcagctgccagggccaggaggactgcgccttcgacggcgtgtaccagccccccctgagaggccagttctacgccttcagcaacttctactacaccttccacttcctgaacctgaccagcagacagcccctgagcaccgtgaacgccaccatctgggagttctgccagagaccctggaagctggtggaggccagctaccccggccaggacagatggctgagagactactgcgccagcggcctgtacatcctgaccctgctgcacgagggctacggcttcagcgaggagacctggcccagcctggagttcagaaagcaggccggcggcgtggacatcggctggaccctgggctacatgctgaacctgaccggcatgatccccgccgacgcccccgcccagtggagagccgagagctacggcgtgtgggtggccaaggtggtgttcatggtgctggccctggtggccgtggtgggcgccgccctggtgcagctgttctggctgcaggactag

SEQ ID NO: 18010 - DNA, 1488 bp, Artificial Sequence; identical to SEQ ID NO: 18009
  Description of Artificial Sequence: Synthetic coding sequence

SEQ ID NO: 18011 - DNA, 1362 bp, Artificial Sequence
  Description of Artificial Sequence: Synthetic coding sequence
atgaagctgctggtgatcctgctgttcagcggcctgatcaccggcttcagaagcgacagcagcagcagcctgccccccaagctgctgctggtgagcttcgacggcttcagagccgactacctgaagaactacgagttcccccacctgcagaacttcatcaaggagggcgtgctggtggagcacgtgaagaacgtgttcatcaccaagaccttccccaaccactacagcatcgtgaccggcctgtacgaggagagccacggcatcgtggccaacagcatgtacgacgccgtgaccaagaagcacttcagcgacagcaacgacaaggaccccttctggtggaacgaggccgtgcccatctgggtgaccaaccagctgcaggagaacagaagcagcgccgccgccatgtggcccggcaccgacgtgcccatccacgacaccatcagcagctacttcatgaactacaacagcagcgtgagcttcgaggagagactgaacaacatcaccatgtggctgaacaacagcaacccccccgtgaccttcgccaccctgtactgggaggagcccgacgccagcggccacaagtacggccccgaggacaaggagaacatgagcagagtgctgaagaagatcgacgacctgatcggcgacctggtgcagagactgaagatgctgggcctgtgggagaacctgaacgtgatcatcaccagcgaccacggcatgacccagtgcagccaggacagactgatcaacctggacagctgcatcgaccacagctactacaccctgatcgacctgagccccgtggccgccatcctgcccaagatcaacagaaccgaggtgtacaacaagctgaagaactgcagcccccacatgaacgtgtacctgaaggaggacatccccaacagattctactaccagcacaacgacagaatccagcccatcatcctggtggccgacgagggctggaccatcgtgctgaacgagagcagccagaagctgggcgaccacggctacgacaacagcctgcccagcatgcaccccttcctggccgcccacggccccgccttccacaagggctacaagcacagcaccatcaacatcgtggacatctaccccatgatgtgccacatcctgggcctgaagccccaccccaacaacggcaccttcggccacaccaagtgcctgctggtggaccagtggtgcatcaacctgcccgaggccatcgccatcgtgatcggcagcctgctggtgctgaccatgctgacctgcctgatcatcatcatgcagaacagactgagcgtgcccagacccttcagcagactgcagctgcaggaggacgacgacgaccccctgatcggctag

SEQ ID NO: 18012 - DNA, 1362 bp, Artificial Sequence; identical to SEQ ID NO: 18011
  Description of Artificial Sequence: Synthetic coding sequence

SEQ ID NO: 18013 - DNA, 1377 bp, Artificial Sequence
  Description of Artificial Sequence: Synthetic coding sequence
atgagaggcctggccgtgctgctgaccgtggccctggccaccctgctggcccccggcgccggcgcccccgtgcagagccagggcagccagaacaagctgctgctggtgagcttcgacggcttcagatggaactacgaccaggacgtggacacccccaacctggacgccatggccagagacggcgtgaaggccagatacatgacccccgccttcgtgaccatgaccagcccctgccacttcaccctggtgaccggcaagtacatcgagaaccacggcgtggtgcacaacatgtactacaacaccaccagcaaggtgaagctgccctaccacgccaccctgggcatccagagatggtgggacaacggcagcgtgcccatctggatcaccgcccagagacagggcctgagagccggcagcttcttctaccccggcggcaacgtgacctaccagggcgtggccgtgaccagaagcagaaaggagggcatcgcccacaactacaagaacgagaccgagtggagagccaacatcgacaccgtgatggcctggttcaccgaggaggacctggacctggtgaccctgtacttcggcgagcccgacagcaccggccacagatacggccccgagagccccgagagaagagagatggtgagacaggtggacagaaccgtgggctacctgagagagagcatcgccagaaaccacctgaccgacagactgaacctgatcatcaccagcgaccacggcatgaccaccgtggacaagagagccggcgacctggtggagttccacaagttccccaacttcaccttcagagacatcgagttcgagctgctggactacggccccaacggcatgctgctgcccaaggagggcagactggagaaggtgtacgacgccctgaaggacgcccaccccaagctgcacgtgtacaagaaggaggccttccccgaggccttccactacgccaacaaccccagagtgacccccctgctgatgtacagcgacctgggctacgtgatccacggcagaatcaacgtgcagttcaacaacggcgagcacggcttcgacaacaaggacatggacatgaagaccatcttcagagccgtgggccccagcttcagagccggcctggaggtggagcccttcgagagcgtgcacgtgtacgagctgatgtgcagactgctgggcatcgtgcccgaggccaacgacggccacctggccaccctgctgcccatgctgcacaccgagagcgccctgccccccgacggcagacccaccctgctgcccaagggcagaagcgccctgccccccagcagcagacccctgctggtgatgggcctgctgggcaccgtgatcctgctgagcgaggtggcctag

SEQ ID NO: 18014 - DNA, 1305 bp, Artificial Sequence
  Description of Artificial Sequence: Synthetic coding sequence
atggccgccgccgccggcagctgcgccagagtggccgcctggggcggcaagctgagaagaggcctggccgtgagcagacaggccgtgagaagccccggccccctggccgccgccgtggccggcgccgccctggccggcgccggcgccgcctggcaccacagcagagtgagcgtggccgccagagacggcagcttcaccgtgagcgcccagaagaacgtggagcacggcatcatctacatcggcaagcccagcctgagaaagcagagattcatgcagttcagcagcctggagcacgagggcgagtactacatgacccccagagacttcctgttcagcgtgatgttcgagcagatggagagaaagaccagcgtgaagaagctgaccaagaaggacatcgaggacaccctgagcggcatccagaccgccggctgcggcagcaccttcttcagagacctgggcgacaagggcctgatcagctacaccgagtacctgttcctgctgaccatcctgaccaagccccacagcggcttccacgtggccttcaagatgctggacaccgacggcaacgagatgatcgagaagagagagttcttcaagctgcagaagatcatcagcaagcaggacgacctgatgaccgtgaagaccaacgagaccggctaccaggaggccatcgtgaaggagcccgagatcaacaccaccctgcagatgagattcttcggcaagagaggccagagaaagctgcactacaaggagttcagaagattcatggagaacctgcagaccgagatccaggagatggagttcctgcagttcagcaagggcctgagcttcatgagaaaggaggacttcgccgagtggctgctgttcttcaccaacaccgagaacaaggacatctactggaagaacgtgagagagaagctgagcgccggcgagagcatcagcctggacgagttcaagagcttctgccacttcaccacccacctggaggacttcgccatcgccatgcagatgttcagcctggcccacagacccgtgagactggccgagttcaagagagccgtgaaggtggccaccggccaggagctgagcaacaacatcctggacaccgtgttcaagatcttcgacctggacggcgacgagtgcctgagccacgaggagttcctgggcgtgctgaagaacagaatgcacagaggcctgtgggtgccccagcaccagagcatccaggagtactggaagtgcgtgaagaaggagagcatcaagggcgtgaaggaggtgtggaagcaggccggcaagggcctgttctag

SEQ ID NO: 18015 - DNA, 1593 bp, Artificial Sequence
  Description of Artificial Sequence: Synthetic coding sequence
atggccgccctgagaagactgctgtggcccccccccagagtgagcccccccctgtgcgcccaccagcccctgctgggcccctggggcagacccgccgtgaccaccctgggcctgcccggcagacccttcagcagcagagaggacgaggagagagccgtggccgaggccgcctggagaagaagaagaagatggggcgagctgagcgtggccgccgccgccggcggcggcctggtgggcctggtgtgctaccagctgtacggcgaccccagagccggcagccccgccaccggcagacccagcaagagcgccgccaccgagcccgaggacccccccagaggcagaggcatgctgcccatccccgtggccgccgccaaggagaccgtggccatcggcagaaccgacatcgaggacctggacctgtacgccaccagcagagagagaagattcagactgttcgccagcatcgagtgcgagggccagctgttcatgaccccctacgacttcatcctggccgtgaccaccgacgagcccaaggtggccaagacctggaagagcctgagcaagcaggagctgaaccagatgctggccgagaccccccccgtgtggaagggcagcagcaagctgttcagaaacctgaaggagaagggcgtgatcagctacaccgagtacctgttcctgctgtgcatcctgaccaagccccacgccggcttcagaatcgccttcaacatgttcgacaccgacggcaacgagatggtggacaagaaggagttcctggtgctgcaggagatcttcagaaagaagaacgagaagagagagatcaagggcgacgaggagaagagagccatgctgagactgcagctgtacggctaccacagccccaccaacagcgtgctgaagaccgacgccgaggagctggtgagcagaagctactgggacaccctgagaagaaacaccagccaggccctgttcagcgacctggccgagagagccgacgacatcaccagcctggtgaccgacaccaccctgctggtgcacttcttcggcaagaagggcaaggccgagctgaacttcgaggacttctacagattcatggacaacctgcagaccgaggtgctggagatcgagttcctgagctacagcaacggcatgaacaccatcagcgaggaggacttcgcccacatcctgctgagatacaccaacgtggagaacaccagcgtgttcctggagaacgtgagatacagcatccccgaggagaagggcatcaccttcgacgagttcagaagcttcttccagttcctgaacaacctggaggacttcgccatcgccctgaacatgtacaacttcgccagcagaagcatcggccaggacgagttcaagagagccgtgtacgtggccaccggcctgaagttcagcccccacctggtgaacaccgtgttcaagatcttcgacgtggacaaggacgaccagctgagctacaaggagttcatcggcatcatgaaggacagactgcacagaggcttcagaggctacaagaccgtgcagaagtaccccaccttcaagagctgcctgaagaaggagctgcacagcagatag

SEQ ID NO: 18016 - DNA, 534 bp, Artificial Sequence
  Description of Artificial Sequence: Synthetic coding sequence
atgttcaagcagtacgacgccggcagagacggcttcatcgacctgatggagctgaagctgatgatggagaagctgggcgccccccagacccacctgggcctgaagaacatgatcaaggaggtggacgaggacttcgacagcaagctgagcttcagagagttcctgctgatcttcagaaaggccgccgccggcgagctgcaggaggacagcggcctgtgcgtgctggccagactgagcgagatcgacgtgagcagcgagggcgtgaagggcgccaagagcttcttcgaggccaagtggaactgggtgtgcagatgggcccccagaaccggcagcagaggcagcggctggcagcagctggagagactgcccagcagcgccctggccctgcagcagccccagaacatcggccccggccaccagagagtgcagcccctgagaggcggcgaccagggcagagccggcggcaaggaggaggccggcggcggcgacgaggccgccgagagcggcctgcagggcgccgccgtgcacctgtag

SEQ ID NO: 18017 - DNA, 723 bp, Artificial Sequence
  Description of Artificial Sequence: Synthetic coding sequence
atggccaccgacgagctggccaccaagctgagcagaagactgcagatggagggcgagggcggcggcgagacccccgagcagcccggcctgaacggcgccgccgccgccgccgccggcgcccccgacgaggccgccgaggccctgggcagcgccgactgcgagctgagcgccaagctgctgagaagagccgacctgaaccagggcatcggcgagccccagagccccagcagaagagtgttcaacccctacaccgagttcaaggagttcagcagaaagcagatcaaggacatggagaagatgttcaagcagtacgacgccggcagagacggcttcatcgacctgatggagctgaagctgatgatggagaagctgggcgccccccagacccacctgggcctgaagaacatgatcaaggaggtggacgaggacttcgacagcaagctgagcttcagagagttcctgctgatcttcagaaaggccgccgccggcgagctgcaggaggacagcggcctgtgcgtgctggccagactgagcgagatcgacgtgagcagcgagggcgtgaagggcgccaagagcttcttcgaggccaaggtgcaggccatcaacgtgagcagcagattcgaggaggagatcaaggccgagcaggaggagagaaagaagcaggccgaggagatgaagcagagaaaggccgccttcaaggagctgcagagcaccttcaagtag

SEQ ID NO: 18018 - DNA, 540 bp, Artificial Sequence
  Description of Artificial Sequence: Synthetic coding sequence
tgaaagatgttcaagcagtacgacgccggcagagacggcttcatcgacctgatggagctgaagctgatgatggagaagctgggcgccccccagacccacctgggcctgaagaacatgatcaaggaggtggacgaggacttcgacagcaagctgagcttcagagagttcctgctgatcttcagaaaggccgccgccggcgagctgcaggaggacagcggcctgtgcgtgctggccagactgagcgagatcgacgtgagcagcgagggcgtgaagggcgccaagagcttcttcgaggccaagtggaactgggtgtgcagatgggcccccagaaccggcagcagaggcagcggctggcagcagctggagagactgcccagcagcgccctggccctgcagcagccccagaacatcggccccggccaccagagagtgcagcccctgagaggcggcgaccagggcagagccggcggcaaggaggaggccggcggcggcgacgaggccgccgagagcggcctgcagggcgccgccgtgcacctgtag

SEQ ID NO: 18019 - DNA, 2073 bp, Artificial Sequence
  Description of Artificial Sequence: Synthetic coding sequence
atgaagagactgcccctgctggtggtgttcagcaccctgctgaactgcagctacacccagaactgcaccaagaccccctgcctgcccaacgccaagtgcgagatcagaaacggcatcgaggcctgctactgcaacatgggcttcagcggcaacggcgtgaccatctgcgaggacgacaacgagtgcggcaacctgacccagagctgcggcgagaacgccaactgcaccaacaccgagggcagctactactgcatgtgcgtgcccggcttcagaagcagcagcaaccaggacagattcatcaccaacgacggcaccgtgtgcatcgagaacgtgaacgccaactgccacctggacaacgtgtgcatcgccgccaacatcaacaagaccctgaccaagatcagaagcatcaaggagcccgtggccctgctgcaggaggtgtacagaaacagcgtgaccgacctgagccccaccgacatcatcacctacatcgagatcctggccgagagcagcagcctgctgggctacaagaacaacaccatcagcgccaaggacaccctgagcaacagcaccctgaccgagttcgtgaagaccgtgaacaacttcgtgcagagagacaccttcgtggtgtgggacaagctgagcgtgaaccacagaagaacccacctgaccaagctgatgcacaccgtggagcaggccaccctgagaatcagccagagcttccagaagaccaccgagttcgacaccaacagcaccgacatcgccctgaaggtgttcttcttcgacagctacaacatgaagcacatccacccccacatgaacatggacggcgactacatcaacatcttccccaagagaaaggccgcctacgacagcaacggcaacgtggccgtggccttcgtgtactacaagagcatcggccccctgctgagcagcagcgacaacttcctgctgaagccccagaactacgacaacagcgaggaggaggagagagtgatcagcagcgtgatcagcgtgagcatgagcagcaacccccccaccctgtacgagctggagaagatcaccttcaccctgagccacagaaaggtgaccgacagatacagaagcctgtgcgccttctggaactacagccccgacaccatgaacggcagctggagcagcgagggctgcgagctgacctacagcaacgagacccacaccagctgcagatgcaaccacctgacccacttcgccatcctgatgagcagcggccccagcatcggcatcaaggactacaacatcctgaccagaatcacccagctgggcatcatcatcagcctgatctgcctggccatctgcatcttcaccttctggttcttcagcgagatccagagcaccagaaccaccatccacaagaacctgtgctgcagcctgttcctggccgagctggtgttcctggtgggcatcaacaccaacaccaacaagctgttctgcagcatcatcgccggcctgctgcactacttcttcctggccgccttcgcctggatgtgcatcgagggcatccacctgtacctgatcgtggtgggcgtgatctacaacaagggcttcctgcacaagaacttctacatcttcggctacctgagccccgccgtggtggtgggcttcagcgccgccctgggctacagatactacggcaccaccaaggtgtgctggctgagcaccgagaacaacttcatctggagcttcatcggccccgcctgcctgatcatcctggtgaacctgctggccttcggcgtgatcatctacaaggtgttcagacacaccgccggcctgaagcccgaggtgagctgcttcgagaacatcagaagctgcgccagaggcgccctggccctgctgttcctgctgggcaccacctggatcttcggcgtgctgcacgtggtgcacgccagcgtggtgaccgcctacctgttcaccgtgagcaacgccttccagggcatgttcatcttcctgttcctgtgcgtgctgagcagaaagatccaggaggagtactacagactgttcaagaacgtgccctgctgcttcggctgcctgagatag

SEQ ID NO: 18020 - DNA, 450 bp, Artificial Sequence
  Description of Artificial Sequence: Synthetic coding sequence
gtggtggtgggcttcagcgccgccctgggctacagatactacggcaccaccaaggtgtgctggctgagcaccgagaacaacttcatctggagcttcatcggccccgcctgcctgatcatcctggtgaacctgctggccttcggcgtgatcatctacaaggtgttcagacacaccgccggcctgaagcccgaggtgagctgcttcgagaacatcagaagctgcgccagaggcgccctggccctgctgttcctgctgggcaccacctggatcttcggcgtgctgcacgtggtgcacgccagcgtggtgaccgcctacctgttcaccgtgagcaacgccttccagggcatgttcatcttcctgttcctgtgcgtgctgagcagaaagatccaggaggagtactacagactgttcaagaacgtgccctgctgcttcggctgcctgagctgctag

SEQ ID NO: 18021 - DNA, 2472 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtgaacgagtgcaccagcggccagaacccctgccacagcagcacccactgcctgaacaacgtgggcagctaccagtgcagatgcagacccggctggcagcccatccccggcagccccaacggccccaacaacaccgtgtgcgaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggccccagcgtggtgggcctggtgagcatccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagaagcgtgatccccagacagaaggtgctgtgcgtgttctgggagcacggccagaacggctgcggccactgggccaccaccggctgcagcaccatcggcaccagagacaccagcaccatctgcagatgcacccacctgagcagcttcgccgtgctgatggcccactacgacgtgcaggaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18022 - DNA, 2472 bp, Artificial Sequence; identical to SEQ ID NO: 18021
  Description of Artificial Sequence: Synthetic coding sequence

SEQ ID NO: 18023 - DNA, 2325 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggccccagcgtggtgggcctggtgagcatccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagaagcgtgatccccagacagaaggtgctgtgcgtgttctgggagcacggccagaacggctgcggccactgggccaccaccggctgcagcaccatcggcaccagagacaccagcaccatctgcagatgcacccacctgagcagcttcgccgtgctgatggcccactacgacgtgcaggaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18024 - DNA, 2046 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggccccagcgtggtgggcctggtgagcatccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagaagcgtgatccccagacagaaggtgctgtgcgtgttctgggagcacggccagaacggctgcggccactgggccaccaccggctgcagcaccatcggcaccagagacaccagcaccatctgcagatgcacccacctgagcagcttcgccgtgctgatggcccactacgacgtgcaggaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18025 - DNA, 2193 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggccccagcgtggtgggcctggtgagcatccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagaagcgtgatccccagacagaaggtgctgtgcgtgttctgggagcacggccagaacggctgcggccactgggccaccaccggctgcagcaccatcggcaccagagacaccagcaccatctgcagatgcacccacctgagcagcttcgccgtgctgatggcccactacgacgtgcaggaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18026 - DNA, 720 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtgaacgagtgcaccagcggccagaacccctgccacagcagcacccactgcctgaacaacgtgggcagctaccagtgcagatgcagacccggctggcagcccatccccggcagccccaacggccccaacaacaccgtgtgcgagggcagagagctgagaagccacgtgcccagagacccccagaccagcgaccacatgttcaacggcgcccacaccaaccaggccgagtag

SEQ ID NO: 18027 - DNA, 1140 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggcggcggcagcagagccgactgccaccacctgcacggcgccgagagactgagcgccgtgcccccccccggcggcccccacttcagccccgtgtag

SEQ ID NO: 18028 - DNA, 678 bp, Artificial Sequence
  Description of Artificial Sequence: Synthetic coding sequence
atgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccgtgagcgaccccgagaccgagggcgccctgtgcctgctgggcgcctggcccgagtggatgtggagcctgggccaccacagactgcagcacaacagacaccagagacaccagcaccacctgcccctgcacccccccgagcagctgtgcagaccccacggccccctgagatgcgccggcggcggcagcagagccgactgccaccacctgcacggcgccgagagactgagcgccgtgcccccccccggcggcccccacttcagccccgtgtag

SEQ ID NO: 18029 - DNA, 2298 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtgaacgagtgcaccagcggccagaacccctgccacagcagcacccactgcctgaacaacgtgggcagctaccagtgcagatgcagacccggctggcagcccatccccggcagccccaacggccccaacaacaccgtgtgcgaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggccccagcgtggtgggcctggtgagcatccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagagaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18030 - DNA, 2439 bp, Artificial Sequence
  Description of Artificial Sequence: Synthetic coding sequence
atgggcggcagagtgttcctggtgttcctggccttctgcgtgtggctgaccctgcccggcgccgagacccaggacagcagaggctgcgccagatggtgcccccaggacagcagctgcgtgaacgccaccgcctgcagatgcaaccccggcttcagcagcttcagcgagatcatcaccacccccatggagacctgcgacgacatcaacgagtgcgccaccctgagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagctgaagcccgaggaccccaagctgtgcaccgacgtgaacgagtgcaccagcggccagaacccctgccacagcagcacccactgcctgaacaacgtgggcagctaccagtgcagatgcagacccggctggcagcccatccccggcagccccaacggccccaacaacaccgtgtgcgaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagactacaagcccggcctggccaacaacaccatccagagcatcctgcaggccctggacgagctgctggaggcccccggcgacctggagaccctgcccagactgcagcagcactgcgtggccagccacctgctggacggcctggaggacgtgctgagaggcctgagcaagaacctgagcaacggcctgctgaacttcagctaccccgccggcaccgagctgagcctggaggtgcagaagcaggtggacagaagcgtgaccctgagacagaaccaggccgtgatgcagctggactggaaccaggcccagaagagcggcgaccccggcatgggcaagctgctggccgaggcccccctggtgctggagcccgagaagcagatgctgctgcacgagacccaccagggcctgctgcaggacggcagccccatcctgctgagcgacgtgatcagcgccttcctgagcaacaacgacacccagaacctgagcagccccgtgaccttcaccttcagccacagaagcgtgatccccagacagaaggtgctgtgcgtgttctgggagcacggccagaacggctgcggccactgggccaccaccggctgcagcaccatcggcaccagagacaccagcaccatctgcagatgcacccacctgagcagcttcgccgtgctgatggcccactacgacgtgcaggaggaggaccccgtgctgaccgtgatcacctacatgggcctgagcgtgagcctgctgtgcctgctgctggccgccctgaccttcctgctgtgcaaggccatccagaacaccagcaccagcctgcacctgcagctgagcctgtgcctgttcctggcccacctgctgttcctggtggccatcgaccagaccggccacaaggtgctgtgcagcatcatcgccggcaccctgcactacctgtacctggccaccctgacctggatgctgctggaggccctgtacctgttcctgaccgccagaaacctgaccgtggtgaactacagcagcatcaacagattcatgaagaagctgatgttccccgtgggctacggcgtgcccgccgtgaccgtggccatcagcgccgccagcagaccccacctgtacggcacccccagcagatgctggctgcagcccgagaagggcttcatctggggcttcctgggccccgtgtgcgccatcttcagcgtgaacctggtgctgttcctggtgaccctgtggatcctgaagaacagactgagcagcctgaacagcgaggtgagcaccctgagaaacaccagaatgctggccttcaaggccaccgcccagctgttcatcctgggctgcacctggtgcctgggcatcctgcaggtgggccccgccgccagagtgatggcctacctgttcaccatcatcaacagcctgcagggcgtgttcatcttcctggtgtactgcctgctgagccagcaggtgagagagcagtacggcaagtggagcaagggcatcagaaagctgaagaccgagagcgagatgcacaccctgagcagcagcgccaaggccgacaccagcaagcccagcaccgtgaactag

SEQ ID NO: 18031 - DNA, 2874 bp, Artificial Sequence
  Description of Artificial Sequence: Synthetic coding sequence
atgtacggcagcgccagaaccatcaccaacctggagggcagccccagcagaagccccagactgcccagaagccccagactgggccacagaagaaccagcagcggcggcggcggcggcaccggcaagaccctgagcatggagaacatccagagcctgaacgccgcctacgccaccagcggccccatgtacctgagcgaccacgagggcgtggccagcaccacctaccccaagggcaccatgaccctgggcagagccaccaacagagccgtgtacggcggcagagtgaccgccatgggcagcagccccaacatcgccagcgccggcctgagccacaccgacgtgctgagctacaccgaccagcacggcggcctgaccggcagcagccaccaccaccaccaccaggtgcccagcatgctgagacaggtgagagacagcaccatgctggacctgcaggcccagctgaaggagctgcagagagagaacgacctgctgagaaaggagctggacatcaaggacagcaagctgggcagcagcatgaacagcatcaagaccttctggagccccgagctgaagaaggagagagtgctgagaaaggaggaggccgccagaatgagcgtgctgaaggagcagatgagagtgagccacgaggagaaccagcacctgcagctgaccatccaggccctgcaggacgagctgagaacccagagagacctgaaccacctgctgcagcaggagagcggcaacagaggcgccgagcacttcaccatcgagctgaccgaggagaacttcagaagactgcaggccgagcacgacagacaggccaaggagctgttcctgctgagaaagaccctggaggagatggagctgagaatcgagacccagaagcagaccctgaacgccagagacgagagcatcaagaagctgctggagatgctgcagagcaagggcctgcccagcaagagcctggaggacgacaacgagagaaccagaagaatggccgaggccgagagccaggtgagccacctggaggtgatcctggaccagaaggagaaggagaacatccacctgagagaggagctgcacagaagaagccagctgcagcccgagcccgccaagaccaaggccctgcagaccgtgatcgagatgaaggacaccaagatcgccagcctggagagaaacatcagagacctggaggacgagatccagatgctgaaggccaacggcgtgctgaacaccgaggacagagaggaggagatcaagcagatcgaggtgtacaagagccacagcaagttcatgaagaccaagatcgaccagctgaagcaggagctgagcaagaaggagagcgagctgctggccctgcagaccaagctggagaccctgagcaaccagaacagcgactgcaagcagcacatcgaggtgctgaaggagagcctgaccgccaaggagcagagagccgccatcctgcagaccgaggtggacgccctgagactgagactggaggagaaggagagcttcctgaacaagaagaccaagcagctgcaggacctgaccgaggagaagggcaccctggccggcgagatcagagacatgaaggacatgctggaggtgaaggagagaaagatcaacgtgctgcagaagaagatcgagaacctgcaggagcagctgagagacaaggacaagcagctgaccaacctgaaggacagagtgaagagcctgcagaccgacagcagcaacaccgacaccgccctggccaccctggaggaggccctgagcgagaaggagagaatcatcgagagactgaaggagcagagagagagagacgacagagagagactggaggagatcgagagcttcagaaaggagaacaaggacctgaaggagaaggtgaacgccctgcaggccgagctgaccgagaaggagagcagcctgatcgacctgaaggagcacgccagcagcctggccagcgccggcctgaagagagacagcaagctgaagagcctggagatcgccatcgagcagaagaaggaggagtgcagcaagctggaggcccagctgaagaaggcccacaacatcgaggacgacagcagaatgaaccccgagttcgccgaccagatcaagcagctggacaaggaggccagctactacagagacgagtgcggcaaggcccaggccgaggtggacagactgctggagatcctgaaggaggtggagaacgagaagaacgacaaggacaagaagatcgccgagctggagagcctgaccctgagacacatgaaggaccagaacaagaaggtggccaacctgaagcacaaccagcagctggagaagaagaagaacgcccagctgctggaggaggtgagaagaagagaggacagcatggccgacaacagccagcacctgcagatcgaggagctgatgaacgccctggagaagaccagacaggagctggacgccaccaaggccagactggccagcacccagcagagcctggccgagaaggaggcccacctggccaacctgagaatcgagagaagaaagcagctggaggagatcctggagatgaagcaggaggccctgctggccgccatcagcgagaaggacgccaacatcgccctgctggagctgagcgccagcaagaagaagaagacccaggaggaggtgatggccctgaagagagagaaggacagactggtgcaccagctgaagcagcagacccagaacagaatgaagctgatggccgacaactacgacgacgaccaccaccactaccaccaccaccaccaccaccaccaccacagaagccccggcagaagccagcacagcaaccacagacccagccccgaccaggacgacgaggagggcatctgggcctag

SEQ ID NO: 18032 - DNA, 2874 bp, Artificial Sequence; identical to SEQ ID NO: 18031
  Description of Artificial Sequence: Synthetic coding sequence

SEQ ID NO: 18033 - DNA, 1587 bp, Artificial Sequence
  Description of Artificial Sequence: Synthetic coding sequence
tgaagaagccagctgcagcccgagcccgccaagaccaaggccctgcagaccgtgatcgagatgaaggacaccaagatcgccagcctggagagaaacatcagagacctggaggacgagatccagatgctgaaggccaacggcgtgctgaacaccgaggacagagaggaggagatcaagcagatcgaggtgtacaagagccacagcaagttcatgaagaccaagatcgaccagctgaagcaggagctgagcaagaaggagagcgagctgctggccctgcagaccaagctggagaccctgagcaaccagaacagcgactgcaagcagcacatcgaggtgctgaaggagagcctgaccgccaaggagcagagagccgccatcctgcagaccgaggtggacgccctgagactgagactggaggagaaggagagcttcctgaacaagaagaccaagcagctgcaggacctgaccgaggagaagggcaccctggccggcgagatcagagacatgaaggacatgctggaggtgaaggagagaaagatcaacgtgctgcagaagaagatcgagaacctgcaggagcagctgagagacaaggacaagcagctgaccaacctgaaggacagagtgaagagcctgcagaccgacagcagcaacaccgacaccgccctggccaccctggaggaggccctgagcgagaaggagagaatcatcgagagactgaaggagcagagagagagagacgacagagagagactggaggagatcgagagcttcagaaaggagaacaaggacctgaaggagaaggtgaacgccctgcaggccgagctgaccgagaaggagagcagcctgatcgacctgaaggagcacgccagcagcctggccagcgccggcctgaagagagacagcaagctgaagagcctggagatcgccatcgagcagaagaaggaggagtgcagcaagctggaggcccagctgaagaagcaggccgagcagctgttcaaccagatgtacaaccccgcccacaacatcgaggacgacagcagaatgaaccccgagttcgccgaccagatcaagcagctggacaaggaggccagctactacagagacgagtgcggcaaggcccaggccgaggtggacagactgctggagatcctgaaggaggtggagaacgagaagaacgacaaggacaagaagatcgccgagctggagagacacatgaaggaccagaacaagaaggtggccaacctgaagcacaaccagcagctggagaagaagaagaacgcccagctgctggaggaggtgagaagaagagaggacagcatggccgacaacagccagcacctgcagatcgaggagctgatgaacgccctggagaagaccagacaggagctggacgccaccaaggccagactggccagcacccagcagagcctggccgagaaggaggcccacctggccaacctgagaatcgagagaagaaagcagctggaggagatcctggagatgaagcaggaggccctgctggccgccatcagcgagaaggacgccaacatcgccctgctggagctgagcgccagcaagaagaagtag

SEQ ID NO: 18034 - DNA, 984 bp, Artificial Sequence
  Description of Artificial Sequence: Synthetic coding sequence
atgagagccctgcccggcctgctggaggccagagccagaacccccagactgctgctgctgcagtgcctgctggccgccgccagacccagcagcgccgacggcagcgcccccgacagccccttcaccagcccccccctgagagaggagatcatggccaacaacttcagcctggagagccacaacatcagcctgaccgagcacagcagcatgcccgtggagaagaacatcaccctggagagacccagcaacgtgaacctgacctgccagttcaccaccagcggcgacctgaacgccgtgaacgtgacctggaagaaggacggcgagcagctggagaacaactacctggtgagcgccaccggcagcaccctgtacacccagtacagattcaccatcatcaacagcaagcagatgggcagctacagctgcttcttcagagaggagaaggagcagagaggcaccttcaacttcaaggtgcccgagctgcacggcaagaacaagcccctgatcagctacgtgggcgacagcaccgtgctgacctgcaagtgccagaactgcttccccctgaactggacctggtacagcagcaacggcagcgtgaaggtgcccgtgggcgtgcagatgaacaagtacgtgatcaacggcacctacgccaacgagaccaagctgaagatcacccagctgctggaggaggacggcgagagctactggtgcagagccctgttccagctgggcgagagcgaggagcacatcgagctggtggtgctgagctacctggtgcccctgaagcccttcctggtgatcgtggccgaggtgatcctgctggtggccaccatcctgctgtgcgagaagtacacccagaagaagaagaagcacagcgacgagggcaaggagttcgagcagatcgagcagctgaagagcgacgacagcaacggcatcgagaacaacgtgcccagacacagaaagaacgagagcctgggccagtag

SEQ ID NO: 18035 - DNA, 621 bp, Artificial Sequence
  Description of Artificial Sequence: Synthetic coding sequence
atgggcgccgagtgggagctgggcgccgaggccggcggcagcctgctgctgtgcgccgccctgctggccgccggctgcgccctgggcctgagactgggcagaggccagggcgccgccgacagaggcgccctgatctggctgtgctacgacgccctggtgcacttcgccctggagggccccttcgtgtacctgagcctggtgggcaacgtggccaacagcgacggcctgatcgccagcctgtggaaggagtacggcaaggccgacgccagatgggtgtacttcgaccccaccatcgtgagcgtggagatcctgaccgtggccctggacggcagcctggccctgttcctgatctacgccatcgtgaaggagaagtactacagacacttcctgcagatcaccctgtgcgtgtgcgagctgtacggctgctggatgaccttcctgcccgagtggctgaccagaagccccaacctgaacaccagcaactggctgtactgctggctgtacctgttcttcttcaacggcgtgtgggtgctgatccccggcctgctgctgtggcagagctggctggagctgaagaagatgcaccagaaggagaccagcagcgtgaagaagttccagtag

SEQ ID NO: 18036 - DNA, 261 bp, Artificial Sequence
  Description of Artificial Sequence: Synthetic coding sequence
atgggcgccgagtgggagctgggcgccgaggccggcggcagcctgctgctgtgcgccgccctgctggccgccggctgcgccctgggcctgagactgggcagaggccagggcgccgccgacagaggcgccctgatctggctgtgctacgacgccctggtgcacttcgccctggagagagtgggcaagaccaccaaccaggagagcgccggcgtgctgggcagcaccgagtggaacttcaagaacaccgacaagctgctgtag

SEQ ID NO: 18037 - DNA, 1257 bp, Artificial Sequence
  Description of Artificial Sequence: Synthetic coding sequence
atggccaccagcgagcagagcatctgccaggccagagccagcgtgatggtgtacgacgacaccagcaagaagtgggtgcccatcaagcccggccagcagggcttcagcagaatcaacatctaccacaacaccgccagcaacaccttcagagtggtgggcgtgaagctgcaggaccagcaggtggtgatcaactacagcatcgtgaagggcctgaagtacaaccaggccacccccaccttccaccagtggagagacgccagacaggtgtacggcctgaacttcgccagcaaggaggaggccaccaccttcagcaacgccatgctgttcgccctgaacatcatgaacagccaggagggcggccccagcagccagagacaggtgcagaacggccccagccccgacgagatggacatccagagaagacaggtgatggagcagcaccagcagcagagacaggagagcctggagagaagaaccagcgccaccggccccatcctgccccccggccaccccagcagcgccgccagcgcccccgtgagctgcagcggcccccccccccccccccccccccccgtgccccccccccccaccggcgccaccccccccccccccccccccctgcccgccggcggcgcccagggcagcagccacgacgagagcagcatgagcggcctggccgccgccatcgccggcgccaagctgagaagagtgcagagacccgaggacgccagcggcggcagcagccccagcggcaccagcaagagcgacgccaacagagccagcagcggcggcggcggcggcggcctgatggaggagatgaacaagctgctggccaagagaagaaaggccgccagccagagcgacaagcccgccgagaagaaggaggacgagagccagatggaggaccccagcaccagccccagccccggcaccagagccgccagccagccccccaacagcagcgaggccggcagaaagccctgggagagaagcaacagcgtggagaagcccgtgagcagcatcctgagcagaacccccagcgtggccaagagccccgaggccaagagccccctgcagagccagccccacagcagaatgaagcccgccggcagcgtgaacgacatggccctggacgccttcgacctggacagaatgaagcaggagatcctggaggaggtggtgagagagctgcacaaggtgaaggaggagatcatcgacgccatcagacaggagctgagcggcatcagcaccacctag

SEQ ID NO: 18038 - DNA, 1251 bp, Artificial Sequence
  Description of Artificial Sequence: Synthetic coding sequence
atgagcgagcagagcatctgccaggccagagccagcgtgatggtgtacgacgacaccagcaagaagtgggtgcccatcaagcccggccagcagggcttcagcagaatcaacatctaccacaacaccgccagcaacaccttcagagtggtgggcgtgaagctgcaggaccagcaggtggtgatcaactacagcatcgtgaagggcctgaagtacaaccaggccacccccaccttccaccagtggagagacgccagacaggtgtacggcctgaacttcgccagcaaggaggaggccaccaccttcagcaacgccatgctgttcgccctgaacatcatgaacagccaggagggcggccccagcagccagagacaggtgcagaacggccccagccccgacgagatggacatccagagaagacaggtgatggagcagcaccagcagcagagacaggagagcctggagagaagaaccagcgccaccggccccatcctgccccccggccaccccagcagcgccgccagcgcccccgtgagctgcagcggcccccccccccccccccccccccccgtgccccccccccccaccggcgccaccccccccccccccccccccctgcccgccggcggcgcccagggcagcagccacgacgagagcagcatgagcggcctggccgccgccatcgccggcgccaagctgagaagagtgcagagacccgaggacgccagcggcggcagcagccccagcggcaccagcaagagcgacgccaacagagccagcagcggcggcggcggcggcggcctgatggaggagatgaacaagctgctggccaagagaagaaaggccgccagccagagcgacaagcccgccgagaagaaggaggacgagagccagatggaggaccccagcaccagccccagccccggcaccagagccgccagccagccccccaacagcagcgaggccggcagaaagccctgggagagaagcaacagcgtggagaagcccgtgagcagcatcctgagcagaacccccagcgtggccaagagccccgaggccaagagccccctgcagagccagccccacagcagaatgaagcccgccggcagcgtgaacgacatggccctggacgccttcgacctggacagaatgaagcaggagatcctggaggaggtggtgagagagctgcacaaggtgaaggaggagatcatcgacgccatcagacaggagctgagcggcatcagcaccacctag

SEQ ID NO: 18039 - DNA, 1146 bp, Artificial Sequence
  Description of Artificial Sequence: Synthetic coding sequence
atggccaccagcgagcagagcatctgccaggccagagccagcgtgatggtgtacgacgacaccagcaagaagtgggtgcccatcaagcccggccagcagggcttcagcagaatcaacatctaccacaacaccgccagcaacaccttcagagtggtgggcgtgaagctgcaggaccagcaggtggtgatcaactacagcatcgtgaagggcctgaagtacaaccaggccacccccaccttccaccagtggagagacgccagacaggtgtacggcctgaacttcgccagcaaggaggaggccaccaccttcagcaacgccatgctgttcgccctgaacatcatgaacagccaggagggcggccccagcagccagagacaggtgcagaacggccccagccccgacgagatggacatccagagaagacaggtgatggagcagcaccagcagcagagacaggagagcctggagagaagaaccagcgccaccggccccatcctgccccccggccaccccagcagcgccgccagcgcccccgtgagctgcagcggcgcccccagcggcctggccgccgccatcgccggcgccaagctgagaagagtgcagagacccgaggacgccagcggcggcagcagccccagcggcaccagcaagagcgacgccaacagagccagcagcggcggcggcggcggcggcctgatggaggagatgaacaagctgctggccaagagaagaaaggccgccagccagagcgacaagcccgccgagaagaaggaggacgagagccagatggaggaccccagcaccagccccagccccggcaccagagccgccagccagccccccaacagcagcgaggccggcagaaagccctgggagagaagcaacagcgtggagaagcccgtgagcagcatcctgagcagaacccccagcgtggccaagagccccgaggccaagagccccctgcagagccagccccacagcagaatgaagcccgccggcagcgtgaacgacatggccctggacgccttcgacctggacagaatgaagcaggagatcctggaggaggtggtgagagagctgcacaaggtgaaggaggagatcatcgacgccatcagacaggagctgagcggcatcagcaccacctag

SEQ ID NO: 18040 - DNA, 1173 bp, Artificial Sequence
  Description of Artificial Sequence: Synthetic coding sequence
atgttcgccttcgaggagttcagcgagcagagcatctgccaggccagagccagcgtgatggtgtacgacgacaccagcaagaagtgggtgcccatcaagcccggccagcagggcttcagcagaatcaacatctaccacaacaccgccagcaacaccttcagagtggtgggcgtgaagctgcaggaccagcaggtggtgatcaactacagcatcgtgaagggcctgaagtacaaccaggccacccccaccttccaccagtggagagacgccagacaggtgtacggcctgaacttcgccagcaaggaggaggccaccaccttcagcaacgccatgctgttcgccctgaacatcatgaacagccaggagggcggccccagcagccagagacaggtgcagaacggccccagccccgacgagatggacatccagagaagacaggtgatggagcagcaccagcagcagagacaggagagcctggagagaagaaccagcgccaccggccccatcctgccccccggccaccccagcagcgccgccagcgcccccgtgagctgcagcggcccccccccccccccccccccccccgtgccccccccccccaccggcgccaccccccccccccccccccccctgcccgccggcggcgcccagggcagcagccacgacgagagcagcatgagcggcctggccgccgccatcgccggcgccaagctgagaagagtgcagagacccgaggacgccagcggcggcagcagccccagcggcaccagcaagagcgacgccaacagagccagcagcggcggcggcggcggcggcctgatggaggagatgaacaagctgctggccaagagaagaaaggccgccagccagagcgacaagcccgccgagaagaaggaggacgagagccagatggaggaccccagcaccagccccagccccggcaccagagccgccagccagccccccaacagcagcgaggccggcagaaagccctgggagagaagcaacagcgtggagaagcccgtgagcagcatcctgagcagaacccccagcgtggccaagagccccgaggccaagagccccctgcagagccagccccacagcagatacagaaccaccctgctgctgacctgcccccccggcttcggcgcccccctgagccccgtgccctag

SEQ ID NO: 18041 - DNA, 639 bp, Artificial Sequence
  Description of Artificial Sequence: Synthetic coding sequence
ccccccccccccccccccgtgccccccccccccaccggcgccaccccccccccccccccccccctgcccgccggcggcgcccagggcagcagccacgacgagagcagcatgagcggcctggccgccgccatcgccggcgccaagctgagaagagtgcagagacccgaggacgccagcggcggcagcagccccagcggcaccagcaagagcgacgccaacagagccagcagcggcggcggcggcggcggcctgatggaggagatgaacaagctgctggccaagagaagaaaggccgccagccagagcgacaagcccgccgagaagaaggaggacgagagccagatggaggaccccagcaccagccccagccccggcaccagagccgccagccagccccccaacagcagcgaggccggcagaaagccctgggagagaagcaacagcgtggagaagcccgtgagcagcatcctgagcagaatgaagcccgccggcagcgtgaacgacatggccctggacgccttcgacctggacagaatgaagcaggagatcctggaggaggtggtgagagagctgcacaaggtgaaggaggagatcatcgacgccatcagacaggagctgagcggcatcagcaccacctag

SEQ ID NO: 18042 - DNA, 1617 bp, Artificial Sequence
  Description of Artificial Sequence: Synthetic coding sequence
atgggcctgctgctgctggtgctgatcctgacccccagcctggccgcctacagacaccccgacttccccctgctggagaaggcccagcagctgctgcagagcaccggcagcccctacagcaccaactgctggctgtgcaccagcagcagcaccgagacccccggcaccgcctaccccgccagccccagagagtggaccagcatcgaggccgagctgcacatcagctacagatgggaccccaacctgaagggcctgatgagacccgccaacagcctgctgagcaccgtgaagcaggacttccccgacatcagacagaagccccccatcttcggccccatcttcaccaacatcaacctgatgggcatcgcccccatctgcgtgatggccaagagaaagaacggcaccaacgtgggcaccctgcccagcaccgtgtgcaacgtgaccttcaccgtggacagcaaccagcagacctaccagacctacacccacaaccagttcagacaccagcccagattccccaagccccccaacatcaccttcccccagggcaccctgctggacaagagcagcagattctgccagggcagacccagcagctgcagcaccagaaacttctggttcagacccgccgactacaaccagtgcctgcagatcagcaacctgagcagcaccgccgagtgggtgctgctggaccagaccagaaacagcctgttctgggagaacaagaccaagggcgccaaccagagccagaccccctgcgtgcaggtgctggccggcatgaccatcgccaccagctacctgggcatcagcgccgtgagcgagttcttcggcaccagcctgacccccctgttccacttccacatcagcacctgcctgaagacccagggcgccttctacatctgcggccagagcatccaccagtgcctgcccagcaactggaccggcacctgcaccatcggctacgtgacccccgacatcttcatcgcccccggcaacctgagcctgcccatccccatctacggcaacagccccctgcccagagtgagaagagccatccacttcatccccctgctggccggcctgggcatcctggccggcaccggcaccggcatcgccggcatcaccaaggccagcctgacctacagccagctgagcaaggagatcgccaacaacatcgacaccatggccaaggccctgaccaccatgcaggagcagatcgacagcctggccgccgtggtgctgcagaacagaagaggcctggacatgctgaccgccgcccagggcggcatctgcctggccctggacgagaagtgctgcttctgggtgaaccagagcggcaaggtgcaggacaacatcagacagctgctgaaccaggccagcagcctgagagagagagccacccagggctggctgaactgggagggcacctggaagtggttcagctgggtgctgcccctgaccggccccctggtgagcctgctgctgctgctgctgttcggcccctgcctgctgaacctgatcacccagttcgtgagcagcagactgcaggccatcaagctgcagaccaacctgagcgccggcagacaccccagaaacatccaggagagccccttctag

SEQ ID NO: 18043 - DNA, 1617 bp, Artificial Sequence; identical to SEQ ID NO: 18042
  Description of Artificial Sequence: Synthetic coding sequence

SEQ ID NO: 18044 - DNA, 1617 bp, Artificial Sequence
  Description of Artificial Sequence: Synthetic coding sequence
atggccctgccctaccacatcttcctgttcaccgtgctgctgcccagcttcaccctgaccgccccccccccctgcagatgcatgaccagcagcagcccctaccaggagttcctgtggagaatgcagagacccggcaacatcgacgcccccagctacagaagcctgagcaagggcacccccaccttcaccgcccacacccacatgcccagaaactgctaccacagcgccaccctgtgcatgcacgccaacacccactactggaccggcaagatgatcaaccccagctgccccggcggcctgggcgtgaccgtgtgctggacctacttcacccagaccggcatgagcgacggcggcggcgtgcaggaccaggccagagagaagcacgtgaaggaggtgatcagccagctgaccagagtgcacggcaccagcagcccctacaagggcctggacctgagcaagctgcacgagaccctgagaacccacaccagactggtgagcctgttcaacaccaccctgaccggcctgcacgaggtgagcgcccagaaccccaccaactgctggatctgcctgcccctgaacttcagaccctacgtgagcatccccgtgcccgagcagtggaacaacttcagcaccgagatcaacaccaccagcgtgctggtgggccccctggtgagcaacctggagatcacccacaccagcaacctgacctgcgtgaagttcagcaacaccacctacaccaccaacagccagtgcatcagatgggtgaccccccccacccagatcgtgtgcctgcccagcggcatcttcttcgtgtgcggcaccagcgcctacagatgcctgaacggcagcagcgagagcatgtgcttcctgagcttcctggtgccccccatgaccatctacaccgagcaggacctgtacagctacgtgatcagcaagcccagaaacaagagagtgcccatcctgcccttcgtgatcggcgccggcgtgctgggcgccctgggcaccggcatcggcggcatcaccaccagcacccagttctactacaagctgagccaggagctgaacggcgacatggagagagtggccgacagcctggtgaccctgcaggaccagctgaacagcctggccgccgtggtgctgcagaacagaagagccctggacctgctgaccgccgagagaggcggcacctgcctgttcctgggcgaggagtgctgctactacgtgaaccagagcggcatcgtgaccgagaaggtgaaggagatcagagacagaatccagagaagagccgaggagctgagaaacaccggcccctggggcctgctgagccagtggatgccctggatcctgcccttcctgggccccctggccgccatcatcctgctgctgctgttcggcccctgcatcttcaacctgctggtgaacttcgtgagcagcagaatcgaggccgtgaagctgcagatggagcccaagatgcagagcaagaccaagatctacagaagacccctggacagacccgccagccccagaagcgacgtgaacgacatcaagggcaccccccccgaggagatcagcgccgcccagcccctgctgagacccaacagcgccggcagcagctag

SEQ ID NO: 18045 - DNA, 1710 bp, Artificial Sequence
  Description of Artificial Sequence: Synthetic coding sequence
atgggcagcaccctgggctgccacagaagcatccccagagaccccagcgacctgagccacagcagaaagttcagcgccgcctgcaacttcagcaacatcctggtgaaccaggagagactgaacatcaacaccgccaccgaggaggagctgatgaccctgcccggcgtgaccagagccgtggccagaagcatcgtggagtacagagagtacatcggcggcttcaagaaggtggaggacctggccctggtgagcggcgtgggcgccaccaagctggagcaggtgaagttcgagatctgcgtgagcagcaagggcagcagcgcccagcacagccccagcagcctgagaagagacctgctggccgagcagcagccccaccacctggccaccgccgtgcccctgacccccagagtgaacatcaacaccgccacccccgcccagctgatgagcgtgagaggcctgagcgagaagatggccctgagcatcgtggacttcagaagagagcacggccccttcagaagcgtggaggacctggtgagaatggacggcatcaacgccgccttcctggacagaatcagacaccaggtgttcgccgagagaagcagaccccccagcacccacaccaacggcggcctgaccttcaccgccaagccccaccccagccccaccagcctgagcctgcagagcgaggacctggacctgccccccggcggccccacccagatcatcagcaccagacccagcgtggaggccttcggcggcaccagagacggcagacccgtgctgagactggccacctggaacctgcagggctgcagcgtggagaaggccaacaaccccggcgtgagagaggtggtgtgcatgaccctgctggagaacagcatcaagctgctggccgtgcaggagctgctggacagagaggccctggagaagttctgcaccgagctgaaccagcccaccctgcccaacatcagaaagtggaagggccccagaggctgctggaaggccgtggtggccgagaagcccagcagccagctgcagaagggcgccggctacgccggcttcctgtgggacgccgccgccggcatggagctgagagacgccggcagccaggagagcagccccagcaacggccacggcaagctggccggccccagcccctacctgggcagattcaaggtgggcagccacgacctgaccctggtgaacctgcacctggccgccctgaccctgctgggcagcgagaaccccagcaagaaccacagcgacggccacagactggccagcttcgcccagaccctgcaggagaccctgaagggcgagaaggacgtgatcatcctgggcgacttcggccagggccccgacagcaacgactacgacatcctgagaaaggagaagttccaccacctgatccccgcccacaccttcaccaacatcagcaccaagaacccccagggcagcaagagcctggacaacatctggatcagcaagagcctgaagaaggtgttcaccggccactgggccgtggtgagagagggcctgaccaacccctggatccccgacaactggagctggggcggcgtggccagcgagcactgccccgtgctggccgagttctacaccgagaaggactggagcaagaaggacgcccccagaaacggcagcggcgtggccctggagagaagcgaggccaacatcaagcacgagagatag

SEQ ID NO: 18046 - DNA, 1710 bp, Artificial Sequence; identical to SEQ ID NO: 18045
  Description of Artificial Sequence: Synthetic coding sequence

SEQ ID NO: 18047 - DNA, 822 bp, Artificial Sequence
  Description of Artificial Sequence: Synthetic coding sequence
atggaggccgcccccagcagattcatgttcctgctgttcctgctgacctgcgagctggccgccgaggtggccgccgaggtggagaagagcagcgacggccccggcgccgcccaggagcccacctggctgaccgacgtgcccgccgccatggagttcatcgccgccaccgaggtggccgtgatcggcttcttccaggacctggagatccccgccgtgcccatcctgcacagcatggtgcagaagttccccggcgtgagcttcggcatcagcaccgacagcgaggtgctgacccactacaacatcaccggcaacaccatctgcctgttcagactggtggacaacgagcagctgaacctggaggacgaggacatcgagagcatcgacgccaccaagctgagcagattcatcgagatcaacagcctgcacatggtgaccgagtacaaccccgtgaccgtgatcggcctgttcaacagcgtgatccagatccacctgctgctgatcatgaacaaggccagccccgagtacgaggagaacatgcacagataccagaaggccgccaagctgttccagggcaagatcctgttcatcctggtggacagcggcatgaaggagaacggcaaggtgatcagcttcttcaagctgaaggagagccagctgcccgccctggccatctaccagaccctggacgacgagtgggacaccctgcccaccgccgaggtgagcgtggagcacgtgcagaacttctgcgacggcttcctgagcggcaagctgctgaaggagaacagagagagcgagggcaagacccccaaggtggagctgtag

SEQ ID NO: 18048 - DNA, 2934 bp, Artificial Sequence
  Description of Artificial Sequence: Synthetic coding sequence
atgcccgccagaagactgctgctgctgctgaccctgctgctgcccggcctgggcatcttcggcagcaccagcaccgtgaccctgcccgagaccctgctgttcgtgagcaccctggacggcagcctgcacgccgtgagcaagagaaccggcagcatcaagtggaccctgaaggaggaccccgtgctgcaggtgcccacccacgtggaggagcccgccttcctgcccgaccccaacgacggcagcctgtacaccctgggcagcaagaacaacgagggcctgaccaagctgcccttcaccatccccgagctggtgcaggccagcccctgcagaagcagcgacggcatcctgtacatgggcaagaagcaggacatctggtacgtgatcgacctgctgaccggcgagaagcagcagaccctgagcagcgccttcgccgacagcctgtgccccagcaccagcctgctgtacctgggcagaaccgagtacaccatcaccatgtacgacaccaagaccagagagctgagatggaacgccacctacttcgactacgccgccagcctgcccgaggacgacgtggactacaagatgagccacttcgtgagcaacggcgacggcctggtggtgaccgtggacagcgagagcggcgacgtgctgtggatccagaactacgccagccccgtggtggccttctacgtgtggcagagagagggcctgagaaaggtgatgcacatcaacgtggccgtggagaccctgagatacctgaccttcatgagcggcgaggtgggcagaatcaccaagtggaagtaccccttccccaaggagaccgaggccaagagcaagctgacccccaccctgtacgtgggcaagtacagcaccagcctgtacgccagccccagcatggtgcacgagggcgtggccgtggtgcccagaggcagcaccctgcccctgctggagggcccccagaccgacggcgtgaccatcggcgacaagggcgagtgcgtgatcacccccagcaccgacgtgaagttcgaccccggcctgaagagcaagaacaagctgaactacctgagaaactactggctgctgatcggccaccacgagacccccctgagcgccagcaccaagatgctggagagattccccaacaacctgcccaagcacagagagaacgtgatccccgccgacagcgagaagaagagcttcgaggaggtgatcaacctggtggaccagaccagcgagaacgcccccaccaccgtgagcagagacgtggaggagaagcccgcccacgcccccgccagacccgaggcccccgtggacagcatgctgaaggacatggccaccatcatcctgagcaccttcctgctgatcggctgggtggccttcatcatcacctaccccctgagcatgcaccagcagcagcagctgcagcaccagcagttccagaaggagctggagaagatccagctgctgcagcagcagcagcagcagctgcccttccacccccccggcgacaccgcccaggacggcgagctgctggacaccagcggcccctacagcgagagcagcggcaccagcagccccagcaccagccccagagccagcaaccacagcctgtgcagcggcagcagcgccagcaaggccggcagcagccccagcctggagcaggacgacggcgacgaggagaccagcgtggtgatcgtgggcaagatcagcttctgccccaaggacgtgctgggccacggcgccgagggcaccatcgtgtacagaggcatgttcgacaacagagacgtggccgtgaagagaatcctgcccgagtgcttcagcttcgccgacagagaggtgcagctgctgagagagagcgacgagcaccccaacgtgatcagatacttctgcaccgagaaggacagacagttccagtacatcgccatcgagctgtgcgccgccaccctgcaggagtacgtggagcagaaggacttcgcccacctgggcctggagcccatcaccctgctgcagcagaccaccagcggcctggcccacctgcacagcctgaacatcgtgcacagagacctgaagccccacaacatcctgatcagcatgcccaacgcccacggcaagatcaaggccatgatcagcgacttcggcctgtgcaagaagctggccgtgggcagacacagcttcagcagaagaagcggcgtgcccggcaccgagggctggatcgcccccgagatgctgagcgaggactgcaaggagaaccccacctacaccgtggacatcttcagcgccggctgcgtgttctactacgtgatcagcgagggcagccaccccttcggcaagagcctgcagagacaggccaacatcctgctgggcgcctgcagcctggactgcctgcaccccgagaagcacgaggacgtgatcgccagagagctgatcgagaagatgatcgccatggacccccagaagagacccagcgccaagcacgtgctgaagcaccccttcttctggagcctggagaagcagctgcagttcttccaggacgtgagcgacagaatcgagaaggagagcctggacggccccatcgtgaagcagctggagagaggcggcagagccgtggtgaagatggactggagagagaacatcaccgtgcccctgcagaccgacctgagaaagttcagaacctacaagggcggcagcgtgagagacctgctgagagccatgagaaacaagaagcaccactacagagagctgcccgccgaggtgagagagaccctgggcagcctgcccgacgacttcgtgtgctacttcaccagcagattcccccacctgctggcccacacctacagagccatggagctgtgcagccacgagagactgttccagccctactacttccacgagccccccgagccccagccccccgtgacccccgacgccctgtag

SEQ ID NO: 18049 - DNA, 873 bp, Artificial Sequence
  Description of Artificial Sequence: Synthetic coding sequence
atgcccttcgacttcagaagattcgacatctacagaaaggtgcccaaggacctgacccagcccacctacaccggcgccatcatcagcatctgctgctgcctgttcatcctgttcctgttcctgagcgagctgaccggcttcatcaccaccgaggtggtgaacgagctgtacgtggacgaccccgacaaggacagcggcggcaagatcgacgtgagcctgaacatcagcctgcccaacctgcactgcgagctggtgggcctggacatccaggacgagatgggcagacacgaggtgggccacatcgacaacagcatgaagatccccctgaacaacggcgccggctgcagattcgagggccagttcagcatcaacaaggtgcccggcaacttccacgtgagcacccacagcgccaccgcccagccccagaaccccgacatgacccacgtgatccacaagctgagcttcggcgacaccctgcaggtgcagaacatccacggcgccttcaacgccctgggcggcgccgacagactgaccagcaaccccctggccagccacgactacatcctgaagatcgtgcccaccgtgtacgaggacaagagcggcaagcagagatacagctaccagtacaccgtggccaacaaggagtacgtggcctacagccacaccggcagaatcatccccgccatctggttcagatacgacctgagccccatcaccgtgaagtacaccgagagaagacagcccctgtacagattcatcaccaccatctgcgccatcatcggcggcaccttcaccgtggccggcatcctggacagctgcatcttcaccgccagcgaggcctggaagaagatccagctgggcaagatgcactag

SEQ ID NO: 18050 - DNA, 108 bp, Artificial Sequence
  Description of Artificial Sequence: Synthetic coding sequence
tgatgcagcaccgccaacggcgagaaggacagcatcaccctgatcagcatgaagaacatcaacatgaacaacggcaagcagagcctgagcgccgagaaggtgctgtag

SEQ ID NO: 18051 - DNA, 219 bp, Artificial Sequence
  Description of Artificial Sequence: Synthetic coding sequence
atgggcaccgccggcgccatgcagctgtgctgggtgatcctgggcttcctgctgttcagaggccacaacagccagcccaccatgacccagaccagcagcagccagggcggcctgggcggcctgagcctgaccaccgagcccgtgagcagcaaccccggctacatccccagcagcgaggccaacagacccagccacctgagcagcaccggcaccccctag

SEQ ID NO: 18052 - DNA, 768 bp, Artificial Sequence
  Description of Artificial Sequence: Synthetic coding sequence
atggccagccccggcgccggcagagccccccccgagctgcccgagagaaactgcggctacagagaggtggagtactgggaccagagataccagggcgccgccgacagcgccccctacgactggttcggcgacttcagcagcttcagagccctgctggagcccgagctgagacccgaggacagaatcctggtgctgggctgcggcaacagcgccctgagctacgagctgttcctgggcggcttccccaacgtgaccagcgtggactacagcagcgtggtggtggccgccatgcaggccagacacgcccacgtgccccagctgagatgggagaccatggacgtgagaaagctggacttccccagcgccagcttcgacgtggtgctggagaagggcaccctggacgccctgctggccggcgagagagacccctggaccgtgagcagcgagggcgtgcacaccgtggaccaggtgctgagcgaggtgagcagagtgctggtgcccggcggcagattcatcagcatgaccagcgccgccccccacttcagaaccagacactacgcccaggcctactacggctggagcctgagacacgccacctacggcagcggcttccacttccacctgtacctgatgcacaagggcggcaagctgagcgtggcccagctggccctgggcgcccagatcctgagcccccccagaccccccaccagcccctgcttcctgcaggacagcgaccacgaggacttcctgagcgccatccagctgtag

SEQ ID NO: 18053 - DNA, 2211 bp, Artificial Sequence
  Description of Artificial Sequence: Synthetic coding sequence
atgaacgtggccctgcaggagctgggcgccggcagcaacgtgggcttccagaagggcaccagacagctgctgggcagcagaacccagctggagctggtgctggccggcgccagcctgctgctggccgccctgctgctgggctgcctggtggccctgggcgtgcagtaccacagagaccccagccacagcacctgcctgaccgaggcctgcatcagagtggccggcaagatcctggagagcctggacagaggcgtgagcccctgcgaggacttctaccagttcagctgcggcggctggatcagaagaaaccccctgcccgacggcagaagcagatggaacaccttcaacagcctgtgggaccagaaccaggccatcctgaagcacctgctggagaacaccaccttcaacagcagcagcgaggccgagcagaagacccagagattctacctgagctgcctgcaggtggagagaatcgaggagctgggcgcccagcccctgagagacctgatcgagaagatcggcggctggaacatcaccggcccctgggaccaggacaacttcatggaggtgctgaaggccgtggccggcacctacagagccacccccttcttcaccgtgtacatcagcgccgacagcaagagcagcaacagcaacgtgatccaggtggaccagagcggcctgttcctgcccagcagagactactacctgaacagaaccgccaacgagaaggtgctgaccgcctacctggactacatggaggagctgggcatgctgctgggcggcagacccaccagcaccagagagcagatgcagcaggtgctggagctggagatccagctggccaacatcaccgtgccccaggaccagagaagagacgaggagaagatctaccacaagatgagcatcagcgagctgcaggccctggcccccagcatggactggctggagttcctgagcttcctgctgagccccctggagctgagcgacagcgagcccgtggtggtgtacggcatggactacctgcagcaggtgagcgagctgatcaacagaaccgagcccagcatcctgaacaactacctgatctggaacctggtgcagaagaccaccagcagcctggacagaagattcgagagcgcccaggagaagctgctggagaccctgtacggcaccaagaagagctgcgtgcccagatggcagacctgcatcagcaacaccgacgacgccctgggcttcgccctgggcagcctgttcgtgaaggccaccttcgacagacagagcaaggagatcgccgagggcatgatcagcgagatcagaaccgccttcgaggaggccctgggccagctggtgtggatggacgagaagaccagacaggccgccaaggagaaggccgacgccatctacgacatgatcggcttccccgacttcatcctggagcccaaggagctggacgacgtgtacgacggctacgagatcagcgaggacagcttcttccagaacatgctgaacctgtacaacttcagcgccaaggtgatggccgaccagctgagaaagccccccagcagagaccagtggagcatgaccccccagaccgtgaacgcctactacctgcccaccaagaacgagatcgtgttccccgccggcatcctgcaggcccccttctacgccagaaaccaccccaaggccctgaacttcggcggcatcggcgtggtgatgggccacgagctgacccacgccttcgacgaccagggcagagagtacgacaaggagggcaacctgagaccctggtggcagaacgagagcctggccgccttcagaaaccacaccgcctgcatggaggagcagtacaaccagtaccaggtgaacggcgagagactgaacggcagacagaccctgggcgagaacatcgccgacaacggcggcctgaaggccgcctacaacgcctacaaggcctggctgagaaagcacggcgaggagcagcagctgcccgccgtgggcctgaccaaccaccagctgttcttcgtgggcttcgcccaggtgtggtgcagcgtgagaacccccgagagcagccacgagggcctggtgaccgacccccacagccccgccagattcagagtgctgggcaccctgagcaacagcagagacttcctgagacacttcggctgccccgtgggcagccccatgaaccccggccagctgtgcgaggtgtggtag

SEQ ID NO: 18054 - DNA, 2652 bp, Artificial Sequence
  Description of Artificial Sequence: Synthetic coding sequence
atggccagccccggcgccggcagagccccccccgagctgcccgagagaaactgcggctacagagaggtggagtactgggaccagagataccagggcgccgccgacagcgccccctacgactggttcggcgacttcagcagcttcagagccctgctggagcccgagctgagacccgaggacagaatcctggtgctgggctgcggcaacagcgccctgagctacgagctgttcctgggcggcttccccaacgtgaccagcgtggactacagcagcgtggtggtggccgccatgcaggccagacacgcccacgtgccccagctgagatgggagaccatggacgtgagaaagctggacttccccagcgccagcttcgacgtggtgctggagaagggcaccctggacgccctgctggccggcgagagagacccctggaccgtgagcagcgagggcgtgcacaccgtggaccaggtgctgagcgaggtgggcttccagaagggcaccagacagctgctgggcagcagaacccagctggagctggtgctggccggcgccagcctgctgctggccgccctgctgctgggctgcctggtggccctgggcgtgcagtaccacagagaccccagccacagcacctgcctgaccgaggcctgcatcagagtggccggcaagatcctggagagcctggacagaggcgtgagcccctgcgaggacttctaccagttcagctgcggcggctggatcagaagaaaccccctgcccgacggcagaagcagatggaacaccttcaacagcctgtgggaccagaaccaggccatcctgaagcacctgctggagaacaccaccttcaacagcagcagcgaggccgagcagaagacccagagattctacctgagctgcctgcaggtggagagaatcgaggagctgggcgcccagcccctgagagacctgatcgagaagatcggcggctggaacatcaccggcccctgggaccaggacaacttcatggaggtgctgaaggccgtggccggcacctacagagccacccccttcttcaccgtgtacatcagcgccgacagcaagagcagcaacagcaacgtgatccaggtggaccagagcggcctgttcctgcccagcagagactactacctgaacagaaccgccaacgagaaggtgctgaccgcctacctggactacatggaggagctgggcatgctgctgggcggcagacccaccagcaccagagagcagatgcagcaggtgctggagctggagatccagctggccaacatcaccgtgccccaggaccagagaagagacgaggagaagatctaccacaagatgagcatcagcgagctgcaggccctggcccccagcatggactggctggagttcctgagcttcctgctgagccccctggagctgagcgacagcgagcccgtggtggtgtacggcatggactacctgcagcaggtgagcgagctgatcaacagaaccgagcccagcatcctgaacaactacctgatctggaacctggtgcagaagaccaccagcagcctggacagaagattcgagagcgcccaggagaagctgctggagaccctgtacggcaccaagaagagctgcgtgcccagatggcagacctgcatcagcaacaccgacgacgccctgggcttcgccctgggcagcctgttcgtgaaggccaccttcgacagacagagcaaggagatcgccgagggcatgatcagcgagatcagaaccgccttcgaggaggccctgggccagctggtgtggatggacgagaagaccagacaggccgccaaggagaaggccgacgccatctacgacatgatcggcttccccgacttcatcctggagcccaaggagctggacgacgtgtacgacggctacgagatcagcgaggacagcttcttccagaacatgctgaacctgtacaacttcagcgccaaggtgatggccgaccagctgagaaagccccccagcagagaccagtggagcatgaccccccagaccgtgaacgcctactacctgcccaccaagaacgagatcgtgttccccgccggcatcctgcaggcccccttctacgccagaaaccaccccaaggccctgaacttcggcggcatcggcgtggtgatgggccacgagctgacccacgccttcgacgaccagggcagagagtacgacaaggagggcaacctgagaccctggtggcagaacgagagcctggccgccttcagaaaccacaccgcctgcatggaggagcagtacaaccagtaccaggtgaacggcgagagactgaacggcagacagaccctgggcgagaacatcgccgacaacggcggcctgaaggccgcctacaacgcctacaaggcctggctgagaaagcacggcgaggagcagcagctgcccgccgtgggcctgaccaaccaccagctgttcttcgtgggcttcgcccaggtgtggtgcagcgtgagaacccccgagagcagccacgagggcctggtgaccgacccccacagccccgccagattcagagtgctgggcaccctgagcaacagcagagacttcctgagacacttcggctgccccgtgggcagccccatgaaccccggccagctgtgcgaggtgtggtag

SEQ ID NO: 18055 - DNA, 2298 bp, Artificial Sequence
  Description of Artificial Sequence: Synthetic coding sequence
atgaacgtggccctgcaggagctgggcgccggcagcaacatggtggagtacaagagagccaccctgagagacgaggacgcccccgagacccccgtggagggcggcgccagccccgacgccatggaggtgggcttccagaagggcaccagacagctgctgggcagcagaacccagctggagctggtgctggccggcgccagcctgctgctggccgccctgctgctgggctgcctggtggccctgggcgtgcagtaccacagagaccccagccacagcacctgcctgaccgaggcctgcatcagagtggccggcaagatcctggagagcctggacagaggcgtgagcccctgcgaggacttctaccagttcagctgcggcggctggatcagaagaaaccccctgcccgacggcagaagcagatggaacaccttcaacagcctgtgggaccagaaccaggccatcctgaagcacctgctggagaacaccaccttcaacagcagcagcgaggccgagcagaagacccagagattctacctgagctgcctgcaggtggagagaatcgaggagctgggcgcccagcccctgagagacctgatcgagaagatcggcggctggaacatcaccggcccctgggaccaggacaacttcatggaggtgctgaaggccgtggccggcacctacagagccacccccttcttcaccgtgtacatcagcgccgacagcaagagcagcaacagcaacgtgatccaggtggaccagagcggcctgttcctgcccagcagagactactacctgaacagaaccgccaacgagaaggtgctgaccgcctacctggactacatggaggagctgggcatgctgctgggcggcagacccaccagcaccagagagcagatgcagcaggtgctggagctggagatccagctggccaacatcaccgtgccccaggaccagagaagagacgaggagaagatctaccacaagatgagcatcagcgagctgcaggccctggcccccagcatggactggctggagttcctgagcttcctgctgagccccctggagctgagcgacagcgagcccgtggtggtgtacggcatggactacctgcagcaggtgagcgagctgatcaacagaaccgagcccagcatcctgaacaactacctgatctggaacctggtgcagaagaccaccagcagcctggacagaagattcgagagcgcccaggagaagctgctggagaccctgtacggcaccaagaagagctgcgtgcccagatggcagacctgcatcagcaacaccgacgacgccctgggcttcgccctgggcagcctgttcgtgaaggccaccttcgacagacagagcaaggagatcgccgagggcatgatcagcgagatcagaaccgccttcgaggaggccctgggccagctggtgtggatggacgagaagaccagacaggccgccaaggagaaggccgacgccatctacgacatgatcggcttccccgacttcatcctggagcccaaggagctggacgacgtgtacgacggctacgagatcagcgaggacagcttcttccagaacatgctgaacctgtacaacttcagcgccaaggtgatggccgaccagctgagaaagccccccagcagagaccagtggagcatgaccccccagaccgtgaacgcctactacctgcccaccaagaacgagatcgtgttccccgccggcatcctgcaggcccccttctacgccagaaaccaccccaaggccctgaacttcggcggcatcggcgtggtgatgggccacgagctgacccacgccttcgacgaccagggcagagagtacgacaaggagggcaacctgagaccctggtggcagaacgagagcctggccgccttcagaaaccacaccgcctgcatggaggagcagtacaaccagtaccaggtgaacggcgagagactgaacggcagacagaccctgggcgagaacatcgccgacaacggcggcctgaaggccgcctacaacgcctacaaggcctggctgagaaagcacggcgaggagcagcagctgcccgccgtgggcctgaccaaccaccagctgttcttcgtgggcttcgcccaggtgtggtgcagcgtgagaacccccgagagcagccacgagggcctggtgaccgacccccacagccccgccagattcagagtgctgggcaccctgagcaacagcagagacttcctgagacacttcggctgccccgtgggcagccccatgaaccccggccagctgtgcgaggtgtggtag

SEQ ID NO: 18056 - DNA, 2436 bp, Artificial Sequence
  Description of Artificial Sequence: Synthetic coding sequence
atgaacgtggccctgcaggagctgggcgccggcagcaacatggtggagtacaagagagccaccctgagagacgaggacgcccccgagacccccgtggagggcggcgccagccccgacgccatggaggtgggcaagggcgccagccccttcagccccggccccagccccggcatgacccccggcacccccagaagcagcggcctgttctggagagtgacctgcccccacctgagaagcatcagcggcctgtgcagcagaaccatggtgggcttccagaagggcaccagacagctgctgggcagcagaacccagctggagctggtgctggccggcgccagcctgctgctggccgccctgctgctgggctgcctggtggccctgggcgtgcagtaccacagagaccccagccacagcacctgcctgaccgaggcctgcatcagagtggccggcaagatcctggagagcctggacagaggcgtgagcccctgcgaggacttctaccagttcagctgcggcggctggatcagaagaaaccccctgcccgacggcagaagcagatggaacaccttcaacagcctgtgggaccagaaccaggccatcctgaagcacctgctggagaacaccaccttcaacagcagcagcgaggccgagcagaagacccagagattctacctgagctgcctgcaggtggagagaatcgaggagctgggcgcccagcccctgagagacctgatcgagaagatcggcggctggaacatcaccggcccctgggaccaggacaacttcatggaggtgctgaaggccgtggccggcacctacagagccacccccttcttcaccgtgtacatcagcgccgacagcaagagcagcaacagcaacgtgatccaggtggaccagagcggcctgttcctgcccagcagagactactacctgaacagaaccgccaacgagaaggtgctgaccgcctacctggactacatggaggagctgggcatgctgctgggcggcagacccaccagcaccagagagcagatgcagcaggtgctggagctggagatccagctggccaacatcaccgtgccccaggaccagagaagagacgaggagaagatctaccacaagatgagcatcagcgagctgcaggccctggcccccagcatggactggctggagttcctgagcttcctgctgagccccctggagctgagcgacagcgagcccgtggtggtgtacggcatggactacctgcagcaggtgagcgagctgatcaacagaaccgagcccagcatcctgaacaactacctgatctggaacctggtgcagaagaccaccagcagcctggacagaagattcgagagcgcccaggagaagctgctggagaccctgtacggcaccaagaagagctgcgtgcccagatggcagacctgcatcagcaacaccgacgacgccctgggcttcgccctgggcagcctgttcgtgaaggccaccttcgacagacagagcaaggagatcgccgagggcatgatcagcgagatcagaaccgccttcgaggaggccctgggccagctggtgtggatggacgagaagaccagacaggccgccaaggagaaggccgacgccatctacgacatgatcggcttccccgacttcatcctggagcccaaggagctggacgacgtgtacgacggctacgagatcagcgaggacagcttcttccagaacatgctgaacctgtacaacttcagcgccaaggtgatggccgaccagctgagaaagccccccagcagagaccagtggagcatgaccccccagaccgtgaacgcctactacctgcccaccaagaacgagatcgtgttccccgccggcatcctgcaggcccccttctacgccagaaaccaccccaaggccctgaacttcggcggcatcggcgtggtgatgggccacgagctgacccacgccttcgacgaccagggcagagagtacgacaaggagggcaacctgagaccctggtggcagaacgagagcctggccgccttcagaaaccacaccgcctgcatggaggagcagtacaaccagtaccaggtgaacggcgagagactgaacggcagacagaccctgggcgagaacatcgccgacaacggcggcctgaaggccgcctacaacgcctacaaggcctggctgagaaagcacggcgaggagcagcagctgcccgccgtgggcctgaccaaccaccagctgttcttcgtgggcttcgcccaggtgtggtgcagcgtgagaacccccgagagcagccacgagggcctggtgaccgacccccacagccccgccagattcagagtgctgggcaccctgagcaacagcagagacttcctgagacacttcggctgccccgtgggcagccccatgaaccccggccagctgtgcgaggtgtggtag

SEQ ID NO: 18057 - DNA, 786 bp, Artificial Sequence
  Description of Artificial Sequence: Synthetic coding sequence
atgctgagagtgctgtgcctgctgagaccctggagacccctgagagccagaggctgcgccagcgacggcgccgccggcggcagcgagatccaggtgagagccctggccggccccgaccagggcatcaccgagatcctgatgaacagacccagcgccagaaacgccctgggcaacgtgttcgtgagcgagctgctggagaccctggcccagctgagagaggacagacaggtgagagtgctgctgttcagaagcggcgtgaagggcgtgttctgcgccggcgccgacctgaaggagagagagcagatgagcgaggccgaggtgggcgtgttcgtgcagagactgagaggcctgatgaacgacatcgccagcagcgccgtgatgggcctgatcgagaccaccagaggcctgctgcccggcgccggcggcacccagagactgcccagatgcctgggcgtggccctggccaaggagctgatcttcaccggcagaagactgagcggcaccgaggcccacgtgctgggcctggtgaaccacgccgtggcccagaacgaggagggcgacgccgcctaccagagagccagagccctggcccaggagatcctgccccaggcccccatcgccgtgagactgggcaaggtggccatcgacagaggcaccgaggtggacatcgccagcggcatggccatcgagggcatgtgctacgcccagaacatccccaccagagacagactggagggcatggccgccttcagagagaagagaacccccaagttcgtgggcaagtag

SEQ ID NO: 18058 - DNA, 879 bp, Artificial Sequence
  Description of Artificial Sequence: Synthetic coding sequence
atgctgagagtgctgtgcctgctgagaccctggagacccctgagagccagaggctgcgccagcgacggcgccgccggcggcagcgagatccaggtgagagccctggccggccccgaccagggcatcaccgagatcctgatgaacagacccagcgccagaaacgccctgggcaacgtgttcgtgagcgagctgctggagaccctggcccagctgagagaggacagacaggtgagagtgctgctgttcagaagcggcgtgaagggcgtgttctgcgccggcgccgacctgaaggagagagagcagatgagcgaggccgaggtgggcgtgttcgtgcagagactgagaggcctgatgaacgacatcgccgccttccccgcccccaccatcgccgccatggacggcttcgccctgggcggcggcctggagctggccctggcctgcgacctgagagtggccgccagcagcgccgtgatgggcctgatcgagaccaccagaggcctgctgcccggcgccggcggcacccagagactgcccagatgcctgggcgtggccctggccaaggagctgatcttcaccggcagaagactgagcggcaccgaggcccacgtgctgggcctggtgaaccacgccgtggcccagaacgaggagggcgacgccgcctaccagagagccagagccctggcccaggagatcctgccccaggcccccatcgccgtgagactgggcaaggtggccatcgacagaggcaccgaggtggacatcgccagcggcatggccatcgagggcatgtgctacgcccagaacatccccaccagagacagactggagggcatggccgccttcagagagaagagaacccccaagttcgtgggcaagtag

SEQ ID NO: 18059 - DNA, 741 bp, Artificial Sequence
  Description of Artificial Sequence: Synthetic coding sequence
atgaacagacccagcgccagaaacgccctgggcaacgtgttcgtgagcgagctgctggagaccctggcccagctgagagaggacagacaggtgagagtgctgctgttcagaagcggcgtgaagggcgtgttctgcgccggcgccgacctgaaggagagagagcagatgagcgaggccgaggtgggcgtgttcgtgcagagactgagaggcctgatgaacgacatcgccgccttccccgcccccaccatcgccgccatggacggcttcgccctgggcggcggcctggagctggccctggcctgcgacctgagagtggccgccagcagcgccgtgatgggcctgatcgagaccaccagaggcctgctgcccggcgccggcggcacccagagactgcccagatgcctgggcgtggccctggccaaggagctgatcttcaccggcagaagactgagcggcaccgaggcccacgtgctgggcctggtgaaccacgccgtggcccagaacgaggagggcgacgccgcctaccagagagccagagccctggcccaggagatcctgccccaggcccccatcgccgtgagactgggcaaggtggccatcgacagaggcaccgaggtggacatcgccagcggcatggccatcgagggcatgtgctacgcccagaacatccccaccagagacagactggagggcatggccgccttcagagagaagagaacccccaagttcgtgggcaagtag

SEQ ID NO: 18060 - DNA, 384 bp, Artificial Sequence
  Description of Artificial Sequence: Synthetic coding sequence
atgaacagacccagcgccagaaacgccctgggcaacgtgttcgtgagcgagctgctggagaccctggcccagctgagagaggacagacaggtgagagtgctgctgttcagaagcggcgtgaagggcgtgttctgcgccggcgccgacctgaaggagagagagcagatgagcgaggccgaggtgggcgtgttcgtgcagagactgagaggcctgatgaacgacatcgccgccttccccgcccccaccatcgccgccatggacggcttcgccctgggcggcggcctggagctggccctggcctgcgacctgagagtggccggcaccggccccggcctgggcgccggcggcggcgccagagagagcggcgtgagcgagaccggctag

SEQ ID NO: 18061 - DNA, 660 bp, Artificial Sequence
  Description of Artificial Sequence: Synthetic coding sequence
atgctgagagtgctgtgcctgctgagaccctggagacccctgagagccagaggctgcgccagcgacggcgccgccggcggcagcgagatccaggtgagagccctggccggccccgaccagggcatcaccgagatcctgatgaacagacccagcgccagaaacgccctgggcaacgtgttcgtgagcgagctgctggagaccctggcccagctgagagaggacagacaggtgagagtgctgctgttcagaagcggcgtgaagggcgtgttctgcgccggcgccgacctgaaggagagagagcagatgagcgaggccgaggtgggcgtgttcgtgcagagactgagaggcctgatgaacgacatcgccagcagcgccgtgatgggcctgatcgagaccaccagaggcctgctgcccggcgccggcggcacccagagactgcccagatgcctgggcgtggccctggccaaggagctgatcttcaccggcagaagactgagcggcaccgaggcccacgtgctgggcctggtgaaccacgccgtggcccagaacgaggagggcgacgccgcctaccagagagccagagccctggcccaggagatcctgccccaggtggacatcgccagcggcatggccatcgagggcatgtgctacgcccagtag

SEQ ID NO: 18062 - DNA, 912 bp, Artificial Sequence
  Description of Artificial Sequence: Synthetic coding sequence
atggccgccgtggccgtgctgagagccttcggcgccagcggccccatgtgcctgagaagaggcccctgggcccagctgcccgccagattctgcagcagagaccccgccggcgccggcagaagagagagcgagcccagacccaccagcgccagacagctggacggcatcagaaacatcgtgctgagcaaccccaagaagagaaacgccctgagcctggccatgctgaagagcctgcagagcgacatcctgcacgacgccgacagcaacgacctgaaggtgatcatcatcagcgccgagggccccgtgttcagcagcggccacgacctgaaggagctgaccgaggagcagggcagagactaccacgccgaggtgttccagacctgcagcaaggtgatgatgcacatcagaaaccaccccgtgcccgtgatcgccatggtgaacggcctggccgccgccgccggctgccagctggtggccagctgcgacatcgccgtggccagcgacaagagcagcttcgccacccccggcgtgaacgtgggcctgttctgcagcacccccggcgtggccctggccagagccgtgcccagaaaggtggccctggagatgctgttcaccggcgagcccatcagcgcccaggaggccctgctgcacggcctgctgagcaaggtggtgcccgaggccgagctgcaggaggagaccatgagaatcgccagaaagatcgccagcctgagcagacccgtggtgagcctgggcaaggccaccttctacaagcagctgccccaggacctgggcaccgcctactacctgaccagccaggccatggtggacaacctggccctgagagacggccaggagggcatcaccgccttcctgcagaagagaaagcccgtgtggagccacgagcccgtgtag

SEQ ID NO: 18063 - DNA, 726 bp, Artificial Sequence
  Description of Artificial Sequence: Synthetic coding sequence
atggccgccgtggccgtgctgagagccttcggcgccagcggccccatgtgcctgagaagaggcccctgggcccagctgcccgccagattctgcagcagagaccccgccggcgccggcagaagagagagcgagcccagacccaccagcgccagacagctggacggcatcagaagcgcccccggcagagccggcagcagcagatggtgcagagtgggcgtgagagccccccccctgaccagaggcggccccggcgagcccgagcccagactgagaccctggggcggcaacagcccctgccccggccccggccccggcagcgagaccagaagaaacatcgtgctgagcaaccccaagaagagaaacgccctgagcctggccatgctgaagagcctgcagagcgacatcctgcacgacgccgacagcaacgacctgaaggtgatcatcatcagcgccgagggccccgtgttcagcagcggccacgacctgaaggagctgaccgaggagcagggcagagactaccacgccgaggtgttccagacctgcagcaaggtgatgatgcacatcagaaaccaccccgtgcccgtgatcgccatggtgaacggcctggccgccgccgccggctgccagctggtggccagctgcgacatcgccgtggccagcgacaagagcagcttcgccacccccggcgtgaacgtgggcctgttctgcagcacccccggcgtgtag

SEQ ID NO: 18064 - DNA, 501 bp, Artificial Sequence
  Description of Artificial Sequence: Synthetic coding sequence
atgctgaagagcctgcagagcgacatcctgcacgacgccgacagcaacgacctgaaggtgatcatcatcagcgccgagggccccgtgttcagcagcggccacgacctgaaggagctgaccgaggagcagggcagagactaccacgccgaggtgttccagacctgcagcaaggtgatgatgcacatcagaaaccaccccgtgcccgtgatcgccatggtgaacggcctggccgccgccgccggctgccagctggtggccagctgcgacatcgccgtggccagcgacaagagcagcttcgccacccccggcgtgaacgtgggcctgttctgcagcacccccggcgtggccctggccagagccgtgcccagaaaggtggccctggagatgctgttcaccggcgagcccatcagcgcccaggaggccctgctgcacggcctgctgagcaaggtggtgcccgaggccgagctgcaggaggagaccatgagaatcgccagaaagtag

SEQ ID NO: 18065 - DNA, 909 bp, Artificial Sequence
  Description of Artificial Sequence: Synthetic coding sequence
atggccctggtggccagcgtgagagtgcccgccagagtgctgctgagagccggcgccagactgcccggcgccgccctgggcagaaccgagagagccgccggcggcggcgacggcgccagaagattcggcagccagagagtgctggtggagcccgacgccggcgccggcgtggccgtgatgaagttcaagaacccccccgtgaacagcctgagcctggagttcctgaccgagctggtgatcagcctggagaagctggagaacgacaagagcttcagaggcgtgatcctgaccagcgacagacccggcgtgttcagcgccggcctggacctgaccgagatgtgcggcagaagccccgcccactacgccggctactggaaggccgtgcaggagctgtggctgagactgtaccagagcaacctggtgctggtgagcgccatcaacggcgcctgccccgccggcggctgcctggtggccctgacctgcgactacagaatcctggccgacaaccccagatactgcatcggcctgaacgagacccagctgggcatcatcgcccccttctggctgaaggacaccctggagaacaccatcggccacagagccgccgagagagccctgcagctgggcctgctgttcccccccgccgaggccctgcaggtgggcatcgtggaccaggtggtgcccgaggagcaggtgcagagcaccgccctgagcgccatcgcccagtggatggccatccccgaccacgccagacagctgaccaaggccatgatgagaaaggccaccgccagcagactggtgacccagagagacgccgacgtgcagaacttcgtgagcttcatcagcaaggacagcatccagaagagcctgcagatgtacctggagagactgaaggaggagaagggctag

SEQ ID NO: 18066 - DNA, 858 bp, Artificial Sequence
  Description of Artificial Sequence: Synthetic coding sequence
atggccctggtggccagcgtgagagtgcccgccagagtgctgctgagagccggcgccagactgcccggcgccgccctgggcagaaccgagagagccgccggcggcggcgacggcgccagaagattcggcagccagagagtgctggtggagcccgacgccggcgccggcgtggccgtgatgaagttcaagaacccccccgtgaacagcctgagcctggagttcctgaccgagctggtgatcagcctggagaagctggagaacgacaagagcttcagaggcgtgatcctgaccagcgacagacccggcgtgttcagcgccggcctggacctgaccgagatgtgcggcagaagccccgcccactacgccggctactggaaggccgtgcaggagctgtggctgagactgtaccagagcaacctggtgctggtgagcgccatcaacggcgcctgccccgccggcggctgcctggtggccctgacctgcgactacagaatcctggccgacaaccccagactgaaggacaccctggagaacaccatcggccacagagccgccgagagagccctgcagctgggcctgctgttcccccccgccgaggccctgcaggtgggcatcgtggaccaggtggtgcccgaggagcaggtgcagagcaccgccctgagcgccatcgcccagtggatggccatccccgaccacgccagacagctgaccaaggccatgatgagaaaggccaccgccagcagactggtgacccagagagacgccgacgtgcagaacttcgtgagcttcatcagcaaggacagcatccagaagagcctgcagatgtacctggagagactgaaggaggagaagggctag

SEQ ID NO: 18067 - DNA, 1095 bp, Artificial Sequence
  Description of Artificial Sequence: Synthetic coding sequence
atgaacagaaccgccatgagagccagccagaaggacttcgagaacagcatgaaccaggtgaagctgctgaagaaggaccccggcaacgaggtgaagctgaagctgtacgccctgtacaagcaggccaccgagggcccctgcaacatgcccaagcccggcgtgttcgacctgatcaacaaggccaagtgggacgcctggaacgccctgggcagcctgcccaaggaggccgccagacagaactacgtggacctggtgagcagcctgagccccagcctggagagcagcagccaggtggagcccggcaccgacagaaagagcaccggcttcgagaccctggtggtgaccagcgaggacggcatcaccaagatcatgttcaacagacccaagaagaagaacgccatcaacaccgagatgtaccacgagatcatgagagccctgaaggccgccagcaaggacgacagcatcatcaccgtgctgaccggcaacggcgactactacagcagcggcaacgacctgaccaacttcaccgacatcccccccggcggcgtggaggagaaggccaagaacaacgccgtgctgctgagagagttcgtgggctgcttcatcgacttccccaagcccctgatcgccgtggtgaacggccccgccgtgggcatcagcgtgaccctgctgggcctgttcgacgccgtgtacgccagcgacagagccaccttccacacccccttcagccacctgggccagagccccgagggctgcagcagctacaccttccccaagatcatgagccccgccaaggccaccgagatgctgatcttcggcaagaagctgaccgccggcgaggcctgcgcccagggcctggtgaccgaggtgttccccgacagcaccttccagaaggaggtgtggaccagactgaaggccttcgccaagctgccccccaacgccctgagaatcagcaaggaggtgatcagaaagagagagagagagaagctgcacgccgtgaacgccgaggagtgcaacgtgctgcagggcagatggctgagcgacgagtgcaccaacgccgtggtgaacttcctgagcagaaagagcaagctgtag

SEQ ID NO: 18068 - DNA, 1185 bp, Artificial Sequence
  Description of Artificial Sequence: Synthetic coding sequence
atggccatggcctacctggcctggagactggccagaagaagctgccccagcagcctgcaggtgaccagcttccccgtggtgcagctgcacatgaacagaaccgccatgagagccagccagaaggacttcgagaacagcatgaaccaggtgaagctgctgaagaaggaccccggcaacgaggtgaagctgaagctgtacgccctgtacaagcaggccaccgagggcccctgcaacatgcccaagcccggcgtgttcgacctgatcaacaaggccaagtgggacgcctggaacgccctgggcagcctgcccaaggaggccgccagacagaactacgtggacctggtgagcagcctgagccccagcctggagagcagcagccaggtggagcccggcaccgacagaaagagcaccggcttcgagaccctggtggtgaccagcgaggacggcatcaccaagatcatgttcaacagacccaagaagaagaacgccatcaacaccgagatgtaccacgagatcatgagagccctgaaggccgccagcaaggacgacagcatcatcaccgtgctgaccggcaacggcgactactacagcagcggcaacgacctgaccaacttcaccgacatcccccccggcggcgtggaggagaaggccaagaacaacgccgtgctgctgagagagttcgtgggctgcttcatcgacttccccaagcccctgatcgccgtggtgaacggccccgccgtgggcatcagcgtgaccctgctgggcctgttcgacgccgtgtacgccagcgacagagccaccttccacacccccttcagccacctgggccagagccccgagggctgcagcagctacaccttccccaagatcatgagccccgccaaggccaccgagatgctgatcttcggcaagaagctgaccgccggcgaggcctgcgcccagggcctggtgaccgaggtgttccccgacagcaccttccagaaggaggtgtggaccagactgaaggccttcgccaagctgccccccaacgccctgagaatcagcaaggaggtgatcagaaagagagagagagagaagctgcacgccgtgaacgccgaggagtgcaacgtgctgcagggcagatggctgagcgacgagtgcaccaacgccgtggtgaacttcctgagcagaaagagcaagctgtag

SEQ ID NO: 18069 - DNA, 1095 bp, Artificial Sequence; identical to SEQ ID NO: 18067
  Description of Artificial Sequence: Synthetic coding sequence

SEQ ID NO: 18070 - DNA, 684 bp, Artificial Sequence
  Description of Artificial Sequence: Synthetic coding sequence
atgtaccacgagatcatgagagccctgaaggccgccagcaaggacgacagcatcatcaccgtgctgaccggcaacggcgactactacagcagcggcaacgacctgaccaacttcaccgacatcccccccggcggcgtggaggagaaggccaagaacaacgccgtgctgctgagagagttcgtgggctgcttcatcgacttccccaagcccctgatcgccgtggtgaacggccccgccgtgggcatcagcgtgaccctgctgggcctgttcgacgccgtgtacgccagcgacagagccaccttccacacccccttcagccacctgggccagagccccgagggctgcagcagctacaccttccccaagatcatgagccccgccaaggccaccgagatgctgatcttcggcaagaagctgaccgccggcgaggcctgcgcccagggcctggtgaccgaggtgttccccgacagcaccttccagaaggaggtgtggaccagactgaaggccttcgccaagctgccccccaacgccctgagaatcagcaaggaggtgatcagaaagagagagagagagaagctgcacgccgtgaacgccgaggagtgcaacgtgctgcagggcagatggctgagcgacgagtgcaccaacgccgtggtgaacttcctgagcagaaagagcaagctgtag

SEQ ID NO: 18071 - DNA, 1095 bp, Artificial Sequence; identical to SEQ ID NO: 18067
  Description of Artificial Sequence: Synthetic coding sequence

SEQ ID NO: 18072 - DNA, 2961 bp, Artificial Sequence
  Description of Artificial Sequence: Synthetic coding sequence
atggccggcatcttctacttcgccctgttcagctgcctgttcggcatctgcgacgccgtgaccggcagcagagtgtaccccgccaacgaggtgaccctgctggacagcagaagcgtgcagggcgagctgggctggatcgccagccccctggagggcggctgggaggaggtgagcatcatggacgagaagaacacccccatcagaacctaccaggtgtgcaacgtgatggagcccagccagaacaactggctgagaaccgactggatcaccagagagggcgcccagagagtgtacatcgagatcaagttcaccctgagagactgcaacagcctgcccggcgtgatgggcacctgcaaggagaccttcaacctgtactactacgagagcgacaacgacaaggagagattcatcagagagaaccagttcgtgaagatcgacaccatcgccgccgacgagagcttcacccaggtggacatcggcgacagaatcatgaagctgaacaccgagatcagagacgtgggccccctgagcaagaagggcttctacctggccttccaggacgtgggcgcctgcatcgccctggtgagcgtgagagtgttctacaagaagtgccccctgaccgtgagaaacctggcccagttccccgacaccatcaccggcgccgacaccagcagcctggtggaggtgagaggcagctgcgtgaacaacagcgaggagaaggacgtgcccaagatgtactgcggcgccgacggcgagtggctggtgcccatcggcaactgcctgtgcaacgccggccacgaggagagaagcggcgagtgccaggcctgcaagatcggctactacaaggccctgagcaccgacgccacctgcgccaagtgccccccccacagctacagcgtgtgggagggcgccaccagctgcacctgcgacagaggcttcttcagagccgacaacgacgccgccagcatgccctgcaccagaccccccagcgcccccctgaacctgatcagcaacgtgaacgagaccagcgtgaacctggagtggagcagcccccagaacaccggcggcagacaggacatcagctacaacgtggtgtgcaagaagtgcggcgccggcgaccccagcaagtgcagaccctgcggcagcggcgtgcactacaccccccagcagaacggcctgaagaccaccaaggtgagcatcaccgacctgctggcccacaccaactacaccttcgagatctgggccgtgaacggcgtgagcaagtacaaccccaaccccgaccagagcgtgagcgtgaccgtgaccaccaaccaggccgcccccagcagcatcgccctggtgcaggccaaggaggtgaccagatacagcgtggccctggcctggctggagcccgacagacccaacggcgtgatcctggagtacgaggtgaagtactacgagaaggaccagaacgagagaagctacagaatcgtgagaaccgccgccagaaacaccgacatcaagggcctgaaccccctgaccagctacgtgttccacgtgagagccagaaccgccgccggctacggcgacttcagcgagcccctggaggtgaccaccaacaccgtgcccagcagaatcatcggcgacggcgccaacagcaccgtgctgctggtgagcgtgagcggcagcgtggtgctggtggtgatcctgatcgccgccttcgtgatcagcagaagaagaagcaagtacagcaaggccaagcaggaggccgacgaggagaagcacctgaaccagggcgtgagaacctacgtggaccccttcacctacgaggaccccaaccaggccgtgagagagttcgccaaggagatcgacgccagctgcatcaagatcgagaaggtgatcggcgtgggcgagttcggcgaggtgtgcagcggcagactgaaggtgcccggcaagagagagatctgcgtggccatcaagaccctgaaggccggctacaccgacaagcagagaagagacttcctgagcgaggccagcatcatgggccagttcgaccaccccaacatcatccacctggagggcgtggtgaccaagtgcaagcccgtgatgatcatcaccgagtacatggagaacggcagcctggacgccttcctgagaaagaacgacggcagattcaccgtgatccagctggtgggcatgctgagaggcatcggcagcggcatgaagtacctgagcgacatgagctacgtgcacagagacctggccgccagaaacatcctggtgaacagcaacctggtgtgcaaggtgagcgacttcggcatgagcagagtgctggaggacgaccccgaggccgcctacaccaccagaggcggcaagatccccatcagatggaccgcccccgaggccatcgcctacagaaagttcaccagcgccagcgacgtgtggagctacggcatcgtgatgtgggaggtgatgagctacggcgagagaccctactgggacatgagcaaccaggacgtgatcaaggccatcgaggagggctacagactgcccccccccatggactgccccatcgccctgcaccagctgatgctggactgctggcagaaggagagaagcgacagacccaagttcggccagatcgtgaacatgctggacaagctgatcagaaaccccaacagcctgaagagaaccggcaccgagagcagcagacccaacaccgccctgctggaccccagcagccccgagttcagcgccgtggtgagcgtgggcgactggctgcaggccatcaagatggacagatacaaggacaacttcaccgccgccggctacaccaccctggaggccgtggtgcacgtgaaccaggaggacctggccagaatcggcatcaccgccatcacccaccagaacaagatcctgagcagcgtgcaggccatgagaacccagatgcagcagatgcacggcagaatggtgcccgtgtag

SEQ ID NO: 18073 - DNA, 2808 bp, Artificial Sequence
  Description of Artificial Sequence: Synthetic coding sequence
atgaagtgggaggaggtgagcatcatggacgagaagaacacccccatcagaacctaccaggtgtgcaacgtgatggagcccagccagaacaactggctgagaaccgactggatcaccagagagggcgcccagagagtgtacatcgagatcaagttcaccctgagagactgcaacagcctgcccggcgtgatgggcacctgcaaggagaccttcaacctgtactactacgagagcgacaacgacaaggagagattcatcagagagaaccagttcgtgaagatcgacaccatcgccgccgacgagagcttcacccaggtggacatcggcgacagaatcatgaagctgaacaccgagatcagagacgtgggccccctgagcaagaagggcttctacctggccttccaggacgtgggcgcctgcatcgccctggtgagcgtgagagtgttctacaagaagtgccccctgaccgtgagaaacctggcccagttccccgacaccatcaccggcgccgacaccagcagcctggtggaggtgagaggcagctgcgtgaacaacagcgaggagaaggacgtgcccaagatgtactgcggcgccgacggcgagtggctggtgcccatcggcaactgcctgtgcaacgccggccacgaggagagaagcggcgagtgccaggcctgcaagatcggctactacaaggccctgagcaccgacgccacctgcgccaagtgccccccccacagctacagcgtgtgggagggcgccaccagctgcacctgcgacagaggcttcttcagagccgacaacgacgccgccagcatgccctgcaccagaccccccagcgcccccctgaacctgatcagcaacgtgaacgagaccagcgtgaacctggagtggagcagcccccagaacaccggcggcagacaggacatcagctacaacgtggtgtgcaagaagtgcggcgccggcgaccccagcaagtgcagaccctgcggcagcggcgtgcactacaccccccagcagaacggcctgaagaccaccaaggtgagcatcaccgacctgctggcccacaccaactacaccttcgagatctgggccgtgaacggcgtgagcaagtacaaccccaaccccgaccagagcgtgagcgtgaccgtgaccaccaaccaggccgcccccagcagcatcgccctggtgcaggccaaggaggtgaccagatacagcgtggccctggcctggctggagcccgacagacccaacggcgtgatcctggagtacgaggtgaagtactacgagaaggaccagaacgagagaagctacagaatcgtgagaaccgccgccagaaacaccgacatcaagggcctgaaccccctgaccagctacgtgttccacgtgagagccagaaccgccgccggctacggcgacttcagcgagcccctggaggtgaccaccaacaccgtgcccagcagaatcatcggcgacggcgccaacagcaccgtgctgctggtgagcgtgagcggcagcgtggtgctggtggtgatcctgatcgccgccttcgtgatcagcagaagaagaagcaagtacagcaaggccaagcaggaggccgacgaggagaagcacctgaaccagggcgtgagaacctacgtggaccccttcacctacgaggaccccaaccaggccgtgagagagttcgccaaggagatcgacgccagctgcatcaagatcgagaaggtgatcggcgtgggcgagttcggcgaggtgtgcagcggcagactgaaggtgcccggcaagagagagatctgcgtggccatcaagaccctgaaggccggctacaccgacaagcagagaagagacttcctgagcgaggccagcatcatgggccagttcgaccaccccaacatcatccacctggagggcgtggtgaccaagtgcaagcccgtgatgatcatcaccgagtacatggagaacggcagcctggacgccttcctgagaaagaacgacggcagattcaccgtgatccagctggtgggcatgctgagaggcatcggcagcggcatgaagtacctgagcgacatgagctacgtgcacagagacctggccgccagaaacatcctggtgaacagcaacctggtgtgcaaggtgagcgacttcggcatgagcagagtgctggaggacgaccccgaggccgcctacaccaccagaggcggcaagatccccatcagatggaccgcccccgaggccatcgcctacagaaagttcaccagcgccagcgacgtgtggagctacggcatcgtgatgtgggaggtgatgagctacggcgagagaccctactgggacatgagcaaccaggacgtgatcaaggccatcgaggagggctacagactgcccccccccatggactgccccatcgccctgcaccagctgatgctggactgctggcagaaggagagaagcgacagacccaagttcggccagatcgtgaacatgctggacaagctgatcagaaaccccaacagcctgaagagaaccggcaccgagagcagcagacccaacaccgccctgctggaccccagcagccccgagttcagcgccgtggtgagcgtgggcgactggctgcaggccatcaagatggacagatacaaggacaacttcaccgccgccggctacaccaccctggaggccgtggtgcacgtgaaccaggaggacctggccagaatcggcatcaccgccatcacccaccagaacaagatcctgagcagcgtgcaggccatgagaacccagatgcagcagatgcacggcagaatggtgcccgtgtag

SEQ ID NO: 18074 - DNA, 2850 bp, Artificial Sequence
  Description of Artificial Sequence: Synthetic coding sequence
atggccggcatcttctacttcgccctgttcagctgcctgttcggcatctgcgacgccgtgaccggcagcagagtgtaccccgccaacgaggtgaccctgctggacagcagaagcgtgcagggcgagctgggctggatcgccagccccctggagggcggctgggaggaggtgagcatcatggacgagaagaacacccccatcagaacctaccaggtgtgcaacgtgatggagcccagccagaacaactggctgagaaccgactggatcaccagagagggcgcccagagagtgtacatcgagatcaagttcaccctgagagactgcaacagcctgcccggcgtgatgggcacctgcaaggagaccttcaacctgtactactacgagagcgacaacgacaaggagagattcatcagagagaaccagttcgtgaagatcgacaccatcgccgccgacgagagcttcacccaggtggacatcggcgacagaatcatgaagctgaacaccgagatcagagacgtgggccccctgagcaagaagggcttctacctggccttccaggacgtgggcgcctgcatcgccctggtgagcgtgagagtgttctacaagaagtgccccctgaccgtgagaaacctggcccagttccccgacaccatcaccggcgccgacaccagcagcctggtggaggtgagaggcagctgcgtgaacaacagcgaggagaaggacgtgcccaagatgtactgcggcgccgacggcgagtggctggtgcccatcggcaactgcctgtgcaacgccggccacgaggagagaagcggcgagtgccaggcctgcaagatcggctactacaaggccctgagcaccgacgccacctgcgccaagtgccccccccacagctacagcgtgtgggagggcgccaccagctgcacctgcgacagaggcttcttcagagccgacaacgacgccgccagcatgccctgcaccagaccccccagcgcccccctgaacctgatcagcaacgtgaacgagaccagcgtgaacctggagtggagcagcccccagaacaccggcggcagacaggacatcagctacaacgtggtgtgcaagaagtgcggcgccggcgaccccagcaagtgcagaccctgcggcagcggcgtgcactacaccccccagcagaacggcctgaagaccaccaaggtgagcatcaccgacctgctggcccacaccaactacaccttcgagatctgggccgtgaacggcgtgagcaagtacaaccccaaccccgaccagagcgtgagcgtgaccgtgaccaccaaccaggccgcccccagcagcatcgccctggtgcaggccaaggaggtgaccagatacagcgtggccctggcctggctggagcccgacagacccaacggcgtgatcctggagtacgaggtgaagtactacgagaaggaccagaacgagagaagctacagaatcgtgagaaccgccgccagaaacaccgacatcaagggcctgaaccccctgaccagctacgtgttccacgtgagagccagaaccgccgccggctacggcgacttcagcgagcccctggaggtgaccaccaacaccgtgcccagcagaatcatcggcgacggcgccaacagcaccgtgctgctggtgagcgtgagcggcagcgtggtgctggtggtgatcctgatcgccgccttcgtgatcagcagaagaagaagcaagtacagcaaggccaagcaggaggccgacgaggagaagcacctgaaccagggcgtgagaacctacgtggaccccttcacctacgaggaccccaaccaggccgtgagagagttcgccaaggagatcgacgccagctgcatcaagatcgagaaggtgatcggcgtgggcgagttcggcgaggtgtgcagcggcagactgaaggtgcccggcaagagagagatctgcgtggccatcaagaccctgaaggccggctacaccgacaagcagagaagagacttcctgagcgaggccagcatcatgggccagttcgaccaccccaacatcatccacctggagggcgtggtgaccaagtgcaagcccgtgatgatcatcaccgagtacatggagaacggcagcctggacgccttcctgagaaagaacgacggcagattcaccgtgatccagctggtgggcatgctgagaggcatcggcagcggcatgaagtacctgagcgacatgagctacgtgcacagagacctggccgccagaaacatcctggtgaacagcaacctggtgtgcaaggtgagcgacttcggcatgagcagagtgctggaggacgaccccgaggccgcctacaccaccagaggcggcaagatccccatcagatggaccgcccccgaggccatcgcctacagaaagttcaccagcgccagcgacgtgtggagctacggcatcgtgatgtgggaggtgatgagctacggcgagagaccctactgggacatgagcaaccaggacgtgatcaaggccatcgaggagggctacagactgcccccccccatggactgccccatcgccctgcaccagctgatgctggactgctggcagaaggagagaagcgacagacccaagttcggccagatcgtgaacatgctggacaagctgatcagaaaccccaacagcctgaagagaaccggcaccgagagcagcagacccaacaccgccctgctggaccccagcagccccgagttcagcgccgtggtgagcgtgggcgactggctgcaggccatcaagatggacagatacaaggacaacttcaccgccgccggctacaccaccctggaggccgtggtgcacgtgaaccaggagtag

SEQ ID NO: 18075 - DNA, 2961 bp, Artificial Sequence; identical to SEQ ID NO: 18072
  Description of Artificial Sequence: Synthetic coding sequence

SEQ ID NO: 18076 - DNA, 276 bp, Artificial Sequence
  Description of Artificial Sequence: Synthetic coding sequence
atggccggcatcttctacttcgccctgttcagctgcctgttcggcatctgcgacgccgtgaccggcagcagagtgtaccccgccaacgaggtgaccctgctggacagcagaagcgtgcagggcgagctgggctggatcgccagccccctggagggcggctgggaggaggtgagcatcatggacgagaagaacacccccatcagaacctaccaggtgtgcaacgtgatggagcccagccagaacaactggctgagaaccgactggatcaccagatag

SEQ ID NO: 18077 - DNA, 450 bp, Artificial Sequence
  Description of Artificial Sequence: Synthetic coding sequence
atggccggcatcttctacttcgccctgttcagctgcctgttcggcatctgcgacgccgtgaccggcagcagagtgtaccccgccaacgaggtgaccctgctggacagcagaagcgtgcagggcgagctgggctggatcgccagccccctggagggcggctgggaggaggtgagcatcatggacgagaagaacacccccatcagaacctaccaggtgtgcaacgtgatggagcccagccagaacaactggctgagaaccgactggatcaccagagagggcgcccagagagtgtacatcgagatcaagttcaccctgagagactgcaacagcctgcccggcgtgatgggcacctgcaaggagaccttcaacctgtactactacgagagcgacaacgacaaggagagattcatcagagagaaccagttcgtgaagatcgacaccatcgcctag

SEQ ID NO: 18078 - DNA, 840 bp, Artificial Sequence
  Description of Artificial Sequence: Synthetic coding sequence
atggtgttccagaccagataccccagctggatcatcctgtgctacatctggctgctgagattcgcccacaccggcgaggcccaggccgccaaggaggtgctgctgctggacagcaaggcccagcagaccgagctggagtggatcagcagcccccccaacggctgggaggagatcagcggcctggacgagaactacacccccatcagaacctaccaggtgtgccaggtgatggagcccaaccagaacaactggctgagaaccaactggatcagcaagggcaacgcccagagaatcttcgtggagctgaagttcaccctgagagactgcaacagcctgcccggcgtgctgggcacctgcaaggagaccttcaacctgtactactacgagaccgactacgacaccggcagaaacatcagagagaacctgtacgtgaagatcgacaccatcgccgccgacgagagcttcacccagggcgacctgggcgagagaaagatgaagctgaacaccgaggtgagagagatcggccccctgagcaagaagggcttctacctggccttccaggacgtgggcgcctgcatcgccctggtgagcgtgaaggtgtactacaagaagtgctggagcatcatcgagaacctggccatcttccccgacaccgtgaccggcagcgagttcagcagcctggtggaggtgagaggcacctgcgtgagcagcgccgaggaggaggccgagaacgcccccagaatgcactgcagcgccgagggcgagtggctggtgcccatcggcaagtgcatctgcaaggccggctaccagcagaagggcgacacctgcgagagaaagtag

SEQ ID NO: 18079 - DNA, 2997 bp, Artificial Sequence
  Description of Artificial Sequence: Synthetic coding sequence
atggtgttccagaccagataccccagctggatcatcctgtgctacatctggctgctgagattcgcccacaccggcgaggcccaggccgccaaggaggtgctgctgctggacagcaaggcccagcagaccgagctggagtggatcagcagcccccccaacggctgggaggagatcagcggcctggacgagaactacacccccatcagaacctaccaggtgtgccaggtgatggagcccaaccagaacaactggctgagaaccaactggatcagcaagggcaacgcccagagaatcttcgtggagctgaagttcaccctgagagactgcaacagcctgcccggcgtgctgggcacctgcaaggagaccttcaacctgtactactacgagaccgactacgacaccggcagaaacatcagagagaacctgtacgtgaagatcgacaccatcgccgccgacgagagcttcacccagggcgacctgggcgagagaaagatgaagctgaacaccgaggtgagagagatcggccccctgagcaagaagggcttctacctggccttccaggacgtgggcgcctgcatcgccctggtgagcgtgaaggtgtactacaagaagtgctggagcatcatcgagaacctggccatcttccccgacaccgtgaccggcagcgagttcagcagcctggtggaggtgagaggcacctgcgtgagcagcgccgaggaggaggccgagaacgcccccagaatgcactgcagcgccgagggcgagtggctggtgcccatcggcaagtgcatctgcaaggccggctaccagcagaagggcgacacctgcgagccctgcggcagaggcttctacaagagcagcagccaggacctgcagtgcagcagatgccccacccacagcttcagcgacaaggagggcagcagcagatgcgagtgcgaggacggctactacagagcccccagcgaccccccctacgtggcctgcaccagaccccccagcgccccccagaacctgatcttcaacatcaaccagaccaccgtgagcctggagtggagcccccccgccgacaacggcggcagaaacgacgtgacctacagaatcctgtgcaagagatgcagctgggagcagggcgagtgcgtgccctgcggcagcaacatcggctacatgccccagcagaccggcctggaggacaactacgtgaccgtgatggacctgctggcccacgccaactacaccttcgaggtggaggccgtgaacggcgtgagcgacctgagcagaagccagagactgttcgccgccgtgagcatcaccaccggccaggccgcccccagccaggtgagcggcgtgatgaaggagagagtgctgcagagaagcgtggagctgagctggcaggagcccgagcaccccaacggcgtgatcaccgagtacgagatcaagtactacgagaaggaccagagagagagaacctacagcaccgtgaagaccaagagcaccagcgccagcatcaacaacctgaagcccggcaccgtgtacgtgttccagatcagagccttcaccgccgccggctacggcaactacagccccagactggacgtggccaccctggaggaggccaccggcaagatgttcgaggccaccgccgtgagcagcgagcagaaccccgtgatcatcatcgccgtggtggccgtggccggcaccatcatcctggtgttcatggtgttcggcttcatcatcggcagaagacactgcggctacagcaaggccgaccaggagggcgacgaggagctgtacttccacttcaagttccccggcaccaagacctacatcgaccccgagacctacgaggaccccaacagagccgtgcaccagttcgccaaggagctggacgccagctgcatcaagatcgagagagtgatcggcgccggcgagttcggcgaggtgtgcagcggcagactgaagctgcccggcaagagagacgtggccgtggccatcaagaccctgaaggtgggctacaccgagaagcagagaagagacttcctgtgcgaggccagcatcatgggccagttcgaccaccccaacgtggtgcacctggagggcgtggtgaccagaggcaagcccgtgatgatcgtgatcgagttcatggagaacggcgccctggacgccttcctgagaaagcacgacggccagttcaccgtgatccagctggtgggcatgctgagaggcatcgccgccggcatgagatacctggccgacatgggctacgtgcacagagacctggccgccagaaacatcctggtgaacagcaacctggtgtgcaaggtgagcgacttcggcctgagcagagtgatcgaggacgaccccgaggccgtgtacaccaccaccggcggcaagatccccgtgagatggaccgcccccgaggccatccagtacagaaagttcaccagcgccagcgacgtgtggagctacggcatcgtgatgtgggaggtgatgagctacggcgagagaccctactgggacatgagcaaccaggacgtgatcaaggccatcgaggagggctacagactgcccgcccccatggactgccccgccggcctgcaccagctgatgctggactgctggcagaaggagagagccgagagacccaagttcgagcagatcgtgggcatcctggacaagatgatcagaaaccccaacagcctgaagacccccctgggcacctgcagcagacccatcagccccctgctggaccagaacacccccgacttcaccaccttctgcagcgtgggcgagtggctgcaggccatcaagatggagagatacaaggacaacttcaccgccgccggctacaacagcctggagagcgtggccagaatgaccatcgaggacgtgatgagcctgggcatcaccctggtgggccaccagaagaagatcatgagcagcatccagaccatgagagcccagatgctgcacctgcacggcaccggcatccaggtgtag

SEQ ID NO: 18080 - DNA, 687 bp, Artificial Sequence
  Description of Artificial Sequence: Synthetic coding sequence
atgctgcacgtggagatgctgaccctggtgttcctggtgctgtggatgtgcgtgttcagccaggaccccggcagcaaggccgtggccgacagatacgccgtgtactggaacagcagcaaccccagattccagagaggcgactaccacatcgacgtgtgcatcaacgactacctggacgtgttctgcccccactacgaggacagcgtgcccgaggacaagaccgagagatacgtgctgtacatggtgaacttcgacggctacagcgcctgcgaccacaccagcaagggcttcaagagatgggagtgcaacagaccccacagccccaacggccccctgaagttcagcgagaagttccagctgttcacccccttcagcctgggcttcgagttcagacccggcagagagtacttctacatcagcagcgccatccccgacaacggcagaagaagctgcctgaagctgaaggtgttcgtgagacccaccaacagctgcatgaagaccatcggcgtgcacgacagagtgttcgacgtgaacgacaaggtggagaacagcctggagcccgccgacgacaccgtgcacgagagcgccgagcccagcagaggcgagaacgccgcccagacccccagaatccccagcagactgctggccatcctgctgttcctgctggccatgctgctgaccctgtag

SEQ ID NO: 18081 - DNA, 2595 bp, Artificial Sequence
  Description of Artificial Sequence: Synthetic coding sequence
atggccgcccccctgatccccctgagccagcagatccccaccggcaacagcctgtacgagagctactacaagcaggtggaccccgcctacaccggcagagtgggcgccagcgaggccgccctgttcctgaagaagagcggcctgagcgacatcatcctgggcaagatctgggacctggccgaccccgagggcaagggcttcctggacaagcagggcttctacgtggccctgagactggtggcctgcgcccagagcggccacgaggtgaccctgagcaacctgaacctgagcatgcccccccccaagttccacgacaccagcagccccctgatggtgaccccccccagcgccgaggcccactgggccgtgagagtggaggagaaggccaagttcgacggcatcttcgagagcctgctgcccatcaacggcctgctgagcggcgacaaggtgaagcccgtgctgatgaacagcaagctgcccctggacgtgctgggcagagtgtgggacctgagcgacatcgacaaggacggccacctggacagagacgagttcgccgtggccatgcacctggtgtacagagccctggagaaggagcccgtgcccagcgccctgccccccagcctgatcccccccagcaagagaaagaagaccgtgttccccggcgccgtgcccgtgctgcccgccagccccccccccaaggacagcctgagaagcacccccagccacggcagcgtgagcagcctgaacagcaccggcagcctgagccccaagcacagcctgaagcagacccagcccaccgtgaactgggtggtgcccgtggccgacaagatgagattcgacgagatcttcctgaagaccgacctggacctggacggctacgtgagcggccaggaggtgaaggagatcttcatgcacagcggcctgacccagaacctgctggcccacatctgggccctggccgacaccagacagaccggcaagctgagcaaggaccagttcgccctggccatgtacttcatccagcagaaggtgagcaagggcatcgaccccccccaggtgctgagccccgacatggtgccccccagcgagagaggcacccccggccccgacagcagcggcagcctgggcagcggcgagttcaccggcgtgaaggagctggacgacatcagccaggagatcgcccagctgcagagagagaagtacagcctggagcaggacatcagagagaaggaggaggccatcagacagaagaccagcgaggtgcaggagctgcagaacgacctggacagagagaccagcagcctgcaggagctggaggcccagaagcaggacgcccaggacagactggacgagatggaccagcagaaggccaagctgagagacatgctgagcgacgtgagacagaagtgccaggacgagacccagatgatcagcagcctgaagacccagatccagagccaggagagcgacctgaagagccaggaggacgacctgaacagagccaagagcgagctgaacagactgcagcaggaggagacccagctggagcagagcatccaggccggcagagtgcagctggagaccatcatcaagagcctgaagagcacccaggacgagatcaaccaggccagaagcaagctgagccagctgcacgagagcagacaggaggcccacagaagcctggagcagtacgaccaggtgctggacggcgcccacggcgccagcctgaccgacctggccaacctgagcgagggcgtgagcctggccgagagaggcagcttcggcgccatggacgaccccttcaagaacaaggccctgctgttcagcaacaacacccaggagctgcaccccgaccccttccagaccgaggaccccttcaagagcgaccccttcaagggcgccgaccccttcaagggcgaccccttccagaacgaccccttcgccgagcagcagaccaccagcaccgaccccttcggcggcgaccccttcaaggagagcgaccccttcagaggcagcgccaccgacgacttcttcaagaagcagaccaagaacgaccccttcaccagcgaccccttcaccaagaaccccagcctgcccagcaagctggaccccttcgagagcagcgaccccttcagcagcagcagcgtgagcagcaagggcagcgaccccttcggcaccctggaccccttcggcagcggcagcttcaacagcgccgagggcttcgccgacttcagccagatgagcaagcccccccccagcggccccttcaccagcagcctgggcggcgccggcttcagcgacgaccccttcaagagcaagcaggacacccccgccctgccccccaagaagcccgccccccccagacccaagccccccagcggcaagagcacccccgtgagccagctgggcagcgccgacttccccgaggcccccgaccccttccagcccctgggcgccgacagcggcgaccccttccagagcaagaagggcttcggcgaccccttcagcggcaaggaccccttcgtgcccagcagcgccgccaagcccagcaaggccagcgccagcggcttcgccgacttcaccagcgtgagctag

SEQ ID NO: 18082 - DNA, 2733 bp, Artificial Sequence
  Description of Artificial Sequence: Synthetic coding sequence
atggccgcccccctgatccccctgagccagcagatccccaccggcaacagcctgtacgagagctactacaagcaggtggaccccgcctacaccggcagagtgggcgccagcgaggccgccctgttcctgaagaagagcggcctgagcgacatcatcctgggcaagatctgggacctggccgaccccgagggcaagggcttcctggacaagcagggcttctacgtggccctgagactggtggcctgcgcccagagcggccacgaggtgaccctgagcaacctgaacctgagcatgcccccccccaagttccacgacaccagcagccccctgatggtgaccccccccagcgccgaggcccactgggccgtgagagtggaggagaaggccaagttcgacggcatcttcgagagcctgctgcccatcaacggcctgctgagcggcgacaaggtgaagcccgtgctgatgaacagcaagctgcccctggacgtgctgggcagagtgtgggacctgagcgacatcgacaaggacggccacctggacagagacgagttcgccgtggccatgcacctggtgtacagagccctggagaaggagcccgtgcccagcgccctgccccccagcctgatcccccccagcaagagaaagaagaccgtgttccccggcgccgtgcccgtgctgcccgccagccccccccccaaggacagcctgagaagcacccccagccacggcagcgtgagcagcctgaacagcaccggcagcctgagccccaagcacagcctgaagcagacccagcccaccgtgaactgggtggtgcccgtggccgacaagatgagattcgacgagatcttcctgaagaccgacctggacctggacggctacgtgagcggccaggaggtgaaggagatcttcatgcacagcggcctgacccagaacctgctggcccacatctgggccctggccgacaccagacagaccggcaagctgagcaaggaccagttcgccctggccatgtacttcatccagcagaaggtgagcaagggcatcgaccccccccaggtgctgagccccgacatggtgccccccagcgagagaggcacccccggccccgacagcagcggcagcctgggcagcggcgagttcaccggcgtgaaggagctggacgacatcagccaggagatcgcccagctgcagagagagaagtacagcctggagcaggacatcagagagaaggaggaggccatcagacagaagaccagcgaggtgcaggagctgcagaacgacctggacagagagaccagcagcctgcaggagctggaggcccagaagcaggacgcccaggacagactggacgagatggaccagcagaaggccaagctgagagacatgctgagcgacgtgagacagaagtgccaggacgagacccagatgatcagcagcctgaagacccagatccagagccaggagagcgacctgaagagccaggaggacgacctgaacagagccaagagcgagctgaacagactgcagcaggaggagacccagctggagcagagcatccaggccggcagagtgcagctggagaccatcatcaagagcctgaagagcacccaggacgagatcaaccaggccagaagcaagctgagccagctgcacgagagcagacaggaggcccacagaagcctggagcagtacgaccaggtgctggacggcgcccacggcgccagcctgaccgacctggccaacctgagcgagggcgtgagcctggccgagagaggcagcttcggcgccatggacgaccccttcaagaacaaggccctgctgttcagcaacaacacccaggagctgcaccccgaccccttccagaccgaggaccccttcaagagcgaccccttcaagggcgccgaccccttcaagggcgaccccttccagaacgaccccttcgccgagcagcagaccaccagcaccgaccccttcggcggcgaccccttcaaggagagcgaccccttcagaggcagcgccaccgacgacttcttcaagaagcagaccaagaacgaccccttcaccagcgaccccttcaccaagaaccccagcctgcccagcaagctggaccccttcgagagcagcgaccccttcagcagcagcagcgtgagcagcaagggcagcgaccccttcggcaccctggaccccttcggcagcggcagcttcaacagcgccgagggcttcgccgacttcagccagatgagcaagcccccccccagcggccccttcaccagcagcctgggcggcgccggcttcagcgacgaccccttcaagagcaagcaggacacccccgccctgccccccaagaagcccgccccccccagacccaagccccccagcggcaagagcacccccgtgagccagctgggcagcgccgacttccccgaggcccccgaccccttccagcccctgggcgccgacagcggcgaccccttccagagcaagaagggcttcggcgaccccttcagcggcaaggaccccttcgtgcccagcagcgccgccaagcccagcaaggccagcgccagcggcttcgccgacttcaccagcttcggcaacgaggagcagcagctggcctgggccaagagagagagcgagaaggccgagcaggagagactggccagactgagaagacaggagcaggaggacctggagctggccatcgccctgagcaaggccgacatgcccgccgcctag

SEQ ID NO: 18083 - DNA, 2265 bp, Artificial Sequence
  Description of Artificial Sequence: Synthetic coding sequence
atggccgcccccctgatccccctgagccagcagatccccaccggcaacagcctgtacgagagctactacaagcaggtggaccccgcctacaccggcagagtgggcgccagcgaggccgccctgttcctgaagaagagcggcctgagcgacatcatcctgggcaagatctgggacctggccgaccccgagggcaagggcttcctggacaagcagggcttctacgtggccctgagactggtggcctgcgcccagagcggccacgaggtgaccctgagcaacctgaacctgagcatgcccccccccaagttccacgacaccagcagccccctgatggtgaccccccccagcgccgaggcccactgggccgtgagagtggaggagaaggccaagttcgacggcatcttcgagagcctgctgcccatcaacggcctgctgagcggcgacaaggtgaagcccgtgctgatgaacagcaagctgcccctggacgtgctgggcagagtgtgggacctgagcgacatcgacaaggacggccacctggacagagacgagttcgccgtggccatgcacctggtgtacagagccctggagaaggagcccgtgcccagcgccctgccccccagcctgatcccccccagcaagagaaagaagaccgtgttccccggcgccgtgcccgtgctgcccgccagccccccccccaaggacagcctgagaagcacccccagccacggcagcgtgagcagcctgaacagcaccggcagcctgagccccaagcacagcctgaagcagacccagcccaccgtgaactgggtggtgcccgtggccgacaagatgagattcgacgagatcttcctgaagaccgacctggacctggacggctacgtgagcggccaggaggtgaaggagatcttcatgcacagcggcctgacccagaacctgctggcccacatctgggccctggccgacaccagacagaccggcaagctgagcaaggaccagttcgccctggccatgtacttcatccagcagaaggtgagcaagggcatcgaccccccccaggtgctgagccccgacatggtgccccccagcgagagaggcacccccggccccgacagcagcggcagcctgggcagcggcgagttcaccggcgtgaaggagctggacgacatcagccaggagatcgcccagctgcagagagagaagtacagcctggagcaggacatcagagagaaggaggaggccatcagacagaagaccagcgaggtgcaggagctgcagaacgacctggacagagagaccagcagcctgcaggagctggaggcccagaagcaggacgcccaggacagactggacgagatggaccagcagaaggccaagctgagagacatgctgagcgacgtgagacagaagtgccaggacgagacccagatgatcagcagcctgaagacccagatccagagccaggagagcgacctgaagagccaggaggacgacctgaacagagccaagagcgagctgaacagactgcagcaggaggagacccagctggagcagagcatccaggccggcagagtgcagctggagaccatcatcaagagcctgaagagcacccaggacgagatcaaccaggccagaagcaagctgagccagctgcacgagagcagacaggaggcccacagaagcctggagcagtacgaccaggtgctggacggcgcccacggcgccagcctgaccgacctggccaacctgagcgagggcgtgagcctggccgagagaggcagcttcggcgccatggacgaccccttcaagaacaaggccctgctgttcagcaacaacacccaggagctgcaccccgaccccttccagaccgaggaccccttcaagagcgaccccttcaagggcgccgaccccttcaagggcgaccccttccagaacgaccccttcgccgagcagcagaccaccagcaccgaccccttcggcggcgaccccttcaaggagagcgaccccttcagaggcagcgccaccgacgacttcttcaagaagcagaccaagaacgaccccttcaccagcgaccccttcaccaagaaccccagcctgcccagcaagctggaccccttcgagagcagcgaccccttcagcagcagcagcgtgagcagcaagggcagcgaccccttcggcaccctggaccccttcggcagcggcagcttcaacagcgccgagggcttcgccgacttcagccagatgagcaaggtgaaggtgcacctgtag

SEQ ID NO: 18084 - DNA, 1806 bp, Artificial Sequence
  Description of Artificial Sequence: Synthetic coding sequence
atggccgcccccctgatccccctgagccagcagatccccaccggcaacagcctgtacgagagctactacaagcaggtggaccccgcctacaccggcagagtgggcgccagcgaggccgccctgttcctgaagaagagcggcctgagcgacatcatcctgggcaagatctgggacctggccgaccccgagggcaagggcttcctggacaagcagggcttctacgtggccctgagactggtggcctgcgcccagagcggccacgaggtgaccctgagcaacctgaacctgagcatgcccccccccaagttccacgacaccagcagccccctgatggtgaccccccccagcgccgaggcccactgggccgtgagagtggaggagaaggccaagttcgacggcatcttcgagagcctgctgcccatcaacggcctgctgagcggcgacaaggtgaagcccgtgctgatgaacagcaagctgcccctggacgtgctgggcagagtgtgggacctgagcgacatcgacaaggacggccacctggacagagacgagttcgccgtggccatgcacctggtgtacagagccctggagaaggagcccgtgcccagcgccctgccccccagcctgatcccccccagcaagagaaagaagaccgtgttccccggcgccgtgcccgtgctgcccgccagccccccccccaaggacagcctgagaagcacccccagccacggcagcgtgagcagcctgaacagcaccggcagcctgagccccaagcacagcctgaagcagacccagcccaccgtgaactgggtggtgcccgtggccgacaagatgagattcgacgagatcttcctgaagaccgacctggacctggacggctacgtgagcggccaggaggtgaaggagatcttcatgcacagcggcctgacccagaacctgctggcccacatctgggccctggccgacaccagacagaccggcaagctgagcaaggaccagttcgccctggccatgtacttcatccagcagaaggtgagcaagggcatcgaccccccccaggtgctgagccccgacatggtgccccccagcgagagaggcacccccggccccgacagcagcggcagcctgggcagcggcgagttcaccggcgtgaaggagctggacgacatcagccaggagatcgcccagctgcagagagagaagtacagcctggagcaggacatcagagagaaggaggaggccatcagacagaagaccagcgaggtgcaggagctgcagaacgacctggacagagagaccagcagcctgcaggagctggaggcccagaagcaggacgcccaggacagactggacgagatggaccagcagaaggccaagctgagagacatgctgagcgacgtgagacagaagtgccaggacgagacccagatgatcagcagcctgaagacccagatccagagccaggagagcgacctgaagagccaggaggacgacctgaacagagccaagagcgagctgaacagactgcagcaggaggagacccagctggagcagagcatccaggccggcagagtgcagctggagaccatcatcaagagcctgaagagcacccaggacgagatcaaccaggccagaagcaagctgagccagctgcacgagagcagacaggaggcccacagaagcctggagcagtacgaccaggtgctggacggcgcccacggcgccagcctgaccgacctggccaacctgagcgagggcgtgagcctggccgagagaggcagcttcggcgccatggtgaaggtggagtag

SEQ ID NO: 18085 - DNA, 1824 bp, Artificial Sequence
  Description of Artificial Sequence: Synthetic coding sequence
atgtggatgacccccaagagaagcaagatggaggtggacgaggccctggtgttcagacccgagtggacccagagatacctggtggtggagccccccgagggcgacggcgccctgtgcctggtgtgcagaagactgatcgtggccaccagagagagagacgtgagaagacactacgaggccgagcacgagtactacgagagatacgtggccgacggcgagagagccgccctggtggagagactgagacagggcgacctgcccgtggccagcttcacccccgaggagagagccgccagagccggcctgggcctgtgcagactgctggccctgaagggcagaggctggggcgagggcgacttcgtgtaccagtgcatggaggtgctgctgagagaggtgctgcccgagcacgtgagcgtgctgcagggcgtggacctgagccccgacatcaccagacagagaatcctgagcatcgacagaaacctgagaaaccagctgttcaacagagccagagacttcaaggcctacagcctggccctggacgaccaggccttcgtggcctacgagaactacctgctggtgttcatcagaggcgtgggccccgagctggaggtgcaggaggacctgctgaccatcatcaacctgacccaccacttcagcgtgggcgccctgatgagcgccatcctggagagcctgcagaccgccggcctgagcctgcagagaatggtgggcctgaccaccacccacaccctgagaatgatcggcgagaacagcggcctggtgagctacatgagagagaaggccgtgagccccaactgctggaacgtgatccactacagcggcttcctgcacctggagctgctgagcagctacgacgtggacgtgaaccagatcatcaacaccatcagcgagtggatcgtgctgatcaagaccagaggcgtgagaagacccgagttccagaccctgctgaccgagagcgagagcgagcacggcgagagagtgaacggcagatgcctgaacaactggctgagaagaggcaagaccctgaagctgatcttcagcctgagaaaggagatggaggccttcctggtgagcgtgggcgccaccaccgtgcacttcagcgacaagcagtggctgtgcgacttcggcttcctggtggacatcatggagcacctgagagagctgagcgaggagctgagagtgagcaaggtgttcgccgccgccgccttcgaccacatctgcaccttcgaggtgaagctgaacctgttccagagacacatcgaggagaagaacctgaccgacttccccgccctgagagaggtggtggacgagctgaagcagcagaacaaggaggacgagaagatcttcgaccccgacagataccagatggtgatctgcagactgcagaaggagttcgagagacacttcaaggacctgagattcatcaagaaggacctggagctgttcagcaaccccttcaacttcaagcccgagtacgcccccatcagcgtgagagtggagctgaccaagctgcaggccaacaccaacctgtggaacgagtacagaatcaaggacctgggccagttctacgccggcctgagcgccgagagctaccccatcatcaagggcgtggcctgcaaggtggccagcctgttcgacagcaaccagatctgcgagaaggccttcagctacctgaccagaaaccagcacaccctgagccagcccctgaccgacgagcacctgcaggccctgttcagagtggccaccaccgagatggagcccggctgggacgacctggtgagagagagaaacgagagcaacccctag

SEQ ID NO: 18086 - DNA, 1089 bp, Artificial Sequence
  Description of Artificial Sequence: Synthetic coding sequence
atggccagactgagagactgcctgcccagactgatgctgaccctgagaagcctgctgttctggagcctggtgtactgctactgcggcctgtgcgccagcatccacctgctgaagctgctgtggagcctgggcaagggccccgcccagaccttcagaagacccgccagagagcacccccccgcctgcctgagcgaccccagcctgggcacccactgctacgtgagaatcaaggacagcggcctgagattccactacgtggccgccggcgagagaggcaagcccctgatgctgctgctgcacggcttccccgagttctggtacagctggagataccagctgagagagttcaagagcgagtacagagtggtggccctggacctgagaggctacggcgagaccgacgcccccatccacagacagaactacaagctggactgcctgatcaccgacatcaaggacatcctggacagcctgggctacagcaagtgcgtgctgatcggccacgactggggcggcatgatcgcctggctgatcgccatctgctaccccgagatggtgatgaagctgatcgtgatcaacttcccccaccccaacgtgttcaccgagtacatcctgagacaccccgcccagctgctgaagagcagctactactacttcttccagatcccctggttccccgagttcatgttcagcatcaacgacttcaaggtgctgaagcacctgttcaccagccacagcaccggcatcggcagaaagggctgccagctgaccaccgaggacctggaggcctacatctacgtgttcagccagcccggcgccctgagcggccccatcaaccactacagaaacatcttcagctgcctgcccctgaagcaccacatggtgaccacccccaccctgctgctgtggggcgagaacgacgccttcatggaggtggagatggccgaggtgaccaagatctacgtgaagaactacttcagactgaccatcctgagcgaggccagccactggctgcagcaggaccagcccgacatcgtgaacaagctgatctggaccttcctgaaggaggagaccagaaagaaggactag

SEQ ID NO: 18087 - DNA, 1974 bp, Artificial Sequence
  Description of Artificial Sequence: Synthetic coding sequence
atgcagtggagagccctggtgctgggcctggtgctgctgagactgggcctgcacggcgtgctgtggctggtgttcggcctgggccccagcatgggcttctaccagagattccccctgagcttcggcttccagagactgagaagccccgacggccccgccagccccaccagcggccccgtgggcagacccggcggcgtgagcggccccagctggctgcagccccccggcaccggcgccgcccagagccccagaaaggcccccagaagacccggccccggcatgtgcggccccgccaactggggctacgtgctgggcggcagaggcagaggccccgacgagtacgagaagagatacagcggcgccttccccccccagctgagagcccagatgagagacctggccagaggcatgttcgtgttcggctacgacaactacatggcccacgccttcccccaggacgagctgaaccccatccactgcagaggcagaggccccgacagaggcgaccccagcaacctgaacatcaacgacgtgctgggcaactacagcctgaccctggtggacgccctggacaccctggccatcatgggcaacagcagcgagttccagaaggccgtgaagctggtgatcaacaccgtgagcttcgacaaggacagcaccgtgcaggtgttcgaggccaccatcagagtgctgggcagcctgctgagcgcccacagaatcatcaccgacagcaagcagcccttcggcgacatgaccatcaaggactacgacaacgagctgctgtacatggcccacgacctggccgtgagactgctgcccgccttcgagaacaccaagaccggcatcccctaccccagagtgaacctgaagaccggcgtgccccccgacaccaacaacgagacctgcaccgccggcgccggcagcctgctggtggagttcggcatcctgagcagactgctgggcgacagcaccttcgagtgggtggccagaagagccgtgaaggccctgtggaacctgagaagcaacgacaccggcctgctgggcaacgtggtgaacatccagaccggccactgggtgggcaagcagagcggcctgggcgccggcctggacagcttctacgagtacctgctgaagagctacatcctgttcggcgagaaggaggacctggagatgttcaacgccgcctaccagagcatccagaactacctgagaagaggcagagaggcctgcaacgagggcgagggcgacccccccctgtacgtgaacgtgaacatgttcagcggccagctgatgaacacctggatcgacagcctgcaggccttcttccccggcctgcaggtgctgatcggcgacgtggaggacgccatctgcctgcacgccttctactacgccatctggaagagatacggcgccctgcccgagagatacaactggcagctgcaggcccccgacgtgctgttctaccccctgagacccgagctggtggagagcacctacctgctgtaccaggccaccaagaaccccttctacctgcacgtgggcatggacatcctgcagagcctggagaagtacaccaaggtgaagtgcggctacgccaccctgcaccacgtgatcgacaagagcaccgaggacagaatggagagcttcttcctgagcgagacctgcaagtacctgtacctgctgttcgacgaggacaaccccgtgcacaagagcggcaccagatacatgttcaccaccgagggccacatcgtgagcgtggacgagcacctgagagagctgccctggaaggagttcttcagcgaggagggcggccaggaccagggcggcaagagcgtgcacagacccaagccccacgagctgaaggtgatcaacagcagcagcaactgcaacagagtgcccgacgagagaagatacagcctgcccctgaagagcatctacatgagacagatcgaccagatggtgggcctgatctag

SEQ ID NO: 18088 - DNA, 639 bp, Artificial Sequence
  Description of Artificial Sequence: Synthetic coding sequence
atgcactggatccacctgcaggtgctgggcagcctgctgagcgcccacagaatcatcaccgacagcaagcagcccttcggcgacatgaccatcaaggactacgacaacgagctgctgtacatggcccacgacctggccgtgagactgctgcccgccttcgagaacaccaagaccggcatcccctaccccagagtgaacctgaagaccggcgtgccccccgacaccaacaacgagacctgcaccgccggcgccggcagcctgctggtggagttcggcatcctgagcagactgctgggcgacagcaccttcgagtgggtggccagaagagccgtgaaggccctgtggaacctgagaagcaacgacaccggcctgctgggcaacgtggtgaacatccagaccggccactgggtgggcaagcagagcggcctgggcgccggcctggacagcttctacgagtacctgctgaagagctacatcctgttcggcgagaaggaggacctggagatgttcaacgccgcctaccagagcatccagaactacctgagaagaggcagagaggcctgcaacgagggcgagggcgacccccccctgtgccagagagagcacgtgcagtgggccgccgacgagcacctggactag

SEQ ID NO: 18089 - DNA, 1131 bp, Artificial Sequence
  Description of Artificial Sequence: Synthetic coding sequence
atgggcaacagcagcgagttccagaaggccgtgaagctggtgatcaacaccgtgagcttcgacaaggacagcaccgtgcaggtgttcgaggccaccatcagagtgctgggcagcctgctgagcgcccacagaatcatcaccgacagcaagcagcccttcggcgacatgaccatcaaggactacgacaacgagctgctgtacatggcccacgacctggccgtgagactgctgcccgccttcgagaacaccaagaccggcatcccctaccccagagtgaacctgaagaccggcgtgccccccgacaccaacaacgagacctgcaccgccggcgccggcagcctgctggtggagttcggcatcctgagcagactgctgggcgacagcaccttcgagtgggtggccagaagagccgtgaaggccctgtggaacctgagaagcaacgacaccggcctgctgggcaacgtggtgaacatccagaccggccactgggtgggcaagcagagcggcctgggcgccggcctggacagcttctacgagtacctgctgaagagctacatcctgttcggcgagaaggaggacctggagatgttcaacgccgcctaccagagcatccagaactacctgagaagaggcagagaggcctgcaacgagggcgagggcgacccccccctgtacgtgaacgtgaacatgttcagcggccagctgatgaacacctggatcgacagcctgcaggccttcttccccggcctgcaggtgctgatcggcgacgtggaggacgccatctgcctgcacgccttctactacgccatctggaagagatacggcgccctgcccgagagatacaactggcagctgcaggcccccgacgtgctgttctaccccctgagacccgagctggtggagagcacctacctgctgtaccaggccaccaagaaccccttctacctgcacgtgggcatggacatcctgcagagcctggagaagtacaccaaggtgaagtgcggctacgccaccctgcaccacgtgatcgacaagagcaccgaggacagaatggagagcttcttcctgagcgagacctgcaagtacctgtacctggtgtgcgtgctgcaggacgagcccagaaacatctag

SEQ ID NO: 18090 - DNA, 2799 bp, Artificial Sequence
  Description of Artificial Sequence: Synthetic coding sequence
atgagcgaggccggcggcagaggctgcggcagccccgtgccccagagagccagatggagactggtggccgccaccgccgccttctgcctggtgagcgccaccagcgtgtggaccgccggcgccgagcccatgagcagagaggagaagcagaagctgggcaaccaggtgctggagatgttcgaccacgcctacggcaactacatggagcacgcctaccccgccgacgagctgatgcccctgacctgcagaggcagagtgagaggccaggagcccagcagaggcgacgtggacgacgccctgggcaagttcagcctgaccctgatcgacagcctggacaccctggtggtgctgaacaagaccaaggagttcgaggacgccgtgagaaaggtgctgagagacgtgaacctggacaacgacgtggtggtgagcgtgttcgagaccaacatcagagtgctgggcggcctgctgggcggccacagcctggccatcatgctgaaggagaagggcgagtacatgcagtggtacaacgacgagctgctgcagatggccaagcagctgggctacaagctgctgcccgccttcaacaccaccagcggcctgccctaccccagaatcaacctgaagttcggcatcagaaagcccgaggccagaaccggcaccgagaccgacacctgcaccgcctgcgccggcaccctgatcctggagttcgccgccctgagcagattcaccggcgccaccatcttcgaggagtacgccagaaaggccctggacttcctgtgggagaagagacagagaagcagcaacctggtgggcgtgaccatcaacatccacaccggcgactgggtgagaaaggacagcggcgtgggcgccggcatcgacagctactacgagtacctgctgaaggcctacgtgctgctgggcgacgacagcttcctggagagattcaacacccactacgacgccatcatgagatacatcagccagccccccctgctgctggacgtgcacatccacaagcccatgctgaacgccagaacctggatggacgccctgctggccttcttccccggcctgcaggtgctgaagggcgacatcagacccgccatcgagacccacgagatgctgtaccaggtgatcaagaagcacaacttcctgcccgaggccttcaccaccgacttcagagtgcactgggcccagcaccccctgagacccgagttcgccgagagcacctacttcctgtacaaggccaccggcgacccctactacctggaggtgggcaagaccctgatcgagaacctgaacaagtacgccagagtgccctgcggcttcgccgccatgaaggacgtgagaaccggcagccacgaggacagaatggacagcttcttcctggccgagatgttcaagtacctgtacctgctgttcgccgacaaggaggacatcatcttcgacatcgaggactacatcttcaccaccgaggcccacctgctgcccctgtggctgagcaccaccaaccagagcatcagcaagaagaacaccaccagcgagtacaccgagctggacgacagcaacttcgactggacctgccccaacacccagatcctgttccccaacgaccccctgtacgcccagagcatcagagagcccctgaagaacgtggtggacaagagctgccccagaggcatcatcagagtggaggagagcttcagaagcggcgccaagccccccctgagagccagagacttcatggccaccaaccccgagcacctggagatcctgaagaagatgggcgtgagcctgatccacctgaaggacggcagagtgcagctggtgcagcacgccatccaggccgccagcagcatcgacgccgaggacggcctgagattcatgcaggagatgatcgagctgagcagccagcagcagaaggagcagcagctgccccccagagccgtgcagatcgtgagccaccccttcttcggcagagtggtgctgaccgccggccccgcccagttcggcctggacctgagcaagcacaaggagaccagaggcttcgtggccagcagcaagcccagcaacggctgcagcgagctgaccaaccccgaggccgtgatgggcaagatcgccctgatccagagaggccagtgcatgttcgccgagaaggccagaaacatccagaacgccggcgccatcggcggcatcgtgatcgacgacaacgagggcagcagcagcgacaccgcccccctgttccagatggccggcgacggcaaggacaccgacgacatcaagatccccatgctgttcctgttcagcaaggagggcagcatcatcctggacgccatcagagagtacgaggaggtggaggtgctgctgagcgacaaggccaaggacagagaccccgagatggagaacgaggagcagcccagcagcgagaacgacagccagaaccagagcggcgagcagatcagcagcagcagccaggaggtggacctggtggaccaggagagcagcgaggagaacagcctgaacagccaccccgagagcctgagcctggccgacatggacaacgccgccagcatcagccccagcgagcagaccagcaaccccaccgagaaccacgagaccaccaacctgaacggcgagtgcaccgacctggacaaccagctgcaggagcagagcgagaccgaggaggacagcaaccccaacgtgagctggggcaagaaggtgcagcccatcgacagcatcctggccgactggaacgaggacatcgaggccttcgagatgatggagaaggacgagctgtag

SEQ ID NO: 18091 - DNA, 2718 bp, Artificial Sequence
  Description of Artificial Sequence: Synthetic coding sequence
atgagcagagaggagaagcagaagctgggcaaccaggtgctggagatgttcgaccacgcctacggcaactacatggagcacgcctaccccgccgacgagctgatgcccctgacctgcagaggcagagtgagaggccaggagcccagcagaggcgacgtggacgacgccctgggcaagttcagcctgaccctgatcgacagcctggacaccctggtggtgctgaacaagaccaaggagttcgaggacgccgtgagaaaggtgctgagagacgtgaacctggacaacgacgtggtggtgagcgtgttcgagaccaacatcagagtgctgggcggcctgctgggcggccacagcctggccatcatgctgaaggagaagggcgagtacatgcagtggtacaacgacgagctgctgcagatggccaagcagctgggctacaagctgctgcccgccttcaacaccaccagcggcctgccctaccccagaatcaacctgaagttcggcatcagaaagcccgaggccagaaccggcaccgagaccgacacctgcaccgcctgcgccggcaccctgatcctggagttcgccgccctgagcagattcaccggcgccaccatcttcgaggagtacgccagaaaggccctggacttcctgtgggagaagagacagagaagcagcaacctggtgggcgtgaccatcaacatccacaccggcgactgggtgagaaaggacagcggcgtgggcgccggcatcgacagctactacgagtacctgctgaaggcctacgtgctgctgggcgacgacagcttcctggagagattcaacacccactacgacgccatcatgagatacatcagccagccccccctgctgctggacgtgcacatccacaagcccatgctgaacgccagaacctggatggacgccctgctggccttcttccccggcctgcaggtgctgaagggcgacatcagacccgccatcgagacccacgagatgctgtaccaggtgatcaagaagcacaacttcctgcccgaggccttcaccaccgacttcagagtgcactgggcccagcaccccctgagacccgagttcgccgagagcacctacttcctgtacaaggccaccggcgacccctactacctggaggtgggcaagaccctgatcgagaacctgaacaagtacgccagagtgccctgcggcttcgccgccatgaaggacgtgagaaccggcagccacgaggacagaatggacagcttcttcctggccgagatgttcaagtacctgtacctgctgttcgccgacaaggaggacatcatcttcgacatcgaggactacatcttcaccaccgaggcccacctgctgcccctgtggctgagcaccaccaaccagagcatcagcaagaagaacaccaccagcgagtacaccgagctggacgacagcaacttcgactggacctgccccaacacccagatcctgttccccaacgaccccctgtacgcccagagcatcagagagcccctgaagaacgtggtggacaagagctgccccagaggcatcatcagagtggaggagagcttcagaagcggcgccaagccccccctgagagccagagacttcatggccaccaaccccgagcacctggagatcctgaagaagatgggcgtgagcctgatccacctgaaggacggcagagtgcagctggtgcagcacgccatccaggccgccagcagcatcgacgccgaggacggcctgagattcatgcaggagatgatcgagctgagcagccagcagcagaaggagcagcagctgccccccagagccgtgcagatcgtgagccaccccttcttcggcagagtggtgctgaccgccggccccgcccagttcggcctggacctgagcaagcacaaggagaccagaggcttcgtggccagcagcaagcccagcaacggctgcagcgagctgaccaaccccgaggccgtgatgggcaagatcgccctgatccagagaggccagtgcatgttcgccgagaaggccagaaacatccagaacgccggcgccatcggcggcatcgtgatcgacgacaacgagggcagcagcagcgacaccgcccccctgttccagatggccggcgacggcaaggacaccgacgacatcaagatccccatgctgttcctgttcagcaaggagggcagcatcatcctggacgccatcagagagtacgaggaggtggaggtgctgctgagcgacaaggccaaggacagagccgccatcctgaagggcaagatgatccccagctacatcatcaacagcaaccccgagatggagaacgaggagcagcccagcagcgagaacgacagccagaaccagagcggcgagcagatcagcagcagcagccaggaggtggacctggtggaccaggagagcagcgaggagaacagcctgaacagccaccccgagagcctgagcctggccgacatggacaacgccgccagcatcagccccagcgagcagaccagcaaccccaccgagaaccacgagaccaccaacctgaacggcgagtgcaccgacctggacaaccagctgcaggagcagagcgagaccgaggaggacagcaaccccaacgtgagctggggcaagaaggtgcagcccatcgacagcatcctggccgactggaacgaggacatcgaggccttcgagatgatggagaaggacgagctgtag

SEQ ID NO: 18092 - DNA, 1314 bp, Artificial Sequence
  Description of Artificial Sequence: Synthetic coding sequence
atggccgcccccagctggagaggcgccagactggtgcagagcgtgctgagagtgtggcaggtgggcccccacgtggccagagagagagtgatccccttcagcagcctgctgggcttccagagaagatgcgtgagctgcgtggccggcagcgccttcagcggccccagactggccagcgccagcagaagcaacggccagggcagcgccctggaccacttcctgggcttcagccagcccgacagcagcgtgaccccctgcgtgcccgccgtgagcatgaacagagacgagcaggacgtgctgctggtgcaccaccccgacatgcccgagaacagcagagtgctgagagtggtgctgctgggcgcccccaacgccggcaagagcaccctgagcaaccagctgctgggcagaaaggtgttccccgtgagcagaaaggtgcacaccaccagatgccaggccctgggcgtgatcaccgagaaggagacccaggtgatcctgctggacacccccggcatcatcagccccggcaagcagaagagacaccacctggagctgagcctgctggaggacccctggaagagcatggagagcgccgacctggtggtggtgctggtggacgtgagcgacaagtggaccagaaaccagctgagcccccagctgctgagatgcctgaccaagtacagccagatccccagcgtgctggtgatgaacaaggtggactgcctgaagcagaagagcgtgctgctggagctgaccgccgccctgaccgagggcgtggtgaacggcaagaagctgaagatgagacaggccttccacagccaccccggcacccactgccccagccccgccgtgaaggaccccaacacccagagcgtgggcaacccccagagaatcggctggccccacttcaaggagatcttcatgctgagcgccctgagccaggaggacgtgaagaccctgaagcagtacctgctgacccaggcccagcccggcccctgggagtaccacagcgccgtgctgaccagccagacccccgaggagatctgcgccaacatcatcagagagaagctgctggagcacctgccccaggaggtgccctacaacgtgcagcagaagaccgccgtgtgggaggagggccccggcggcgagctggtgatccagcagaagctgctggtgcccaaggagagctacgtgaagctgctgatcggccccaagggccacgtgatcagccagatcgcccaggaggccggccacgacctgatggacatcttcctgtgcgacgtggacatcagactgagcgtgaagctgctgaagtag

SEQ ID NO: 18093 - DNA, 732 bp, Artificial Sequence
  Description of Artificial Sequence: Synthetic coding sequence
atgagcagaatgagcagctggagcatcaccctgatctgcctgagaatccccggcagctacgagtggagcagctgggagcccagaatgcagggcagccagcacagccccaccagctactgggccgagagatgcagcctgttccccggcagatgcatcctgctggccgccaagctgtggggcagcagccagagaagaagacccagatggtgggtgcccaccaagggcgtgctggagaccggccagagagtgaagctgagaggcagccccctgcccagcgccctgaagaagatgatggtgaccttcatctacatcctgctggacacccccggcatcatcagccccggcaagcagaagagacaccacctggagctgagcctgctggaggacccctggaagagcatggagagcgccgacctggtggtggtgctggtggacgtgagcgacaagtggaccagaaaccagctgagcccccagctgctgagatgcctgaccaagtacagccagatccccagcgtgctggtgatgaacaaggtggactgcctgaagcagaagagcgtgctgctggagctgaccgccgccctgaccgagggcgtggtgaacggcaagaagctgaagatgagacaggccttccacagccaccccggcacccactgccccagccccgccgtgaaggaccccaacacccagagcgtgggcaacccccagagaatcggctggccccacttcaagtag

SEQ ID NO: 18094 - DNA, 1167 bp, Artificial Sequence
  Description of Artificial Sequence: Synthetic coding sequence
atggaggccctgggcaagctgaagcagttcgacgcctaccccaagaccctggaggacttcagagtgaagacctgcggcggcgccaccgtgaccatcgtgagcggcctgctgatgctgctgctgttcctgagcgagctgcagtactacctgaccaccgaggtgcaccccgagctgtacgtggacaagagcagaggcgacaagctgaagatcaacatcgacgtgctgttcccccacatgccctgcgcctacctgagcatcgacgccatggacgtggccggcgagcagcagctggacgtggagcacaacctgttcaagcagagactggacaaggacggcatccccgtgagcagcgaggccgagagacacgagctgggcaaggtggaggtgaccgtgttcgaccccgacagcctggaccccgacagatgcgagagctgctacggcgccgaggccgaggacatcaagtgctgcaacacctgcgaggacgtgagagaggcctacagaagaagaggctgggccttcaagaaccccgacaccatcgagcagtgcagaagagagggcttcagccagaagatgcaggagcagaagaacgagggctgccaggtgtacggcttcctggaggtgaacaaggtggccggcaacttccacttcgcccccggcaagagcttccagcagagccacgtgcacgtgcagggcgaggaggtgcacgacctgcagagcttcggcctggacaacatcaacatgacccactacatccagcacctgagcttcggcgaggactaccccggcatcgtgaaccccctggaccacaccaacgtgaccgccccccaggccagcatgatgttccagtacttcgtgaaggtggtgcccaccgtgtacatgaaggtggacggcgaggtgctgagaaccaaccagttcagcgtgaccagacacgagaaggtggccaacggcctgctgggcgaccagggcctgcccggcgtgttcgtgctgtacgagctgagccccatgatggtgaagctgaccgagaagcacagaagcttcacccacttcctgaccggcgtgtgcgccatcatcggcggcatgttcaccgtggccggcctgatcgacagcctgatctaccacagcgccagagccatccagaagaagatcgacctgggcaagaccacctag

SEQ ID NO: 18095 - DNA, 1152 bp, Artificial Sequence
  Description of Artificial Sequence: Synthetic coding sequence
atggaggccctgggcaagctgaagcagttcgacgcctaccccaagaccctggaggacttcagagtgaagacctgcggcggcgccaccgtgaccatcgtgagcggcctgctgatgctgctgctgttcctgagcgagctgcagtactacctgaccaccgaggtgcaccccgagctgtacgtggacaagagcagaggcgacaagctgaagatcaacatcgacgtgctgttcccccacatgccctgcgcctacctgagcatcgacgccatggacgtggccggcgagcagcagctggacgtggagcacaacctgttcaagcagagactggacaaggacggcatccccgtgagcagcgaggccgagagacacgagctgggcaaggtggaggtgaccgtgttcgaccccgacagcctggaccccgacagatgcgagagctgctacggcgccgaggccgaggacatcaagtgctgcaacacctgcgaggacgtgagagaggcctacagaagaagaggctgggccttcaagaaccccgacaccatcgagcagtgcagaagagagggcttcagccagaagatgcaggagcagaagaacgagggctgccaggtgtacggcttcctggaggtgaacaaggtggccggcaacttccacttcgcccccggcaagagcttccagcagagccacgtgcacgtgcacgacctgcagagcttcggcctggacaacatcaacatgacccactacatccagcacctgagcttcggcgaggactaccccggcatcgtgaaccccctggaccacaccaacgtgaccgccccccaggccagcatgatgttccagtacttcgtgaaggtggtgcccaccgtgtacatgaaggtggacggcgaggtgctgagaaccaaccagttcagcgtgaccagacacgagaaggtggccaacggcctgctgggcgaccagggcctgcccggcgtgttcgtgctgtacgagctgagccccatgatggtgaagctgaccgagaagcacagaagcttcacccacttcctgaccggcgtgtgcgccatcatcggcggcatgttcaccgtggccggcctgatcgacagcctgatctaccacagcgccagagccatccagaagaagatcgacctgggcaagaccacctag

SEQ ID NO: 18096 - DNA, 597 bp, Artificial Sequence
  Description of Artificial Sequence: Synthetic coding sequence
ctgagcgtggccttcagctgctgctacggcgccgaggccgaggacatcaagtgctgcaacacctgcgaggacgtgagagaggcctacagaagaagaggctgggccttcaagaaccccgacaccatcgagcagtgcagaagagagggcttcagccagaagatgcaggagcagaagaacgagggctgccaggtgtacggcttcctggaggtgaacaaggtggccggcaacttccacttcgcccccggcaagagcttccagcagagccacgtgcacgtgcacgacctgcagagcttcggcctggacaacatcaacatgacccactacatccagcacctgagcttcggcgaggactaccccggcatcgtgaaccccctggaccacaccaacgtgaccgccccccaggccagcatgatgttccagtacttcgtgaaggtggtgcccaccgtgtacatgaaggtggacggcgaggtgctgagaaccaaccagttcagcgtgaccagacacgagaaggtggccaacggcctgctgggcgaccagggcctgcccggcgtgttcgcccacctgcccctgagcaccagccaccccgaggagaactag

SEQ ID NO: 18097 - DNA, 1167 bp, Artificial Sequence
  Description of Artificial Sequence: Synthetic coding sequence
atggaggccctgggcaagctgaagcagttcgacgcctaccccaagaccctggaggacttcagagtgaagacctgcggcggcgccaccgtgaccatcgtgagcggcctgctgatgctgctgctgttcctgagcgagctgcagtactacctgaccaccgaggtgcaccccgagctgtacgtggacaagagcagaggcgacaagctgaagatcaacatcgacgtgctgttcccccacatgccctgcgcctacctgagcatcgacgccatggacgtggccggcgagcagcagctggacgtggagcacaacctgttcaagcagagactggacaaggacggcatccccgtgagcagcgaggccgagagacacgagctgggcaaggtggaggtgaccgtgttcgaccccgacagcctggaccccgacagatgcgagagctgctacggcgccgaggccgaggacatcaagtgctgcaacacctgcgaggacgtgagagaggcctacagaagaagaggctgggccttcaagaaccccgacaccatcgagcagtgcagaagagagggcttcagccagaagatgcaggagcagaagaacgagggctgccaggtgtacggcttcctggaggtgaacaaggtggccggcaacttccacttcgcccccggcaagagcttccagcagagccacgtgcacgtgcacgccgtggagatccacgacctgcagagcttcggcctggacaacatcaacatgacccactacatccagcacctgagcttcggcgaggactaccccggcatcgtgaaccccctggaccacaccaacgtgaccgccccccaggccagcatgatgttccagtacttcgtgaaggtggtgcccaccgtgtacatgaaggtggacggcgaggtgctgagaaccaaccagttcagcgtgaccagacacgagaaggtggccaacggcctgctgggcgaccagggcctgcccggcgtgttcgtgctgtacgagctgagccccatgatggtgaagctgaccgagaagcacagaagcttcacccacttcctgaccggcgtgtgcgccatcatcggcggcatgttcaccgtggccggcctgatcgacagcctgatctaccacagcgccagagccatccagaagaagatcgacctgggcaagaccacctag

SEQ ID NO: 18098 - DNA, 1197 bp, Artificial Sequence
  Description of Artificial Sequence: Synthetic coding sequence
atggaggccctgggcaagctgaagcagttcgacgcctaccccaagaccctggaggacttcagagtgaagacctgcggcggcgccaccgtgaccatcgtgagcggcctgctgatgctgctgctgttcctgagcgagctgcagtactacctgaccaccgaggtgcaccccgagctgtacgtggacaagagcagaggcgacaagctgaagatcaacatcgacgtgctgttcccccacatgccctgcgcctacctgagcatcgacgccatggacgtggccggcgagcagcagctggacgtggagcacaacctgttcaagcagagactggacaaggacggcatccccgtgagcagcgaggccgagagacacgagctgggcaaggtggaggtgaccgtgttcgaccccgacagcctggaccccgacagatgcgagagctgctacggcgccgaggccgaggacatcaagtgctgcaacacctgcgaggacgtgagagaggcctacagaagaagaggctgggccttcaagaaccccgacaccatcgagcagtgcagaagagagggcttcagccagaagatgcaggagcagaagaacgagggctgccaggtgtacggcttcctggaggtgaacaaggtggccggcaacttccacttcgcccccggcaagagcttccagcagagccacgtgcacggctgcgtgtgcagactgaagatgatcgccagaagcctggcctgcgtgcacgacctgcagagcttcggcctggacaacatcaacatgacccactacatccagcacctgagcttcggcgaggactaccccggcatcgtgaaccccctggaccacaccaacgtgaccgccccccaggccagcatgatgttccagtacttcgtgaaggtggtgcccaccgtgtacatgaaggtggacggcgaggtgctgagaaccaaccagttcagcgtgaccagacacgagaaggtggccaacggcctgctgggcgaccagggcctgcccggcgtgttcgtgctgtacgagctgagccccatgatggtgaagctgaccgagaagcacagaagcttcacccacttcctgaccggcgtgtgcgccatcatcggcggcatgttcaccgtggccggcctgatcgacagcctgatctaccacagcgccagagccatccagaagaagatcgacctgggcaagaccacctag

SEQ ID NO: 18099 - DNA, 1407 bp, Artificial Sequence
  Description of Artificial Sequence: Synthetic coding sequence
atgggcagaggctggggcttcctgttcggcctgctgggcgccgtgtggctgctgagcagcggccacggcgaggagcagccccccgagaccgccgcccagagatgcttctgccaggtgagcggctacctggacgactgcacctgcgacgtggagaccatcgacagattcaacaactacagactgttccccagactgcagaagctgctggagagcgactacttcagatactacaaggtgaacctgaagagaccctgccccttctggaacgacatcagccagtgcggcagaagagactgcgccgtgaagccctgccagagcgacgaggtgcccgacggcatcaagagcgccagctacaagtacagcgaggaggccaacaacctgatcgaggagtgcgagcaggccgagagactgggcgccgtggacgagagcctgagcgaggagacccagaaggccgtgctgcagtggaccaagcacgacgacagcagcgacaacttctgcgaggccgacgacatccagagccccgaggccgagtacgtggacctgctgctgaaccccgagagatacaccggctacaagggccccgacgcctggaagatctggaacgtgatctacgaggagaactgcttcaagccccagaccatcaagagacccctgaaccccctggccagcggccagggcaccagcgaggagaacaccttctacagctggctggagggcctgtgcgtggagaagagagccttctacagactgatcagcggcctgcacgccagcatcaacgtgcacctgagcgccagatacctgctgcaggagacctggctggagaagaagtggggccacaacatcaccgagttccagcagagattcgacggcatcctgaccgagggcgagggccccagaagactgaagaacctgtacttcctgtacctgatcgagctgagagccctgagcaaggtgctgcccttcttcgagagacccgacttccagctgttcaccggcaacaagatccaggacgaggagaacaagatgctgctgctggagatcctgcacgagatcaagagcttccccctgcacttcgacgagaacagcttcttcgccggcgacaagaaggaggcccacaagctgaaggaggacttcagactgcacttcagaaacatcagcagaatcatggactgcgtgggctgcttcaagtgcagactgtggggcaagctgcagacccagggcctgggcaccgccctgaagatcctgttcagcgagaagctgatcgccaacatgcccgagagcggccccagctacgagttccacctgaccagacaggagatcgtgagcctgttcaacgccttcggcagaatcagcaccagcgtgaaggagctggagaacttcagaaacctgctgcagaacatccactag

SEQ ID NO: 18100 - DNA, 522 bp, Artificial Sequence
  Description of Artificial Sequence: Synthetic coding sequence
tggggccccaacatcaaggagttcaagcacagattcgaccccgtggagaccaagggcgagggccccagaagactgaagaacctgtacttcctgtacctgatcgagctgagagccctgagcaaggtggccccctacttcgagagaagcatcgtggacctgtacaccggcaacgccgaggaggacgccgacaccaagaccctgctgctgaacatcttccaggacaccaagagcttccccatgcacttcgacgagaagagcatgttcgccggcgacaagaagggcgccaagagcctgaaggaggagttcagactgcacttcaagaacatcagcagaatcatggactgcgtgggctgcgacaagtgcagactgtggggcaagctgcagacccagggcctgggcaccgccctgaagatcctgttcagcgagaaggagatccagaagctgcccgagaacagccccagcaagggcttccagctgaccagacaggagatcgtggccctgctgaacgccttcggcagatag

SEQ ID NO: 18101 - DNA, 435 bp, Artificial Sequence
  Description of Artificial Sequence: Synthetic coding sequence
atgagccagggcgtgagaagagccggcgccggccagggcgtggccgccgccgtgcagctgctggtgaccctgagcttcctgagaagcgtggtggaggcccaggtgaccggcgtgctggacgactgcctgtgcgacatcgacagcatcgacaacttcaacacctacaagatcttccccaagatcaagaagctgcaggagagagactacttcagatactacaaggtgaacctgaagagaccctgccccttctgggccgaggacggccactgcagcatcaaggactgccacgtggagccctgccccgagagcaagatccccgtgggcatcaaggccggccacagcaacaagtacctgaagatggccaacaacaccaaggagctggaggactgcgagcaggccaacaagctgggcgccatcaacagcaccctgagatag

SEQ ID NO: 18102 - DNA, 1404 bp, Artificial Sequence
  Description of Artificial Sequence: Synthetic coding sequence
atgagccagggcgtgagaagagccggcgccggccagggcgtggccgccgccgtgcagctgctggtgaccctgagcttcctgagaagcgtggtggaggcccaggtgaccggcgtgctggacgactgcctgtgcgacatcgacagcatcgacaacttcaacacctacaagatcttccccaagatcaagaagctgcaggagagagactacttcagatactacaaggtgaacctgaagagaccctgccccttctgggccgaggacggccactgcagcatcaaggactgccacgtggagccctgccccgagagcaagatccccgtgggcatcaaggccggccacagcaacaagtacctgaagatggccaacaacaccaaggagctggaggactgcgagcaggccaacaagctgggcgccatcaacagcaccctgagcaaccagagcaaggaggccttcatcgactgggccagatacgacgacagcagagaccacttctgcgagctggacgacgagagaagccccgccgcccagtacgtggacctgctgctgaaccccgagagatacaccggctacaagggcaccagcgcctggagagtgtggaacagcatctacgaggagaactgcttcaagcccagaagcgtgtacagacccctgaaccccctggcccccagcagaggcgaggacgacggcgagagcttctacacctggctggagggcctgtgcctggagaagagagtgttctacaagctgatcagcggcctgcacgccagcatcaacctgcacctgtgcgccaactacctgctggaggagacctggggcaagcccagctggggccccaacatcaaggagttcaagcacagattcgaccccgtggagaccaagggcgagggccccagaagactgaagaacctgtacttcctgtacctgatcgagctgagagccctgagcaaggtggccccctacttcgagagaagcatcgtggacctgtacaccggcaacgccgaggaggacgccgacaccaagaccctgctgctgaacatcttccaggacaccaagagcttccccatgcacttcgacgagaagagcatgttcgccggcgacaagaagggcgccaagagcctgaaggaggagttcagactgcacttcaagaacatcagcagaatcatggactgcgtgggctgcgacaagtgcagactgtggggcaagctgcagacccagggcctgggcaccgccctgaagatcctgttcagcgagaaggagatccagaagctgcccgagaacagccccagcaagggcttccagctgaccagacaggagatcgtggccctgctgaacgccttcggcagactgagcaccagcatcagagacctgcagaacttcaaggtgctgctgcagcacagcagatag

SEQ ID NO: 18103 - DNA, 216 bp, Artificial Sequence
  Description of Artificial Sequence: Synthetic coding sequence
atggccaacaacaccaaggagctggaggactgcgagcaggccaacaagctgggcgccatcaacagcaccctgagcaaccagagcaaggaggccttcatcgactgggccagatacgacgacagcagagaccacttctgcgagctggacgacgagagaagccccgccgcccagtacgtggacctgctgctgaaccccgagagatacaccggctactag

SEQ ID NO: 18104 - DNA, 702 bp, Artificial Sequence
  Description of Artificial Sequence: Synthetic coding sequence
atggagctgcccaccaagcccggcaccttcgacctgggcctggccacctggagccccagcttccagggcgagacccacagagcccaggccagaagaagagacgtgggcagacagctgcccgagtacaaggccgtggtggtgggcgccagcggcgtgggcaagagcgccctgaccatccagctgaaccaccagtgcttcgtggaggaccacgaccccaccatccaggacagctactggaaggagctgaccctggacagcggcgactgcatcctgaacgtgctggacaccgccggccaggccatccacagagccctgagagaccagtgcctggccgtgtgcgacggcgtgctgggcgtgttcgccctggacgaccccagcagcctgatccagctgcagcagatctgggccacctggggcccccaccccgcccagcccctggtgctggtgggcaacaagtgcgacctggtgaccaccgccggcgacgcccacgccgccgccgccgccctggcccacagctggggcgcccacttcgtggagaccagcgccaagaccagacagggcgtggaggaggccttcagcctgctggtgcacgagatccagagagtgcaggaggccatggccaaggagcccatggccagaagctgcagagagaagaccagacaccagaaggccacctgccactgcggctgcagcgtggcctag

SEQ ID NO: 18105 - DNA, 2178 bp, Artificial Sequence
  Description of Artificial Sequence: Synthetic coding sequence
atggccatggccatgagcgacagcggcgccagcagactgagaagacagctggagagcggcggcttcgaggccagactgtacgtgaagcagctgagccagcagagcgacggcgacagagacctgcaggagcacagacagagaatccaggccctggccgaggagaccgcccagaacctgaagagaaacgtgtaccagaactacagacagttcatcgagaccgccagagagatcagctacctggagagcgagatgtaccagctgagccacctgctgaccgagcagaagagcagcctggagagcatccccctgaccctgctgcccgccgccgccgccgccggcgccgccgccgccagcggcggcgaggagggcgtgggcggcgccggcggcagagaccacctgagaggccaggccggcttcttcagcacccccggcggcgccagcagagacggcagcggccccggcgaggagggcaagcagagaaccctgaccaccctgctggagaaggtggagggctgcagacacctgctggagacccccggccagtacctggtgtacaacggcgacctggtggagtacgacgccgaccacatggcccagctgcagagagtgcacggcttcctgatgaacgactgcctgctggtggccacctggctgccccagagaagaggcatgtacagatacaacgccctgtacagcctggacggcctggccgtggtgaacgtgaaggacaacccccccatgaaggacatgttcaagctgctgatgttccccgagagcagaatcttccaggccgagaacgccaagatcaagagagagtggctggaggtgctggaggacaccaagagagccctgagcgagaagagaagaagagagcaggaggaggccgccgcccccagaggccccccccaggtgaccagcaaggccaccaaccccttcgaggacgacgaggaggaggagcccgccgtgcccgaggtggaggaggagaaggtggacctgagcatggagtggatccaggagctgcccgaggacctggacgtgtgcatcgcccagagagacttcgagggcgccgtggacctgctggacaagctgaaccactacctggaggacaagcccagccccccccccgtgaaggagctgagagccaaggtggaggagagagtgagacagctgaccgaggtgctggtgttcgagctgagccccgacagaagcctgagaggcggccccaaggccaccagaagagccgtgagccagctgatcagactgggccagtgcaccaaggcctgcgagctgttcctgagaaacagagccgccgccgtgcacaccgccatcagacagctgagaatcgagggcgccaccctgctgtacatccacaagctgtgccacgtgttcttcaccagcctgctggagaccgccagagagttcgagatcgacttcgccggcaccgacagcggctgctacagcgccttcgtggtgtgggccagaagcgccatgggcatgttcgtggacgccttcagcaagcaggtgttcgacagcaaggagagcctgagcaccgccgccgagtgcgtgaaggtggccaaggagcactgccagcagctgggcgacatcggcctggacctgaccttcatcatccacgccctgctggtgaaggacatccagggcgccctgcacagctacaaggagatcatcatcgaggccaccaagcacagaaacagcgaggagatgtggagaagaatgaacctgatgacccccgaggccctgggcaagctgaaggaggagatgaagagctgcggcgtgagcaacttcgagcagtacaccggcgacgactgctgggtgaacctgagctacaccgtggtggccttcaccaagcagaccatgggcttcctggaggaggccctgaagctgtacttccccgagctgcacatggtgctgctggagagcctggtggagatcatcctggtggccgtgcagcacgtggactacagcctgagatgcgagcaggaccccgagaagaaggccttcatcagacagaacgccagcttcctgtacgagaccgtgctgcccgtggtggagaagagattcgaggagggcgtgggcaagcccgccaagcagctgcaggacctgagaaacgccagcagactgatcagagtgaaccccgagagcaccaccagcgtggtgtag

SEQ ID NO: 18106 - DNA, 2166 bp, Artificial Sequence
  Description of Artificial Sequence: Synthetic coding sequence
atgagcgacagcggcgccagcagactgagaagacagctggagagcggcggcttcgaggccagactgtacgtgaagcagctgagccagcagagcgacggcgacagagacctgcaggagcacagacagagaatccaggccctggccgaggagaccgcccagaacctgaagagaaacgtgtaccagaactacagacagttcatcgagaccgccagagagatcagctacctggagagcgagatgtaccagctgagccacctgctgaccgagcagaagagcagcctggagagcatccccctgaccctgctgcccgccgccgccgccgccggcgccgccgccgccagcggcggcgaggagggcgtgggcggcgccggcggcagagaccacctgagaggccaggccggcttcttcagcacccccggcggcgccagcagagacggcagcggccccggcgaggagggcaagcagagaaccctgaccaccctgctggagaaggtggagggctgcagacacctgctggagacccccggccagtacctggtgtacaacggcgacctggtggagtacgacgccgaccacatggcccagctgcagagagtgcacggcttcctgatgaacgactgcctgctggtggccacctggctgccccagagaagaggcatgtacagatacaacgccctgtacagcctggacggcctggccgtggtgaacgtgaaggacaacccccccatgaaggacatgttcaagctgctgatgttccccgagagcagaatcttccaggccgagaacgccaagatcaagagagagtggctggaggtgctggaggacaccaagagagccctgagcgagaagagaagaagagagcaggaggaggccgccgcccccagaggccccccccaggtgaccagcaaggccaccaaccccttcgaggacgacgaggaggaggagcccgccgtgcccgaggtggaggaggagaaggtggacctgagcatggagtggatccaggagctgcccgaggacctggacgtgtgcatcgcccagagagacttcgagggcgccgtggacctgctggacaagctgaaccactacctggaggacaagcccagccccccccccgtgaaggagctgagagccaaggtggaggagagagtgagacagctgaccgaggtgctggtgttcgagctgagccccgacagaagcctgagaggcggccccaaggccaccagaagagccgtgagccagctgatcagactgggccagtgcaccaaggcctgcgagctgttcctgagaaacagagccgccgccgtgcacaccgccatcagacagctgagaatcgagggcgccaccctgctgtacatccacaagctgtgccacgtgttcttcaccagcctgctggagaccgccagagagttcgagatcgacttcgccggcaccgacagcggctgctacagcgccttcgtggtgtgggccagaagcgccatgggcatgttcgtggacgccttcagcaagcaggtgttcgacagcaaggagagcctgagcaccgccgccgagtgcgtgaaggtggccaaggagcactgccagcagctgggcgacatcggcctggacctgaccttcatcatccacgccctgctggtgaaggacatccagggcgccctgcacagctacaaggagatcatcatcgaggccaccaagcacagaaacagcgaggagatgtggagaagaatgaacctgatgacccccgaggccctgggcaagctgaaggaggagatgaagagctgcggcgtgagcaacttcgagcagtacaccggcgacgactgctgggtgaacctgagctacaccgtggtggccttcaccaagcagaccatgggcttcctggaggaggccctgaagctgtacttccccgagctgcacatggtgctgctggagagcctggtggagatcatcctggtggccgtgcagcacgtggactacagcctgagatgcgagcaggaccccgagaagaaggccttcatcagacagaacgccagcttcctgtacgagaccgtgctgcccgtggtggagaagagattcgaggagggcgtgggcaagcccgccaagcagctgcaggacctgagaaacgccagcagactgatcagagtgaaccccgagagcaccaccagcgtggtgtag

SEQ ID NO: 18107 - DNA, 3345 bp, Artificial Sequence
  Description of Artificial Sequence: Synthetic coding sequence
atggagagaagccccggcgagggccccagccccagccccatggaccagcccagcgcccccagcgaccccaccgaccagccccccgccgcccacgccaagcccgaccccggcagcggcggccagcccgccggccccggcgccgccggcgaggccctggccgtgctgaccagcttcggcagaagactgctggtgctgatccccgtgtacctggccggcgccgtgggcctgagcgtgggcttcgtgctgttcggcctggccctgtacctgggctggagaagagtgagagacgagaaggagagaagcctgagagccgccagacagctgctggacgacgaggagcagctgaccgccaagaccctgtacatgagccacagagagctgcccgcctgggtgagcttccccgacgtggagaaggccgagtggctgaacaagatcgtggcccaggtgtggcccttcctgggccagtacatggagaagctgctggccgagaccgtggcccccgccgtgagaggcagcaacccccacctgcagaccttcaccttcaccagagtggagctgggcgagaagcccctgagaatcatcggcgtgaaggtgcaccccggccagagaaaggagcagatcctgctggacctgaacatcagctacgtgggcgacgtgcagatcgacgtggaggtgaagaagtacttctgcaaggccggcgtgaagggcatgcagctgcacggcgtgctgagagtgatcctggagcccctgatcggcgacctgcccttcgtgggcgccgtgagcatgttcttcatcagaagacccaccctggacatcaactggaccggcatgaccaacctgctggacatccccggcctgagcagcctgagcgacaccatgatcatggacagcatcgccgccttcctggtgctgcccaacagactgctggtgcccctggtgcccgacctgcaggacgtggcccagctgagaagccccctgcccagaggcatcatcagaatccacctgctggccgccagaggcctgagcagcaaggacaagtacgtgaagggcctgatcgagggcaagagcgacccctacgccctggtgagactgggcacccagaccttctgcagcagagtgatcgacgaggagctgaacccccagtggggcgagacctacgaggtgatggtgcacgaggtgcccggccaggagatcgaggtggaggtgttcgacaaggaccccgacaaggacgacttcctgggcagaatgaagctggacgtgggcaaggtgctgcaggccagcgtgctggacgactggttccccctgcagggcggccagggccaggtgcacctgagactggagtggctgagcctgctgagcgacgccgagaagctggagcaggtgctgcagtggaactggggcgtgagcagcagacccgacccccccagcgccgccatcctggtggtgtacctggacagagcccaggacctgcccatggtgaccagcgagctgtaccccccccagctgaagaagggcaacaaggagcccaaccccatggtgcagctgagcatccaggacgtgacccaggagagcaaggccgtgtacagcaccaactgccccgtgtgggaggaggccttcagattcttcctgcaggacccccagagccaggagctggacgtgcaggtgaaggacgacagcagagccctgaccctgggcgccctgaccctgcccctggccagactgctgaccgcccccgagctgatcctggaccagtggttccagctgagcagcagcggccccaacagcagactgtacatgaagctggtgatgagaatcctgtacctggacagcagcgagatctgcttccccaccgtgcccggctgccccggcgcctgggacgtggacagcgagaacccccagagaggcagcagcgtggacgccccccccagaccctgccacaccacccccgacagccagttcggcaccgagcacgtgctgagaatccacgtgctggaggcccaggacctgatcgccaaggacagattcctgggcggcctggtgaagggcaagagcgacccctacgtgaagctgaagctggccggcagaagcttcagaagccacgtggtgagagaggacctgaaccccagatggaacgaggtgttcgaggtgatcgtgaccagcgtgcccggccaggagctggaggtggaggtgttcgacaaggacctggacaaggacgacttcctgggcagatgcaaggtgagactgaccaccgtgctgaacagcggcttcctggacgagtggctgaccctggaggacgtgcccagcggcagactgcacctgagactggagagactgacccccagacccaccgccgccgagctggaggaggtgctgcaggtgaacagcctgatccagacccagaagagcgccgagctggccgccgccctgctgagcatctacatggagagagccgaggacctgcccctgagaaagggcaccaagcacctgagcccctacgccaccctgaccgtgggcgacagcagccacaagaccaagaccatcagccagaccagcgcccccgtgtgggacgagagcgccagcttcctgatcagaaagccccacaccgagagcctggagctgcaggtgagaggcgagggcaccggcgtgctgggcagcctgagcctgcccctgagcgagctgctggtggccgaccagctgtgcctggacagatggttcaccctgagcagcggccagggccaggtgctgctgagagcccagctgggcatcctggtgagccagcacagcggcgtggaggcccacagccacagctacagccacagcagcagcagcctgagcgaggagcccgagctgagcggcggccccccccacatcaccagcagcgcccccgagctgagacagagactgacccacgtggacagccccctggaggcccccgccggccccctgggccaggtgaagctgaccctgtggtactacagcgaggagagaaagctggtgagcatcgtgcacggctgcagaagcctgagacagaacggcagagacccccccgacccctacgtgagcctgctgctgctgcccgacaagaacagaggcaccaagagaagaaccagccagaagaagagaaccctgagccccgagttcaacgagagattcgagtgggagctgcccctggacgaggcccagagaagaaagctggacgtgagcgtgaagagcaacagcagcttcatgagcagagagagagagctgctgggcaaggtgcagctggacctggccgagaccgacctgagccagggcgtggccagatggtacgacctgatggacaacaaggacaagggcagcagctag

SEQ ID NO: 18108 - DNA, 3315 bp, Artificial Sequence
  Description of Artificial Sequence: Synthetic coding sequence
atggagagaagccccggcgagggccccagccccagccccatggaccagcccagcgcccccagcgaccccaccgaccagccccccgccgcccacgccaagcccgaccccggcagcggcggccagcccgccggccccggcgccgccggcgaggccctggccgtgctgaccagcttcggcagaagactgctggtgctgatccccgtgtacctggccggcgccgtgggcctgagcgtgggcttcgtgctgttcggcctggccctgtacctgggctggagaagagtgagagacgagaaggagagaagcctgagagccgccagacagctgctggacgacgaggagcagctgaccgccaagaccctgtacatgagccacagagagctgcccgcctgggtgagcttccccgacgtggagaaggccgagtggctgaacaagatcgtggcccaggtgtggcccttcctgggccagtacatggagaagctgctggccgagaccgtggcccccgccgtgagaggcagcaacccccacctgcagaccttcaccttcaccagagtggagctgggcgagaagcccctgagaatcatcggcgtgaaggtgcaccccggccagagaaaggagcagatcctgctggacctgaacatcagctacgtgggcgacgtgcagatcgacgtggaggtgaagaagtacttctgcaaggccggcgtgaagggcatgcagctgcacggcgtgctgagagtgatcctggagcccctgatcggcgacctgcccttcgtgggcgccgtgagcatgttcttcatcagaagacccaccctggacatcaactggaccggcatgaccaacctgctggacatccccggcctgagcagcctgagcgacaccatgatcatggacagcatcgccgccttcctggtgctgcccaacagactgctggtgcccctggtgcccgacctgcaggacgtggcccagctgagaagccccctgcccagaggcatcatcagaatccacctgctggccgccagaggcctgagcagcaaggacaagtacgtgaagggcctgatcgagggcaagagcgacccctacgccctggtgagactgggcacccagaccttctgcagcagagtgatcgacgaggagctgaacccccagtggggcgagacctacgaggtgatggtgcacgaggtgcccggccaggagatcgaggtggaggtgttcgacaaggaccccgacaaggacgacttcctgggcagaatgaagctggacgtgggcaaggtgctgcaggccagcgtgctggacgactggttccccctgcagggcggccagggccaggtgcacctgagactggagtggctgagcctgctgagcgacgccgagaagctggagcaggtgctgcagtggaactggggcgtgagcagcagacccgacccccccagcgccgccatcctggtggtgtacctggacagagcccaggacctgcccctgaagaagggcaacaaggagcccaaccccatggtgcagctgagcatccaggacgtgacccaggagagcaaggccgtgtacagcaccaactgccccgtgtgggaggaggccttcagattcttcctgcaggacccccagagccaggagctggacgtgcaggtgaaggacgacagcagagccctgaccctgggcgccctgaccctgcccctggccagactgctgaccgcccccgagctgatcctggaccagtggttccagctgagcagcagcggccccaacagcagactgtacatgaagctggtgatgagaatcctgtacctggacagcagcgagatctgcttccccaccgtgcccggctgccccggcgcctgggacgtggacagcgagaacccccagagaggcagcagcgtggacgccccccccagaccctgccacaccacccccgacagccagttcggcaccgagcacgtgctgagaatccacgtgctggaggcccaggacctgatcgccaaggacagattcctgggcggcctggtgaagggcaagagcgacccctacgtgaagctgaagctggccggcagaagcttcagaagccacgtggtgagagaggacctgaaccccagatggaacgaggtgttcgaggtgatcgtgaccagcgtgcccggccaggagctggaggtggaggtgttcgacaaggacctggacaaggacgacttcctgggcagatgcaaggtgagactgaccaccgtgctgaacagcggcttcctggacgagtggctgaccctggaggacgtgcccagcggcagactgcacctgagactggagagactgacccccagacccaccgccgccgagctggaggaggtgctgcaggtgaacagcctgatccagacccagaagagcgccgagctggccgccgccctgctgagcatctacatggagagagccgaggacctgcccctgagaaagggcaccaagcacctgagcccctacgccaccctgaccgtgggcgacagcagccacaagaccaagaccatcagccagaccagcgcccccgtgtgggacgagagcgccagcttcctgatcagaaagccccacaccgagagcctggagctgcaggtgagaggcgagggcaccggcgtgctgggcagcctgagcctgcccctgagcgagctgctggtggccgaccagctgtgcctggacagatggttcaccctgagcagcggccagggccaggtgctgctgagagcccagctgggcatcctggtgagccagcacagcggcgtggaggcccacagccacagctacagccacagcagcagcagcctgagcgaggagcccgagctgagcggcggccccccccacatcaccagcagcgcccccgagctgagacagagactgacccacgtggacagccccctggaggcccccgccggccccctgggccaggtgaagctgaccctgtggtactacagcgaggagagaaagctggtgagcatcgtgcacggctgcagaagcctgagacagaacggcagagacccccccgacccctacgtgagcctgctgctgctgcccgacaagaacagaggcaccaagagaagaaccagccagaagaagagaaccctgagccccgagttcaacgagagattcgagtgggagctgcccctggacgaggcccagagaagaaagctggacgtgagcgtgaagagcaacagcagcttcatgagcagagagagagagctgctgggcaaggtgcagctggacctggccgagaccgacctgagccagggcgtggccagatggtacgacctgatggacaacaaggacaagggcagcagctag

SEQ ID NO: 18109 - DNA, 3177 bp, Artificial Sequence
  Description of Artificial Sequence: Synthetic coding sequence
atggagagaagccccggcgagggccccagccccagccccatggaccagcccagcgcccccagcgaccccaccgaccagccccccgccgcccacgccaagcccgaccccggcagcggcggccagcccgccggccccggcgccgccggcgaggccctggccgtgctgaccagcttcggcagaagactgctggtgctgatccccgtgtacctggccggcgccgtgggcctgagcgtgggcttcgtgctgttcggcctggccctgtacctgggctggagaagagtgagagacgagaaggagagaagcctgagagccgccagacagctgctggacgacgagaagctgctggccgagaccgtggcccccgccgtgagaggcagcaacccccacctgcagaccttcaccttcaccagagtggagctgggcgagaagcccctgagaatcatcggcgtgaaggtgcaccccggccagagaaaggagcagatcctgctggacctgaacatcagctacgtgggcgacgtgcagatcgacgtggaggtgaagaagtacttctgcaaggccggcgtgaagggcatgcagctgcacggcgtgctgagagtgatcctggagcccctgatcggcgacctgcccttcgtgggcgccgtgagcatgttcttcatcagaagacccaccctggacatcaactggaccggcatgaccaacctgctggacatccccggcctgagcagcctgagcgacaccatgatcatggacagcatcgccgccttcctggtgctgcccaacagactgctggtgcccctggtgcccgacctgcaggacgtggcccagctgagaagccccctgcccagaggcatcatcagaatccacctgctggccgccagaggcctgagcagcaaggacaagtacgtgaagggcctgatcgagggcaagagcgacccctacgccctggtgagactgggcacccagaccttctgcagcagagtgatcgacgaggagctgaacccccagtggggcgagacctacgaggtgatggtgcacgaggtgcccggccaggagatcgaggtggaggtgttcgacaaggaccccgacaaggacgacttcctgggcagaatgaagctggacgtgggcaaggtgctgcaggccagcgtgctggacgactggttccccctgcagggcggccagggccaggtgcacctgagactggagtggctgagcctgctgagcgacgccgagaagctggagcaggtgctgcagtggaactggggcgtgagcagcagacccgacccccccagcgccgccatcctggtggtgtacctggacagagcccaggacctgcccctgaagaagggcaacaaggagcccaaccccatggtgcagctgagcatccaggacgtgacccaggagagcaaggccgtgtacagcaccaactgccccgtgtgggaggaggccttcagattcttcctgcaggacccccagagccaggagctggacgtgcaggtgaaggacgacagcagagccctgaccctgggcgccctgaccctgcccctggccagactgctgaccgcccccgagctgatcctggaccagtggttccagctgagcagcagcggccccaacagcagactgtacatgaagctggtgatgagaatcctgtacctggacagcagcgagatctgcttccccaccgtgcccggctgccccggcgcctgggacgtggacagcgagaacccccagagaggcagcagcgtggacgccccccccagaccctgccacaccacccccgacagccagttcggcaccgagcacgtgctgagaatccacgtgctggaggcccaggacctgatcgccaaggacagattcctgggcggcctggtgaagggcaagagcgacccctacgtgaagctgaagctggccggcagaagcttcagaagccacgtggtgagagaggacctgaaccccagatggaacgaggtgttcgaggtgatcgtgaccagcgtgcccggccaggagctggaggtggaggtgttcgacaaggacctggacaaggacgacttcctgggcagatgcaaggtgagactgaccaccgtgctgaacagcggcttcctggacgagtggctgaccctggaggacgtgcccagcggcagactgcacctgagactggagagactgacccccagacccaccgccgccgagctggaggaggtgctgcaggtgaacagcctgatccagacccagaagagcgccgagctggccgccgccctgctgagcatctacatggagagagccgaggacctgcccctgagaaagggcaccaagcacctgagcccctacgccaccctgaccgtgggcgacagcagccacaagaccaagaccatcagccagaccagcgcccccgtgtgggacgagagcgccagcttcctgatcagaaagccccacaccgagagcctggagctgcaggtgagaggcgagggcaccggcgtgctgggcagcctgagcctgcccctgagcgagctgctggtggccgaccagctgtgcctggacagatggttcaccctgagcagcggccagggccaggtgctgctgagagcccagctgggcatcctggtgagccagcacagcggcgtggaggcccacagccacagctacagccacagcagcagcagcctgagcgaggagcccgagctgagcggcggccccccccacatcaccagcagcgcccccgagctgagacagagactgacccacgtggacagccccctggaggcccccgccggccccctgggccaggtgaagctgaccctgtggtactacagcgaggagagaaagctggtgagcatcgtgcacggctgcagaagcctgagacagaacggcagagacccccccgacccctacgtgagcctgctgctgctgcccgacaagaacagaggcaccaagagaagaaccagccagaagaagagaaccctgagccccgagttcaacgagagattcgagtgggagctgcccctggacgaggcccagagaagaaagctggacgtgagcgtgaagagcaacagcagcttcatgagcagagagagagagctgctgggcaaggtgcagctggacctggccgagaccgacctgagccagggcgtggccagatggtacgacctgatggacaacaaggacaagggcagcagctag

SEQ ID NO: 18110 - DNA, 3345 bp, Artificial Sequence; identical to SEQ ID NO: 18107
  Description of Artificial Sequence: Synthetic coding sequence

SEQ ID NO: 18111 - DNA, 2661 bp, Artificial Sequence
  Description of Artificial Sequence: Synthetic coding sequence
atgagagccgaggagccctgcgcccccggcgcccccagcgccctgggcgcccagagaacccccggccccgagctgagactgagcagccagctgctgcccgagctgtgcaccttcgtggtgagagtgctgttctacctgggccccgtgtacctggccggctacctgggcctgagcatcacctggctgctgctgggcgccctgctgtggatgtggtggagaagaaacagaagaggcaagctgggcagactggccgccgccttcgagttcctggacaacgagagagagttcatcagcagagagctgagaggccagcacctgcccgcctggatccacttccccgacgtggagagagtggagtgggccaacaagatcatcagccagacctggccctacctgagcatgatcatggagagcaagttcagagagaagctggagcccaagatcagagagaagagcatccacctgagaaccttcaccttcaccaagctgtacttcggccagaagtgccccagagtgaacggcgtgaaggcccacaccaacacctgcaacagaagaagagtgaccgtggacctgcagatctgctacatcggcgactgcgagatcagcgtggagctgcagaagatccaggccggcgtgaacggcatccagctgcagggcaccctgagagtgatcctggagcccctgctggtggacaagcccttcgtgggcgccgtgaccgtgttcttcctgcagaagccccacctgcagatcaactggaccggcctgaccaacctgctggacgcccccggcatcaacgacgtgagcgacagcctgctggaggacctgatcgccacccacctggtgctgcccaacagagtgaccgtgcccgtgaagaagggcctggacctgaccaacctgagattccccctgccctgcggcgtgatcagagtgcacctgctggaggccgagcagctggcccagaaggacaacttcctgggcctgagaggcaagagcgacccctacgccaaggtgagcatcggcctgcagcacttcagaagcagaaccatctacagaaacctgaaccccacctggaacgaggtgttcgagttcatggtgtacgaggtgcccggccaggacctggaggtggacctgtacgacgaggacaccgacagagacgacttcctgggcagcctgcagatctgcctgggcgacgtgatgaccaacagagtggtggacgagtggttcgtgctgaacgacaccaccagcggcagactgcacctgagactggagtggctgagcctgctgaccgaccaggaggtgctgaccgaggaccacggcggcctgagcaccgccatcctggtggtgttcctggagagcgcctgcaacctgcccagaaaccccttcgactacctgaacggcgagtacagagccaagaagctgagcagattcgccagaaacaaggtgagcaaggaccccagcagctacgtgaagctgagcgtgggcaagaagacccacaccagcaagacctgcccccacaacaaggaccccgtgtggagccaggtgttcagcttcttcgtgcacaacgtggccaccgagagactgcacctgaaggtgctggacgacgaccaggagtgcgccctgggcatgctggaggtgcccctgtgccagatcctgccctacgccgacctgaccctggagcagagattccagctggaccacagcggcctggacagcctgatcagcatgagactggtgctgagattcctgcaggtggaggagagagagctgggcagcccctacaccggccccgaggccctgaagaagggccccctgctgatcaagaaggtggccaccaaccagggccccaaggcccagccccaggaggagggccccaccgacctgccctgcccccccgaccccgccagcgacaccaaggacgtgagcagaagcaccaccaccaccaccagcgccaccaccgtggccaccgagcccaccagccaggagaccggccccgagcccaagggcaaggacagcgccaagagattctgcgagcccatcggcgagaagaagagccccgccaccatcttcctgaccgtgcccggcccccacagccccggccccatcaagagccccagacccatgaagtgccccgccagccccttcgcctggccccccaagagactggcccccagcatgagcagcctgaacagcctggccagcagctgcttcgacctggccgacatcagcctgaacatcgagggcggcgacctgagaagaagacagctgggcgagatccagctgaccgtgagatacgtgtgcctgagaagatgcctgagcgtgctgatcaacggctgcagaaacctgaccccctgcaccagcagcggcgccgacccctacgtgagagtgtacctgctgcccgagagaaagtgggcctgcagaaagaagaccagcgtgaagagaaagaccctggagcccctgttcgacgagaccttcgagttcttcgtgcccatggaggaggtgaagaagagaagcctggacgtggccgtgaagaacagcagacccctgggcagccacagaagaaaggagctgggcaaggtgctgatcgacctgagcaaggaggacctgatcaagggcttcagccagtggtacgagctgacccccaacggccagcccagaagctag

SEQ ID NO: 18112 - DNA, 2463 bp, Artificial Sequence
  Description of Artificial Sequence: Synthetic coding sequence
atgctgagactgggcctgtgcgccgccgccctgctgtgcgtgtgcagacccggcgccgtgagagccgactgctggctgatcgagggcgacaagggctacgtgtggctggccatctgcagccagaaccagcccccctacgagaccatcccccagcacatcaacagcaccgtgcacgacctgagactgaacgagaacaagctgaaggccgtgctgtacagcagcctgaacagattcggcaacctgaccgacctgaacctgaccaagaacgagatcagctacatcgaggacggcgccttcctgggccagagcagcctgcaggtgctgcagctgggctacaacaagctgagcaacctgaccgagggcatgctgagaggcatgagcagactgcagttcctgttcgtgcagcacaacctgatcgaggtggtgacccccaccgccttcagcgagtgccccagcctgatcagcatcgacctgagcagcaacagactgagcagactggacggcgccaccttcgccagcctggccagcctgatggtgtgcgagctggccggcaaccccttcaactgcgagtgcgacctgttcggcttcctggcctggctggtggtgttcaacaacgtgaccaagaactacgacagactgcagtgcgagagccccagagagttcgccggctaccccctgctggtgcccagaccctaccacagcctgaacgccatcaccgtgctgcaggccaagtgcagaaacggcagcctgcccgccagacccgtgagccaccccaccccctacagcaccgacgcccagagagagcccgacgagaacagcggcttcaaccccgacgagatcctgagcgtggagccccccgccagcagcaccaccgacgccagcgccggccccgccatcaagctgcaccacgtgaccttcaccagcgccaccctggtggtgatcatcccccacccctacagcaagatgtacatcctggtgcagtacaacaacagctacttcagcgacgtgatgaccctgaagaacaagaaggagatcgtgaccctggacaagctgagagcccacaccgagtacaccttctgcgtgaccagcctgagaaacagcagaagattcaaccacacctgcctgaccttcaccaccagagaccccgtgcccggcgacctggcccccagcaccagcaccaccacccactacatcatgaccatcctgggctgcctgttcggcatggtgatcgtgctgggcgccgtgtactactgcctgagaaagagaagaatgcaggaggagaagcagaagagcgtgaacgtgaagaagaccatcctggagatgagatacggcgccgacgtggacgccggcagcatcgtgcacgccgcccagaagctgggcgagccccccgtgctgcccgtgagcagaatggccagcatccccagcatgatcggcgagaagctgcccaccgccaagggcctggaggccggcctggacacccccaaggtggccaccaagggcaactacatcgaggtgagaaccggcgccggcggcgacggcctggccagacccgaggacgacctgcccgacctggagaacggccagggcagcgccgccgagatcagcaccatcgccaaggaggtggacaaggtgaaccagatcatcaacaactgcatcgacgccctgaagctggacagcgccagcttcctgggcggcggcagcagcagcggcgaccccgagctggccttcgagtgccagagcctgcccgccgccgccgccgccagcagcgccaccggccccggcgccctggagagacccagcttcctgagccccccctacaaggagagcagccaccaccccctgcagagacagctgagcgccgacgccgccgtgaccagaaagacctgcagcgtgagcagcagcggcagcatcaagagcgccaaggtgttcagcctggacgtgcccgaccaccccgccgccaccggcctggccaagggcgacagcaagtacatcgagaagggcagccccctgaacagccccctggacagactgcccctggtgcccgccggcagcggcggcggcagcggcggcggcggcggcatccaccacctggaggtgaagcccgcctaccactgcagcgagcacagacacagcttccccgccctgtactacgaggagggcgccgacagcctgagccagagagtgagcttcctgaagcccctgaccagaagcaagagagacagcacctacagccagctgagccccagacactactacagcggctacagcagcagccccgagtacagcagcgagagcacccacaagatctgggagagattcagaccctacaagaagcaccacagagaggaggtgtacatggccgccggccacgccctgagaaagaaggtgcagttcgccaaggacgaggacctgcacgacatcctggactactggaagggcgtgagcgcccagcagaagctgtag

SEQ ID NO: 18113 - DNA, 2463 bp, Artificial Sequence; identical to SEQ ID NO: 18112
  Description of Artificial Sequence: Synthetic coding sequence

SEQ ID NO: 18114 - DNA, 558 bp, Artificial Sequence
  Description of Artificial Sequence: Synthetic coding sequence
atggtgggcctgagatggtggaaccacatcgacgaggacggcaagagccactgggtgttcgagagcagaaaggagagcagccaggagaacaagaccgtgagcgaggccgagagcagaatcttctggctgggcctgatcgcctgcagcgtgctgtgggtgatcttcgccttcagcgccctgttcagcttcaccgtgaagtggctggccgtggtgatcatgggcgtggtgctgcagggcgccaacctgtacggctacatcagatgcaaggtgagaagcagaaagcacctgaccagcatggccaccagctacttcggcaagcagttcctgagacagagaagaagcagacacatcgcccagaccggcctgaaggtgctgggcagcagagacccccccgccagcgccttccagagcgccggcatcaccggcgtgagcagatgccccggccaccccagcagaaagttccaccaggacagccagaagaccctggacttccccggcagctacctgaagaacatgacccccggcagacccatgagccccatccccctgagacagtag

SEQ ID NO: 18115 - DNA, 864 bp, Artificial Sequence
  Description of Artificial Sequence: Synthetic coding sequence
atgccccccctgtgggccctgctggccctgggctgcctgagattcggcagcgccgtgaacctgcagccccagctggccagcgtgaccttcgccaccaacaaccccaccctgaccaccgtggccctggagaagcccctgtgcatgttcgacagcaaggaggccctgaccggcacccacgaggtgtacctgtacgtgctggtggacagcgccatcagcagaaacgccagcgtgcaggacagcaccaacacccccctgggcagcaccttcctgcagaccgagggcggcagaaccggcccctacaaggccgtggccttcgacctgatcccctgcagcgacctgcccagcctggacgccatcggcgacgtgagcaaggccagccagatcctgaacgcctacctggtgagagtgggcgccaacggcacctgcctgtgggaccccaacttccagggcctgtgcaacgcccccctgagcgccgccaccgagtacagattcaagtacgtgctggtgaacatgagcaccggcctggtggaggaccagaccctgtggagcgaccccatcagaaccaaccagctgaccccctacagcaccatcgacacctggcccggcagaagaagcggcggcatgatcgtgatcaccagcatcctgggcagcctgcccttcttcctgctggtgggcttcgccggcgccatcgccctgagcctggtggacatgggcagcagcgacggcgagaccacccacgacagccagatcacccaggaggccgtgcccaagagcctgggcgccagcgagagcagctacaccagcgtgaacagaggcccccccctggacagagccgaggtgtacagcagcaagctgcaggactag

SEQ ID NO: 18116 - DNA, 528 bp, Artificial Sequence
  Description of Artificial Sequence: Synthetic coding sequence
atgaagtacggcgtgctgcacatccacggcctgtacaccgacccctgcggcgtggtgctggaccccagcggctacaaggacgtgacccaggacgccgaggtgatggaggtgctgcagaacctgtacagaaccaagagcttcctgttcgtgggctgcggcgagaccctgagagaccagatcttccaggccctgttcctgtacagcgtgcccaacaaggtggacctggagcactacatgctggtgctgaaggagaacgaggaccacttcttcaagcaccaggccgacatgctgctgcacggcatcaaggtggtgagctacggcgactgcttcgaccacttccccggctacgtgcaggacctggccacccagatctgcaagcagcagagccccgacgccgacagagtggacagcaccaccctgctgggcaacgcctgccaggactgcgccaagagaaagctggaggagaacggcatcgaggtgagcaagaagagaacccagagcgacaccgacgacgccggcggcagctag

SEQ ID NO: 18117 - DNA, 420 bp, Artificial Sequence
  Description of Artificial Sequence: Synthetic coding sequence
atggacagcgtggagaagaccaccaacagaagcgagcagaagagcagaaagttcctgaagagcctgatcagaaagcagccccaggagctgctgctggtgatcggcaccggcgtgagcgccgccgtggcccccggcatccccgccctgtgcagctggagaagctgcatcgaggccgtgatcgaggccgccgagcagctggaggtgctgcaccccggcgacgtggccgagttcagaagaaaggtgaccaaggacagagacctgctggtggtggcccacgacctgatcagaaagatgagccccagaaccggcgacgccaagcccagcttcttccaggactgcctgatggaggtgttcgacgacctggagcagcacatcagaagccccgtggtgctgcagagcatcctgagcctgatggactag

SEQ ID NO: 18118 - DNA, 1074 bp, Artificial Sequence
  Description of Artificial Sequence: Synthetic coding sequence
atggacagcgtggagaagaccaccaacagaagcgagcagaagagcagaaagttcctgaagagcctgatcagaaagcagccccaggagctgctgctggtgatcggcaccggcgtgagcgccgccgtggcccccggcatccccgccctgtgcagctggagaagctgcatcgaggccgtgatcgaggccgccgagcagctggaggtgctgcaccccggcgacgtggccgagttcagaagaaaggtgaccaaggacagagacctgctggtggtggcccacgacctgatcagaaagatgagccccagaaccggcgacgccaagcccagcttcttccaggactgcctgatggaggtgttcgacgacctggagcagcacatcagaagccccgtggtgctgcagagcatcctgagcctgatggacagaggcgccatggtgctgaccaccaactacgacaacctgctggaggccttcggcagaagacagaacaagcccatggagagcctggacctgaaggacaagaccaaggtgctggagtgggccagaggccacatgaagtacggcgtgctgcacatccacggcctgtacaccgacccctgcggcgtggtgctggaccccagcggctacaaggacgtgacccaggacgccgaggtgatggaggtgctgcagaacctgtacagaaccaagagcttcctgttcgtgggctgcggcgagaccctgagagaccagatcttccaggccctgttcctgtacagcgtgcccaacaaggtggacctggagcactacatgctggtgctgaaggagaacgaggaccacttcttcaagcaccaggccgacatgctgctgcacggcatcaaggtggtgagctacggcgactgcttcgaccacttccccggctacgtgcaggacctggccacccagatctgcaagcagcagagccccgacgccgacagagtggacagcaccaccctgctgggcaacgcctgccaggactgcgccaagagaaagctggaggagaacggcatcgaggtgagcaagaagagaacccagagcgacaccgacgacgccggcggcagctag

SEQ ID NO: 18119 - DNA, 822 bp, Artificial Sequence
  Description of Artificial Sequence: Synthetic coding sequence
atggaccccgtgcccggcaccgacagcgcccccctggccggcctggcctggagcagcgccagcgcccccccccccagaggcttcagcgccatcagctgcaccgtggagggcgcccccgccagcttcggcaagagcttcgcccagaagagcggctacttcctgtgcctgagcagcctgggcagcctggagaacccccaggagaacgtggtggccgacatccagatcgtggtggacaagagccccctgcccctgggcttcagccccgtgtgcgaccccatggacagcaaggccagcgtgagcaagaagaagagaatgtgcgtgaagctgctgcccctgggcgccaccgacaccgccgtgttcgacgtgagactgagcggcaagaccaagaccgtgcccggctacctgagaatcggcgacatgggcggcttcgccatctggtgcaagaaggccaaggcccccagacccgtgcccaagcccagaggcctgagcagagacatgcagggcctgagcctggacgccgccagccagcccagcaagggcggcctgctggagagaaccgccagcagactgggcagcagagccagcaccctgagaagaaacgacagcatctacgaggccagcagcctgtacggcatcagcgccatggacggcgtgcccttcaccctgcaccccagattcgagggcaagagctgcagccccctggccttcagcgccttcggcgacctgaccatcaagagcctggccgacatcgaggaggagtacaactacggcttcgtggtggagaagaccgccgccgccagactgccccccagcgtgagctag

SEQ ID NO: 18120 - DNA, 702 bp, Artificial Sequence
  Description of Artificial Sequence: Synthetic coding sequence
atggaccccgtgcccggcaccgacagcgcccccctggccggcctggcctggagcagcgccagcgcccccccccccagaggcttcagcgccatcagctgcaccgtggagggcgcccccgccagcttcggcaagagcttcgcccagaagagcggctacttcctgtgcctgagcagcctgggcagcctggagaacccccaggagaacgtggtggccgacatccagatcgtggtggacaagagccccctgcccctgggcttcagccccgtgtgcgaccccatggacagcaaggccagcgtgagcaagaagaagagaatgtgcgtgaagctgctgcccctgggcgccaccgacaccgccgtgttcgacgtgagactgagcggcaagaccaagaccgtgcccggctacctgagaatcggcaagggcggcctgctggagagaaccgccagcagactgggcagcagagccagcaccctgagaagaaacgacagcatctacgaggccagcagcctgtacggcatcagcgccatggacggcgtgcccttcaccctgcaccccagattcgagggcaagagctgcagccccctggccttcagcgccttcggcgacctgaccatcaagagcctggccgacatcgaggaggagtacaactacggcttcgtggtggagaagaccgccgccgccagactgccccccagcgtgagctag

SEQ ID NO: 18121 - DNA, 822 bp, Artificial Sequence; identical to SEQ ID NO: 18119
  Description of Artificial Sequence: Synthetic coding sequence

SEQ ID NO: 18122 - DNA, 960 bp, Artificial Sequence
  Description of Artificial Sequence: Synthetic coding sequence
atgagaagctgcttctgcgtgagaagaagcagagaccccccccccccccagcccccccccccccccccccagagaggcaccgaccagagcaccatgcccgaggtgaaggacctgagcgaggccctgcccgagaccagcatggaccccatcaccggcgtgggcgtggtggccagcagaaacagagcccccaccggctacgacgtggtggcccagaccgccgacggcgtggacgccgacctgtggaaggacggcctgttcaagagcaaggtgaccagatacctgtgcttcaccagaagcttcagcaaggagaacagccacctgggcaacgtgctggtggacatgaagctgatcgacatcaaggacaccctgcccgtgggcttcatccccatccaggagaccgtggacacccaggaggtggccttcagaaagaagagactgtgcatcaagttcatccccagagacagcaccgaggccgccatctgcgacatcagaatcatgggcagaaccaagcaggcccccccccagtacaccttcatcggcgagctgaacagcatgggcatctggtacagaatgggcagagtgcccagaaaccacgacagcagccagcccaccacccccagccagagcagcgccgccagcacccccgcccccaacctgcccagacacatcagcctgaccctgcccgccaccttcagaggcagaaacagcaccagaaccgactacgagtaccagcacagcaacctgtacgccatcagcgccatggacggcgtgcccttcatgatcagcgagaagttcagctgcgtgcccgagagcatgcagcccttcgacctgctgggcatcaccatcaagagcctggccgagatcgagaaggagtacgagtacagcttcagaaccgagcagagcgccgccgccagactgccccccagccccaccagatgccagcagatcccccagagctag

SEQ ID NO: 18123 - DNA, 618 bp, Artificial Sequence
  Description of Artificial Sequence: Synthetic coding sequence
atggacaccggcctgagcagccagcccagcgaggaggaccagagcaccatgcccgaggtgaaggacctgagcgaggccctgcccgagaccagcatggaccccatcaccggcgtgggcgtggtggccagcagaaacagagcccccaccggctacgacgtggtggcccagaccgccgacggcgtggacgccgacctgtggaaggacggcctgttcaagagcaaggtgaccagatacctgtgcttcaccagaagcttcagcaaggagaacagccacctgggcaacgtgctggtggacatgaagctgatcgacatcaaggacaccctgcccgtgggcttcatccccatccaggagaccgtggacacccaggaggtggccttcagaaagaagagactgtgcatcaagttcatccccagagacagcaccgaggccgccatctgcgacatcagaatcatgggcagaaccaagcaggcccccccccagtacaccttcatcggcgagctgaacagcatgggcatctggtacagaatgggcagagtgcccagaaaccacgacagcagccagcccaccacccccagccagagcagcgccgccagcacccccgcccccaacctgccctag

SEQ ID NO: 18124 - DNA, 915 bp, Artificial Sequence
  Description of Artificial Sequence: Synthetic coding sequence
atggacaccggcctgagcagccagcccagcgaggaggaccagagcaccatgcccgaggtgaaggacctgagcgaggccctgcccgagaccagcatggaccccatcaccggcgtgggcgtggtggccagcagaaacagagcccccaccggctacgacgtggtggcccagaccgccgacggcgtggacgccgacctgtggaaggacggcctgttcaagagcaaggtgaccagatacctgtgcttcaccagaagcttcagcaaggagaacagccacctgggcaacgtgctggtggacatgaagctgatcgacatcaaggacaccctgcccgtgggcttcatccccatccaggagaccgtggacacccaggaggtggccttcagaaagaagagactgtgcatcaagttcatccccagagacagcaccgaggccgccatctgcgacatcagaatcatgggcagaaccaagcaggcccccccccagtacaccttcatcggcgagctgaacagcatgggcatctggtacagaatgggcagagtgcccagaaaccacgacagcagccagcccaccacccccagccagagcagcgccgccagcacccccgcccccaacctgcccagacacatcagcctgaccctgcccgccaccttcagaggcagaaacagcaccagaaccgactacgagtaccagcacagcaacctgtacgccatcagcgccatggacggcgtgcccttcatgatcagcgagaagttcagctgcgtgcccgagagcatgcagcccttcgacctgctgggcatcaccatcaagagcctggccgagatcgagaaggagtacgagtacagcttcagaaccgagcagagcgccgccgccagactgccccccagccccaccagatgccagcagatcccccagagctag

SEQ ID NO: 18125 - DNA, 645 bp, Artificial Sequence
  Description of Artificial Sequence: Synthetic coding sequence
atggaggcccccgcccacggcctggagccctgcggctggggcgcctgctggctggtgtgctacaccgtgggcagaagagccggcagctggctgagaagctgggccggccccccctggagattccccgagaccaagcccagcgtgagcagcgtgcagggcagaagactggaggccagaagaagagtggcccagaccgccgacggcgtggacgccgacctgtggaaggacggcctgttcaagagcaaggtgaccagatacctgtgcttcaccagaagcttcagcaaggagaacagccacctgggcaacgtgctggtggacatgaagctgatcgacatcaaggacaccctgcccgtgggcttcatccccatccaggagaccgtggacacccaggaggtggccttcagaaagaagagactgtgcatcaagttcatccccagagacagcaccgaggccgccatctgcgacatcagaatcatgggcagaaccaagcaggcccccccccagtacaccttcatcggcgagctgaacagcatgggcatctggtacagaatgggcagagtgcccagaaaccacgacagcagccagcccaccacccccagccagagcagcgccgccagcacccccgcccccaacctgcccagatag

SEQ ID NO: 18126 - DNA, 666 bp, Artificial Sequence
  Description of Artificial Sequence: Synthetic coding sequence
atgagaagctgcttctgcgtgagaagaagcagagaccccccccccccccagcccccccccccccccccccagagaggcaccgaccagagcaccatgcccgaggtgaaggacctgagcgaggccctgcccgagaccagcatggaccccatcaccggcgtgggcgtggtggccagcagaaacagagcccccaccggctacgacgtggtggcccagaccgccgacggcgtggacgccgacctgtggaaggacggcctgttcaagagcaaggtgaccagatacctgtgcttcaccagaagcttcagcaaggagaacagccacctgggcaacgtgctggtggacatgaagctgatcgacatcaaggacaccctgcccgtgggcttcatccccatccaggagaccgtggacacccaggaggtggccttcagaaagaagagactgtgcatcaagttcatccccagagacagcaccgaggccgccatctgcgacatcagaatcatgggcagaaccaagcaggcccccccccagtacaccttcatcggcgagctgaacagcatgggcatctggtacagaatgggcagagtgcccagaaaccacgacagcagccagcccaccacccccagccagagcagcgccgccagcacccccgcccccaacctgcccagatag

SEQ ID NO: 18127 - DNA, 2787 bp, Artificial Sequence
  Description of Artificial Sequence: Synthetic coding sequence
atgggcggcagcgccagcagccagctggacgagggcaagtgcgcctacatcagaggcaagaccgaggccgccatcaagaacttcagcccctactacagcagacagtacagcgtggccttctgcaaccacgtgagaaccgaggtggagcagcagagagacctgaccagccagttcctgaagaccaagccccccctggcccccggcaccatcctgtacgaggccgagctgagccagttcagcgaggacatcaagaagtggaaggagagatacgtggtggtgaagaacgactacgccgtggagagctacgagaacaaggaggcctaccagagaggcgccgcccccaagtgcagaatcctgcccgccggcggcaaggtgctgaccagcgaggacgagtacaacctgctgagcgacagacacttccccgaccccctggccagcagcgagaaggagaacacccagcccttcgtggtgctgcccaaggagttccccgtgtacctgtggcagcccttcttcagacacggctacttctgcttccacgaggccgccgaccagaagagattcagcgccctgctgagcgactgcgtgagacacctgaaccacgactacatgaagcagatgaccttcgaggcccaggccttcctggaggccgtgcagttcttcagacaggagaagggccactacggcagctgggagatgatcaccggcgacgagatccagatcctgagcaacctggtgatggaggagctgctgcccaccctgcagaccgacctgctgcccaagatgaagggcaagaagaacgacagaaagagaacctggctgggcctgctggaggaggcctacaccctggtgcagcaccaggtgagcgagggcctgagcgccctgaaggaggagtgcagagccctgaccaagggcctggagggcaccatcagaagcgacatggaccagatcgtgaacagcaagaactacctgatcggcaagatcaaggccatggtggcccagcccgccgagaagagctgcctggagagcgtgcagcccttcctggccagcatcctggaggagctgatgggccccgtgagcagcggcttcagcgaggtgagagtgctgttcgagaaggaggtgaacgaggtgagccagaacttccagaccaccaaggacagcgtgcagctgaaggagcacctggacagactgatgaacctgcccctgcacagcgtgaagatggagccctgctacaccaaggtgaacctgctgcacgagagactgcaggacctgaagagcagattcagattcccccacatcgacctggtggtgcagagaacccagaactacatgcaggagctgatggagaacgccgtgttcaccttcgagcagctgctgagcccccacctgcagggcgaggccagcaagaccgccgtggccatcgagaaggtgaagctgagagtgctgaagcagtacgactacgacagcagcaccatcagaaagaagatcttccaggaggccctggtgcagatcaccctgcccaccgtgcagaaggccctggccagcacctgcaagcccgagctgcagaagtacgagcagttcatcttcgccgaccacaccaacatgatccacgtggagaacgtgtacgaggagatcctgcaccagatcctgctggacgagaccctgaaggtgatcaaggaggccgccatcctgaagaagcacaacctgttcgaggacaacatggccctgcccagcgagagcgtgagcagcctgaccgacctgaagccccccaccggcagcaaccaggccagccccgccagaagagccagcgccatcctgcccggcgtgctgggcagcgagaccctgagcaacgaggtgttccaggagagcgaggaggagaagcagcccgaggtgcccagcagcctggccaagggcgagagcctgagcctgcccggccccagccccccccccgacggcaccgagcaggtgatcatcagcagagtggacgaccccgtggtgaaccccgtggccaccgaggacaccgccggcctgcccggcacctgcagcagcgagctggagttcggcggcaccctggaggacgaggagcccgcccaggaggagcccgagcccatcaccgccagcggcagcctgaaggccctgagaaagctgctgaccgccagcgtggaggtgcccgtggacagcgcccccgtgatggaggaggacaccaacggcgagagccacgtgccccaggagaacgaggaggaggaggagaaggagcccagccaggccgccgccatccaccccgacaactgcgaggagagcgaggtgagcgagagagaggcccagcccccctgccccgaggcccacggcgaggagctgggcggcttccccgaggtgggcagccccgccagcccccccgccagcggcggcctgaccgaggagcccctgggccccatggagggcgagctgcccggcgaggcctgcaccctgaccgcccacgagggcagaggcggcaagtgcaccgaggagggcgacgccagccagcaggagggctgcaccctgggcagcgaccccatctgcctgagcgagagccaggtgagcgaggagcaggaggagatgggcggccagagcagcgccgcccaggccaccgccagcgtgaacgccgaggagatcaaggtggccagaatccacgagtgccagtgggtggtggaggacgcccccaaccccgacgtgctgctgagccacaaggacgacgtgaaggagggcgagggcggccaggagagcttccccgagctgcccagcgaggagtag

SEQ ID NO: 18128 - DNA, 303 bp, Artificial Sequence
  Description of Artificial Sequence: Synthetic coding sequence
tgagccgtggccatcgagaaggtgaagctgagagtgctgaagcagtacgactacgacagcagcaccatcagaaagaagatcttccaggaggccctggtgcagatcaccctgcccaccgtgcagaaggccctggccagcacctgcaagcccgagctgcagaagtacgagcagttcatcttcgccgaccacaccaacatgatccacgtggagaacgtgtacgaggagatcctgcaccagatcctgctggacgagaccctgaagggcgcctacatccccatcaagtgcagcagcctgaagagctag

SEQ ID NO: 18129 - DNA, 1632 bp, Artificial Sequence
  Description of Artificial Sequence: Synthetic coding sequence
atggccagcggcggcggcggcggcaacaccggcgccggcggcggccccggcatgggcctgagcctgggcctgggcctgggcctgagcctgggcatgagcgaggccaccagcgaggccgaggaggaggccgccaccgccgaggccgtgggcagactggccaccaccctgtggctgagactgagaggctgggaggccgtgctggccgccgcccagagactgctggtgtgggagaagcccctgcacagcctggtgaccgccgccgccctgaacggcctgttctggctgctgagcagcagcagcctgagacccttcttcctgctgagcgtgagcctgctggcctacttcctgctggacctgtggcagcccagattcctgcccgacgtgagcgccagcagccccgaggagccccacagcgacagcgagggcgccggcagcggcgccagaccccacctgctgagcgtgcccgagctgtgcagatacctggccgagagctggctgaccttccagatccacctgcaggagctgctgcagtacaagagacagaaccccgcccagttctgcgtgagagtgtgcagcggctgcgccgtgctggccgtgctgggccactacgtgcccggcatcatgatcagctacatcgtgctgctgagcatcctgctgtggcccctggtggtgtaccacgagctgatccagagaatgtacaccagactggagcccctgctgatgcagctggactacagcatgaaggccgaggccaacgccctgcaccacaagcacgacaagagaaagagacagggcaagaacgccccccccggcggcgacgagcccctggccgagaccgagagcgagagcgaggccgagctggccggcttcagccccgtggtggacgtgaagaagaccgccctggccctggccatcaccgacagcgagctgagcgacgaggaggccagcatcctggagagcggcggcttcagcgtgagcagagccaccaccccccagctgaccgacgtgagcgaggacctggaccagcagagcctgcccagcgagcccgaggagaccctgagcagagacctgggcgagggcgaggagggcgagctggccccccccgaggacctgctgggcagaccccaggccctgagcagacaggccctggacagcgaggaggaggaggaggacgtggccgccaaggagaccctgctgagactgagcagccccctgcacttcgtgaacacccacttcaacggcgccggcagcccccccgacggcgtgaagtgcagccccggcggccccgtggagaccctgagccccgagaccgtgagcggcggcctgaccgccctgcccggcaccctgagcccccccctgtgcctggtgggcagcgaccccgcccccagccccagcatcctgccccccgtgccccaggacagcccccagcccctgcccgcccccgaggaggaggaggccctgaccaccgaggacttcgagctgctggaccagggcgagctggagcagctgaacgccgagctgggcctggagcccgagaccccccccaagccccccgacgccccccccctgggccccgacatccacagcctggtgcagagcgaccaggaggcccaggccgtggccgagccctag

SEQ ID NO: 18130 - DNA, 906 bp, Artificial Sequence
  Description of Artificial Sequence: Synthetic coding sequence
atgatcagctacatcgtgctgctgagcatcctgctgtggcccctggtggtgtaccacgagctgatccagagaatgtacaccagactggagcccctgctgatgcagctggactacagcatgaaggccgaggccaacgccctgcaccacaagcacgacaagagaaagagacagggcaagaacgccccccccggcggcgacgagcccctggccgagaccgagagcgagagcgaggccgagctggccggcttcagccccgtggtggacgtgaagaagaccgccctggccctggccatcaccgacagcgagctgagcgacgaggaggccagcatcctggagagcggcggcttcagcgtgagcagagccaccaccccccagctgaccgacgtgagcgaggacctggaccagcagagcctgcccagcgagcccgaggagaccctgagcagagacctgggcgagggcgaggagggcgagctggccccccccgaggacctgctgggcagaccccaggccctgagcagacaggccctggacagcgaggaggaggaggaggacgtggccgccaaggagaccctgctgagactgagcagccccctgcacttcgtgaacacccacttcaacggcgccggcagcccccccgacggcgtgaagtgcagccccggcggccccgtggagaccctgagccccgagaccgacagcccccagcccctgcccgcccccgaggaggaggaggccctgaccaccgaggacttcgagctgctggaccagggcgagctggagcagctgaacgccgagctgggcctggagcccgagaccccccccaagccccccgacgccccccccctgggccccgacatccacagcctggtgcagagcgaccaggaggcccaggccgtggccgagccctag

SEQ ID NO: 18131 - DNA, 1401 bp, Artificial Sequence
  Description of Artificial Sequence: Synthetic coding sequence
atggccgaggccgagggcgtgcccaccacccccggccccgccagcggcagcaccttcagaggcagaagagacgtgagcggcagctgggagagagaccagcaggtggaggccgcccagagagccctggtggaggtgctgggcccctacgagcccctgctgagcagagtgcaggccgccctggtgtgggagagacccgccagaagcgccctgtggtgcctgggcctgaacgccgccttctggttcttcgccctgaccagcctgagactggtgttcctgctggccttcggcctgatgatcatcgtgtgcatcgaccagtggaagaacaagatctggcccgagatcaaggtgcccagacccgacgccctggacaacgagagctggggcttcgtgcaccccagactgctgagcgtgcccgagctgtgccaccacgtggccgaggtgtgggtgagcggcaccatcttcatcagaaacgtgctgctgttcaagaagcagaaccccggcaagttctgcctgctgagctgcggcatcctgaccttcctggccgtgctgggcagatacgtgcccggcctgctgctgagctacctgatgctggtgaccgtgatgatgtggcccctggccgtgtaccacagactgtgggacagagcctacgtgagactgaagcccgccctgcagagactggacttcagcgtgagaggctacatgatgagcaagcagagagagagacagctgagaagaagagccctgcaccccgagagagccatggacaaccacagcgacagcgaggaggagctggccgccttctgcccccagctggacgacagcaccgtggccagagagctggccatcaccgacagcgagcacagcgacgccgaggtgagctgcaccgacaacggcaccttcaacctgagcagaggccagacccccctgaccgagggcagcgaggacctggacggccacagcgaccccgaggagagcttcgccagagacctgcccgacttccccagcatcaacatggaccccgccggcctggacgacgaggacgacaccagcatcggcatgcccagcctgatgtacagaagcccccccggcgccgaggagccccaggccccccccgccagcagagacgaggccgccctgcccgagctgctgctgggcgccctgcccgtgggcagcaacctgaccagcaacctggccagcctggtgagccagggcatgatccagctggccctgagcggcgccagccagcccggccccagcggcgcccccgcccagagagccaccagaggcttcctgagaagccccagcagcgacctggacaccgacgccgagggcgacgacttcgagctgctggaccagagcgagctgagccagctggaccccgccagcagcagaagccactag

SEQ ID NO: 18132 - DNA, 816 bp, Artificial Sequence
  Description of Artificial Sequence: Synthetic coding sequence
atgctggtgaccgtgatgatgtggcccctggccgtgtaccacagactgtgggacagagcctacgtgagactgaagcccgccctgcagagactggacttcagcgtgagaggctacatgatgagcaagcagagagagagacagctgagaagaagagccctgcaccccgagagagccatggacaaccacagcgacagcgaggaggagctggccgccttctgcccccagctggacgacagcaccgtggccagagagctggccatcaccgacagcgagcacagcgacgccgaggtgagctgcaccgacaacggcaccttcaacctgagcagaggccagacccccctgaccgagggcagcgaggacctggacggccacagcgaccccgaggagagcttcgccagagacctgcccgacttccccagcatcaacatggaccccgccggcctggacgacgaggacgacaccagcatcggcatgcccagcctgatgtacagaagcccccccggcgccgaggagccccaggccccccccgccagcagagacgaggccgccctgcccgagctgctgctgggcgccctgcccgtgggcagcaacctgaccagcaacctggccagcctggtgagccagggcatgatccagctggccctgagcggcgccagccagcccggccccagcggcgcccccgcccagagagccaccagaggcttcctgagaagccccagcagcgacctggacaccgacgccgagggcgacgacttcgagctgctggaccagagcgagctgagccagctggaccccgccagcagcagaagccactag

SEQ ID NO: 18133 - DNA, 3960 bp, Artificial Sequence
  Description of Artificial Sequence: Synthetic coding sequence
atgaccgaggtgcaggccatggtggagttcagcgtggagctgaacaagttctacaacgtggacctgttccagagaggcttctaccagatcagagccagcatgaagatccccagcagaatcccccacagagtggaggccagcctgctgcacgccaccggcatgaccctggccttccccgccagcgtgcacgacagcctgatctgcagcaagaccttccagatcctgtacaagaacgaggaggtggtgctgaacgacgtgatgatcttcaaggtgaagatgctgctggacgagagaaagatcgaggagaccctggaggagatgaacttcctgctgagcctggacctgcacttcaccgacggcgactacagcgccgacgacctgaacgccctgcagctgatcagcagcagaaccctgaagctgcacttcagcccccacagaggcctgcaccaccacgtgaacgtgatgttcgactacttccacctgagcgtggtgagcgtgaccgtgcacgccagcctggtggccctgcaccagcccctgatcagcttccccagacccgtgaagaccacctggctgaacagaaacgcccccgcccagaacaaggacagcgtgatccccaccctggagagcgtggtgttcggcatcaactacaccaagcagctgagccccgacggctgcagcttcatcatcgccgacagcttcctgcaccacgcctacagattccactacaccctgtgcgccaccctgctgctggccttcaagggcctgcacagctacttcatcaccgtgaccgaggagatccccagctgccagaagctggagctggaggagatggacgtggaggccagactgaccgagctgtgcgaggaggtgaagaagatcgagaaccccgacgagctggccgagctgatcaacatgaacctggcccagctgtgcagcctgctgatggccctgtggggccagttcctggaggtgatcaccctgcacgaggagctgagaatcctgctggcccaggagcaccacaccctgagagtgagaagattcagcgaggccttcttctgcttcgagcaccccagagaggccgccatcgcctaccaggagctgcacgcccagagccacctgcagatgtgcaccgccatcaagaacaccagcttctgcagcagcctgccccccctgcccatcgagtgcagcgagctggacggcgacctgaacagcctgcccatcatcttcgaggacagatacctggacagcgtgaccgagggcaagctggacatcagccaggacgacagcgagatcacccagatggagcacaacctggccagcagaagaagcagcgacgactgccacgaccaccagaccacccccagcctgggcgtgagaaccatcgagatcaagcccagcaacaaggaccccttcagcggcgagaacatcaccgtgaagctgggcccctggaccgagctgagacaggaggagatcctggtggacaacctgctgcccaacttcgagagcctggagagcaacggcaagagcaagagcatcgagatcaccttcgagaaggaggccctgcaggaggccaagtgcctgagcatcggcgagagcctgaccaagctgagaagcaacctgcccgcccccagcaccaaggagtaccacgtggtggtgagcggcgacaccatcaagctgcccgacatcagcgccacctacgccagcagcagattcagcgacagcggcgtggagagcgagcccagcagcttcgccacccaccccaacaccgacctggtgttcgagaccgtgcagggccagggcccctgcaacagcgagagactgttcccccagctgctgatgaagcccgactacaacgtgaagttcagcctgggcaaccactgcaccgagagcaccagcgccatcagcgagatccagagcagcctgaccagcatcaacagcctgcccagcgacgacgagctgagccccgacgagaacagcaagaagagcgtggtgcccgagtgccacctgaacgacagcaagaccgtgctgaacctgggcaccaccgacctgcccaagtgcgacgacaccaagaagagcagcatcaccctgcagcagcagagcgtggtgttcagcggcaacctggacaacgagaccgtggccatccacagcctgaacagcagcatcaaggaccccctgcagttcgtgttcagcgacgaggagaccagcagcgacgtgaagagcagctgcagcagcaagcccaacctggacaccatgtgcaagggcttccagagccccgacaagagcaacaacagcaccggcaccgccatcaccctgaacagcaagctgatctgcctgggcaccccctgcgtgatcagcggcagcatcagcagcaacaccgacgtgagcgaggacagaaccatgaagaagaacagcgacgtgctgaacctgacccagatgtacagcgagatccccaccgtggagagcgagacccacctgggcaccagcgaccccttcagcgccagcaccgacatcgtgaagcagggcctggtggagaactacttcggcagccagagcagcaccgacatcagcgacacctgcgccgtgagctacagcaacgccctgagcccccagaaggagaccagcgagaaggagatcagcaacctgcagcaggagcaggacaaggaggacgaggaggaggagcaggaccagcagatggtgcagaacggctactacgaggagaccgactacagcgccctggacggcaccatcaacgcccactacaccagcagagacgagctgatggaggagagactgaccaagagcgagaagatcaacagcgactacctgagagacggcatcaacatgcccaccgtgtgcaccagcggctgcctgagcttccccagcgcccccagagagagcccctgcaacgtgaagtacagcagcaagagcaagttcgacgccatcaccaagcagcccagcagcaccagctacaacttcaccagcagcatcagctggtacgagagcagccccaagccccagatccaggccttcctgcaggccaaggaggagctgaagctgctgaagctgcccggcttcatgtacagcgaggtgcccctgctggccagcagcgtgccctacttcagcgtggaggaggaggacggcagcgaggacggcgtgcacctgatcgtgtgcgtgcacggcctggacggcaacagcgccgacctgagactggtgaagacctacatcgagctgggcctgcccggcggcagaatcgacttcctgatgagcgagagaaaccagaacgacaccttcgccgacttcgacagcatgaccgacagactgctggacgagatcatccagtacatccagatctacagcctgaccgtgagcaagatcagcttcatcggccacagcctgggcaacctgatcatcagaagcgtgctgaccagacccagattcaagtactacctgaacaagctgcacaccttcctgagcctgagcggcccccacctgggcaccctgtacaacagcagcgccctggtgaacaccggcctgtggttcatgcagaagtggaagaagagcggcagcctgctgcagctgacctgcagagaccacagcgaccccagacagaccttcctgtacaagctgagcaacaaggccggcctgcactacttcaagaacgtggtgctggtgggcagcctgcaggacagatacgtgccctaccacagcgccagaatcgagatgtgcaagaccgccctgaaggacaagcagagcggccagatctacagcgagatgatccacaacctgctgagacccgtgctgcagagcaaggactgcaacctggtgagatacaacgtgatcaacgccctgcccaacaccgccgacagcctgatcggcagagccgcccacatcgccgtgctggacagcgagatcttcctggagaagttcttcctggtggccgccctgaagtacttccagtag

SEQ ID NO: 18134 - DNA, 3909 bp, Artificial Sequence
  Description of Artificial Sequence: Synthetic coding sequence
atgaccgaggtgcaggccatggtggagttcagcgtggagctgaacaagttctacaacgtggacctgttccagagaggcaagaccttccagatcctgtacaagaacgaggaggtggtgctgaacgacgtgatgatcttcaaggtgaagatgctgctggacgagagaaagatcgaggagaccctggaggagatgaacttcctgctgagcctggacctgcacttcaccgacggcgactacagcgccgacgacctgaacgccctgcagctgatcagcagcagaaccctgaagctgcacttcagcccccacagaggcctgcaccaccacgtgaacgtgatgttcgactacttccacctgagcgtggtgagcgtgaccgtgcacgccagcctggtggccctgcaccagcccctgatcagcttccccagacccgtgaagaccacctggctgaacagaaacgcccccgcccagaacaaggacagcgtgatccccaccctggagagcgtggtgttcggcatcaactacaccaagcagctgagccccgacggctgcagcttcatcatcgccgacagcttcctgcaccacgcctacagattccactacaccctgtgcgccaccctgctgctggccttcaagggcctgcacagctacttcatcaccgtgaccgaggagatccccagctgccagaagctggagctggccaaggccaacatgcagctgctgtacgagagactgctgagaagaaagcagctgagaacccagaaggacaaccacctggaggagatggacgtggaggccagactgaccgagctgtgcgaggaggtgaagaagatcgagaaccccgacgagctggccgagctgatcaacatgaacctggcccagctgtgcagcctgctgatggccctgtggggccagttcctggaggtgatcaccctgcacgaggagctgagaatcctgctggcccaggagcaccacaccctgagagtgagaagattcagcgaggccttcttctgcttcgagcaccccagagaggccgccatcgcctaccaggagctgcacgcccagagccacctgcagatgtgcaccgccatcaagaacaccagcttctgcagcagcctgccccccctgcccatcgagtgcagcgagctggacggcgacctgaacagcctgcccatcatcttcgaggacagatacctggacagcgtgaccgagggcaagctggacatcagccaggacgacagcgagatcacccagatggagcacaacctggccagcagaagaagcagcgacgactgccacgaccaccagaccacccccagcctgggcgtgagaaccatcgagatcaagcccagcaacaaggaccccttcagcggcgagaacatcaccgtgaagctgggcccctggaccgagctgagacaggaggagatcctggtggacaacctgctgcccaacttcgagagcctggagagcaacggcaagagcaagagcatcgagatcaccttcgagaaggaggccctgcaggaggccaagtgcctgagcatcggcgagagcctgaccaagctgagaagcaacctgcccgcccccagcaccaaggagtaccacgtggtggtgagcggcgacaccatcaagctgcccgacatcagcgccacctacgccagcagcagattcagcgacagcggcgtggagagcgagcccagcagcttcgccacccaccccaacaccgacctggtgttcgagaccgtgcagggccagggcccctgcaacagcgagagactgttcccccagctgctgatgaagcccgactacaacgtgaagttcagcctgggcaaccactgcaccgagagcaccagcgccatcagcgagatccagagcagcctgaccagcatcaacagcctgcccagcgacgacgagctgagccccgacgagaacagcaagaagagcgtggtgcccgagtgccacctgaacgacagcaagaccgtgctgaacctgggcaccaccgacctgcccaagtgcgacgacaccaagaagagcagcatcaccctgcagcagcagagcgtggtgttcagcggcaacctggacaacgagaccgtggccatccacagcctgaacagcagcatcaaggaccccctgcagttcgtgttcagcgacgaggagaccagcagcgacgtgaagagcagctgcagcagcaagcccaacctggacaccatgtgcaagggcttccagagccccgacaagagcaacaacagcaccggcaccgccatcaccctgaacagcaagctgatctgcctgggcaccccctgcgtgatcagcggcagcatcagcagcaacaccgacgtgagcgaggacagaaccatgaagaagaacagcgacgtgctgaacctgacccagatgtacagcgagatccccaccgtggagagcgagacccacctgggcaccagcgaccccttcagcgccagcaccgacatcgtgaagcagggcctggtggagaactacttcggcagccagagcagcaccgacatcagcgacacctgcgccgtgagctacagcaacgccctgagcccccagaaggagaccagcgagaaggagatcagcaacctgcagcaggagcaggacaaggaggacgaggaggaggagcaggaccagcagatggtgcagaacggctactacgaggagaccgactacagcgccctggacggcaccatcaacgcccactacaccagcagagacgagctgatggaggagagactgaccaagagcgagaagatcaacagcgactacctgagagacggcatcaacatgcccaccgtgtgcaccagcggctgcctgagcttccccagcgcccccagagagagcccctgcaacgtgaagtacagcagcaagagcaagttcgacgccatcaccaagcagcccagcagcaccagctacaacttcaccagcagcatcagctggtacgagagcagccccaagccccagatccaggccttcctgcaggccaaggaggagctgaagctgctgaagctgcccggcttcatgtacagcgaggtgcccctgctggccagcagcgtgccctacttcagcgtggaggaggaggacggcagcgaggacggcgtgcacctgatcgtgtgcgtgcacggcctggacggcaacagcgccgacctgagactggtgaagacctacatcgagctgggcctgcccggcggcagaatcgacttcctgatgagcgagagaaaccagaacgacaccttcgccgacttcgacagcatgaccgacagactgctggacgagatcatccagtacatccagatctacagcctgaccgtgagcaagatcagcttcatcggccacagcctgggcaacctgatcatcagaagcgtgctgaccagacccagattcaagtactacctgaacaagctgcacaccttcctgagcctgagcggcccccacctgggcaccctgtacaacagcagcgccctggtgaacaccggcctgtggttcatgcagaagtggaagaagagcggcagcctgctgcagctgacctgcagagaccacagcgaccccagacagaccttcctgtacaagctgagcaacaaggccggcctgcactacttcaagaacgtggtgctggtgggcagcctgcaggacagatacgtgccctaccacagcgccagaatcgagatgtgcaagaccgccctgaaggacaagcagagcggccagatctacagcgagatgatccacaacctgctgagacccgtgctgcagagcaaggactgcaacctggtgagatacaacgtgatcaacgccctgcccaacaccgccgacagcctgatcggcagagccgcccacatcgccgtgctggacagcgagatcttcctggagaagttcttcctggtggccgccctgaagtacttccagtag

SEQ ID NO: 18135 - DNA, 4548 bp, Artificial Sequence
  Description of Artificial Sequence: Synthetic coding sequence
atgaccgaggtgcaggccatggtggagttcagcgtggagctgaacaagttctacaacgtggacctgttccagagaggcttctaccagatcagagccagcatgaagatccccagcagaatcccccacagagtggaggccagcctgctgcacgccaccggcatgaccctggccttccccgccagcgtgcacgacagcctgatctgcagcaagaccttccagatcctgtacaagaacgaggaggtggtgctgaacgacgtgatgatcttcaaggtgaagatgctgctggacgagagaaagatcgaggagaccctggaggagatgaacttcctgctgagcctggacctgcacttcaccgacggcgactacagcgccgacgacctgaacgccctgcagctgatcagcagcagaaccctgaagctgcacttcagcccccacagaggcctgcaccaccacgtgaacgtgatgttcgactacttccacctgagcgtggtgagcgtgaccgtgcacgccagcctggtggccctgcaccagcccctgatcagcttccccagacccgtgaagaccacctggctgaacagaaacgcccccgcccagaacaaggacagcgtgatccccaccctggagagcgtggtgttcggcatcaactacaccaagcagctgagccccgacggctgcagcttcatcatcgccgacagcttcctgcaccacgcctacagattccactacaccctgtgcgccaccctgctgctggccttcaagggcctgcacagctacttcatcaccgtgaccgaggagatccccagctgccagaagctggagctggaggagatggacgtggaggccagactgaccgagctgtgcgaggaggtgaagaagatcgagaaccccgacgagctggccgagctgatcaacatgaacctggcccagctgtgcagcctgctgatggccctgtggggccagttcctggaggtgatcaccctgcacgaggagctgagaatcctgctggcccaggagcaccacaccctgagagtgagaagattcagcgaggccttcttctgcttcgagcaccccagagaggccgccatcgcctaccaggagctgcacgcccagagccacctgcagatgtgcaccgccatcaagaacaccagcttctgcagcagcctgccccccctgcccatcgagtgcagcgagctggacggcgacctgaacagcctgcccatcatcttcgaggacagatacctggacagcgtgaccgaggacctggacgccccctggatgggcatccagaacctgcagagaagcgagagcagcaagatggacaagtacgagaccgaggagagcagcgtggccggcctgagcagccccgagctgaaggtgagacccgccggcgccagcagcatctggtacaccgagggcgagaagcagctgaccaagagcctgaagggcaagaacgaggagagcaacaagagcaaggtgaaggtgaccaagctgatgaagaccatgaagagcgagaacaccaagaagctgatcaagcagaacagcaaggacagcgtggtgctggtgggctacaagtgcctgaagagcaccgccagcaacgacctgatcaagtgcttcgagggcaaccccagccacagccagaaggagggcctggaccccaccatctgcggctacaacttcgaccccaagacctacatgagacagaccagccagaaggaggccagctgcctgcccaccaacaccgagagaaccgagcagaagagccccgacatcgagaacgtgcagcccgaccagttcgaccccctgaacagcggcaacctgaacctgtgcgccaacctgagcatcagcggcaagctggacatcagccaggacgacagcgagatcacccagatggagcacaacctggccagcagaagaagcagcgacgactgccacgaccaccagaccacccccagcctgggcgtgagaaccatcgagatcaagcccagcaacaaggaccccttcagcggcgagaacatcaccgtgaagctgggcccctggaccgagctgagacaggaggagatcctggtggacaacctgctgcccaacttcgagagcctggagagcaacggcaagagcaagagcatcgagatcaccttcgagaaggaggccctgcaggaggccaagtgcctgagcatcggcgagagcctgaccaagctgagaagcaacctgcccgcccccagcaccaaggagtaccacgtggtggtgagcggcgacaccatcaagctgcccgacatcagcgccacctacgccagcagcagattcagcgacagcggcgtggagagcgagcccagcagcttcgccacccaccccaacaccgacctggtgttcgagaccgtgcagggccagggcccctgcaacagcgagagactgttcccccagctgctgatgaagcccgactacaacgtgaagttcagcctgggcaaccactgcaccgagagcaccagcgccatcagcgagatccagagcagcctgaccagcatcaacagcctgcccagcgacgacgagctgagccccgacgagaacagcaagaagagcgtggtgcccgagtgccacctgaacgacagcaagaccgtgctgaacctgggcaccaccgacctgcccaagtgcgacgacaccaagaagagcagcatcaccctgcagcagcagagcgtggtgttcagcggcaacctggacaacgagaccgtggccatccacagcctgaacagcagcatcaaggaccccctgcagttcgtgttcagcgacgaggagaccagcagcgacgtgaagagcagctgcagcagcaagcccaacctggacaccatgtgcaagggcttccagagccccgacaagagcaacaacagcaccggcaccgccatcaccctgaacagcaagctgatctgcctgggcaccccctgcgtgatcagcggcagcatcagcagcaacaccgacgtgagcgaggacagaaccatgaagaagaacagcgacgtgctgaacctgacccagatgtacagcgagatccccaccgtggagagcgagacccacctgggcaccagcgaccccttcagcgccagcaccgacatcgtgaagcagggcctggtggagaactacttcggcagccagagcagcaccgacatcagcgacacctgcgccgtgagctacagcaacgccctgagcccccagaaggagaccagcgagaaggagatcagcaacctgcagcaggagcaggacaaggaggacgaggaggaggagcaggaccagcagatggtgcagaacggctactacgaggagaccgactacagcgccctggacggcaccatcaacgcccactacaccagcagagacgagctgatggaggagagactgaccaagagcgagaagatcaacagcgactacctgagagacggcatcaacatgcccaccgtgtgcaccagcggctgcctgagcttccccagcgcccccagagagagcccctgcaacgtgaagtacagcagcaagagcaagttcgacgccatcaccaagcagcccagcagcaccagctacaacttcaccagcagcatcagctggtacgagagcagccccaagccccagatccaggccttcctgcaggccaaggaggagctgaagctgctgaagctgcccggcttcatgtacagcgaggtgcccctgctggccagcagcgtgccctacttcagcgtggaggaggaggacggcagcgaggacggcgtgcacctgatcgtgtgcgtgcacggcctggacggcaacagcgccgacctgagactggtgaagacctacatcgagctgggcctgcccggcggcagaatcgacttcctgatgagcgagagaaaccagaacgacaccttcgccgacttcgacagcatgaccgacagactgctggacgagatcatccagtacatccagatctacagcctgaccgtgagcaagatcagcttcatcggccacagcctgggcaacctgatcatcagaagcgtgctgaccagacccagattcaagtactacctgaacaagctgcacaccttcctgagcctgagcggcccccacctgggcaccctgtacaacagcagcgccctggtgaacaccggcctgtggttcatgcagaagtggaagaagagcggcagcctgctgcagctgacctgcagagaccacagcgaccccagacagaccttcctgtacaagctgagcaacaaggccggcctgcactacttcaagaacgtggtgctggtgggcagcctgcaggacagatacgtgccctaccacagcgccagaatcgagatgtgcaagaccgccctgaaggacaagcagagcggccagatctacagcgagatgatccacaacctgctgagacccgtgctgcagagcaaggactgcaacctggtgagatacaacgtgatcaacgccctgcccaacaccgccgacagcctgatcggcagagccgcccacatcgccgtgctggacagcgagatcttcctggagaagttcttcctggtggccgccctgaagtacttccagtag

SEQ ID NO: 18136 - DNA, 3909 bp, Artificial Sequence; identical to SEQ ID NO: 18134
  Description of Artificial Sequence: Synthetic coding sequence

SEQ ID NO: 18137 - DNA, 153 bp, Artificial Sequence
  Description of Artificial Sequence: Synthetic coding sequence
atgaccgaggtgcaggccatggtggagttcagcgtggagctgaacaagttctacaacgtggacctgttccagagaggcttctaccagatcagagccagcatgaagatccccagcagaatcccccacagagtggaggccagcctgctgcactag

SEQ ID NO: 18138 - DNA, 96 bp, Artificial Sequence
  Description of Artificial Sequence: Synthetic coding sequence
atgaccgaggtgcaggccatggtggagttcagcgtggagctgaacaagttctacaacgtggacctgttccagagaggcttctaccagatcagatag

SEQ ID NO: 18139 - DNA, 1518 bp, Artificial Sequence
  Description of Artificial Sequence: Synthetic coding sequence
atgaccgaggtgcaggccatggtggagttcagcgtggagctgaacaagttctacaacgtggacctgttccagagaggcttctaccagatcagagccagcatgaagatccccagcagaatcccccacagagtggaggccagcctgctgcacgccaccggcatgaccctggccttccccgccagcgtgcacgacagcctgatctgcagcaagaccttccagatcctgtacaagaacgaggaggtggtgctgaacgacgtgatgatcttcaaggtgaagatgctgctggacgagagaaagatcgaggagaccctggaggagatgaacttcctgctgagcctggacctgcacttcaccgacggcgactacagcgccgacgacctgaacgccctgcagctgatcagcagcagaaccctgaagctgcacttcagcccccacagaggcctgcaccaccacgtgaacgtgatgttcgactacttccacctgagcgtggtgagcgtgaccgtgcacgccagcctggtggccctgcaccagcccctgatcagcttccccagacccgtgaagaccacctggctgaacagaaacgcccccgcccagaacaaggacagcgtgatccccaccctggagagcgtggtgttcggcatcaactacaccaagcagctgagccccgacggctgcagcttcatcatcgccgacagcttcctgcaccacgcctacagattccactacaccctgtgcgccaccctgctgctggccttcaagggcctgcacagctacttcatcaccgtgaccgaggagatccccagctgccagaagctggagctggaggagatggacgtggaggccagactgaccgagctgtgcgaggaggtgaagaagatcgagaaccccgacgagctggccgagctgatcaacatgaacctggcccagctgtgcagcctgctgatggccctgtggggccagttcctggaggtgatcaccctgcacgaggagctgagaatcctgctggcccaggagcaccacaccctgagagtgagaagattcagcgaggccttcttctgcttcgagcaccccagagaggccgccatcgcctaccaggagctgcacgcccagagccacctgcagatgtgcaccgccatcaagaacaccagcttctgcagcagcctgccccccctgcccatcgagtgcagcgagctggacggcgacctgaacagcctgcccatcatcttcgaggacagatacctggacagcgtgaccgaggacctggacgccccctggatgggcatccagaacctgcagagaagcgagagcagcaagatggacaagtacgagaccgaggagagcagcgtggccggcctgagcagccccgagctgaaggtgagacccgccggcgccagcagcatctggtacaccgagggcgagaagcagctgaccaagagcctgaagggcaagaacgaggagagcaacaagagcaaggtgaaggtgaccaagctgatgaagaccatgaagagcgagaactag

SEQ ID NO: 18140 - DNA, 462 bp, Artificial Sequence
  Description of Artificial Sequence: Synthetic coding sequence
atgagcgagatccagggcaccgtggagttcagcgtggagctgcacaagttctacaacgtggacctgttccagagaggctactaccagatcagagtgaccctgaaggtgagcagcagaatcccccacagactgagcgccagcatcgccggccagaccgagagcagcagcctgcacagcgcctgcgtgcacgacagcaccgtgcacagcagagtgttccagatcctgtacagaaacgaggaggtgcccatcaacgacgccgtggtgttcagagtgcacctgctgctgggcggcgagagaatggaggacgccctgagcgaggtggacttccagctgaaggtggacctgcacttcaccgacagcgagcagcagctgagagacgtggccggcgcccccatggtgagcagcagaaccctgggcctgcacttccaccccagaaacggcctgcaccaccaggtgccctag

SEQ ID NO: 18141 - DNA, 4221 bp, Artificial Sequence
  Description of Artificial Sequence: Synthetic coding sequence
atgagcgagatccagggcaccgtggagttcagcgtggagctgcacaagttctacaacgtggacctgttccagagaggctactaccagatcagagtgaccctgaaggtgagcagcagaatcccccacagactgagcgccagcatcgccggccagaccgagagcagcagcctgcacagcgcctgcgtgcacgacagcaccgtgcacagcagagtgttccagatcctgtacagaaacgaggaggtgcccatcaacgacgccgtggtgttcagagtgcacctgctgctgggcggcgagagaatggaggacgccctgagcgaggtggacttccagctgaaggtggacctgcacttcaccgacagcgagcagcagctgagagacgtggccggcgcccccatggtgagcagcagaaccctgggcctgcacttccaccccagaaacggcctgcaccaccaggtgcccgtgatgttcgactacttccacctgagcgtgatcagcgtgaccgtgcacgccgccctggtggccctgcagcagcccctgatcagcttcaccagacccggcagaggcagctggctgggcaagggcggccccgacaccggccaggagcagagcatcatcagcctggagaacctggtgttcggcgccggctactgcaagcccaccagcagcgagggcagcttctacatcaccagcgagaactgcatgcagcacgcccacaagtggcacagagacctgtgcctgctgctgctgcacgcctacagaggcctgagactgcacttcctggtgatcatgagagacatccccgagctgccccacaccgagctggaggccctggccgtggaggagaccctgagccagctgtgcagcgagctgcagatgctgaacaaccccgagaagatcgccgagcagatcagcaaggacctggcctggctgaccagccacatgatgaccctgtggacccagttcctggacaccgtgaccctgcacagccaggtgaccacctacctgacccaggagcaccacaccctgagagtgagaagattcagcgaggccttcttctacatggagcaccagaagctggccgtgctgaccttccaggagaacctgatccagacccacagccagctgagcctggacatcagaaacagcgagtacctgaccagcatgccccccctgcccgccgagtgcctggacatcgacggcgactggaacaccctgcccgtgatcttcgaggacagatacgtggactgccccgccaccggccacaacctgagcgtgtaccccaacttcgacgtgcccgtgaccagccccaccatcatgaacctgaaggacaaggaggacaactgcatggtgaacagcaacctgagcttcagagaggacctggtgctgagcaccatcaagcccagccagatggacagcgacgaggaggtgatcagatgccccgagcccggcgagaacgtggccacccagaaccacatggacatgtgcagcgagagccaggtgtacatcagcatcggcgagttccagaacaaggccggcgtgcccgaggacgagtgctggaccggccagaccagcgacgccggcacctaccccgtggccgacgtggacaccagcagaagaagccccggccccgaggacggccaggcccccgtgctgacctacatcgacgtgaagagcagcaacaagaaccccagcagagccgagcccctggtggccttcaacgcccagcacgagagcagaagcagcagagacaagtacggcctggacagaaccggcctgagcaaggtggtggtgggcggcagccaccagaacgccatcagcagcgacaagaccaccctgcacgagctgagcaccctgggcaagggcatcgaccaggagggcaagatggtgctgctgagcctgaagctgacccccagcgagccctgcgaccccctgagcagcaccctgagagagcccctggacatcagaagcagcctgaaggacagccacaccgaggagcaggaggagctgagcgtgctgagcggcgtgatcaagagaagcagcagcatcatcagcgacagcggcatcgagagcgagcccagcagcgtggcctggagcgaggccagaagcagagccctggagctgcccagcgacagagaggtgctgcaccccttcgtgagaagacacgccctgcacagaaacagcctggagggcggccacaccgagagcaacaccagcctgcccagcggcatccaggccagcctgaccagcatcagcagcctgcccttcgaggaggacgagagagaggtggccctgaccaagctgaccaagagcgtgagcgccccccacatcagcagccccgaggaggccgccgaggacgccgacaccaagcagcaggacggcggcttcgccgagcccagcgacatgcacagcaagagccagggcagccccggcagctgcagccagctgtgcggcgacagcggcaccgacgccggcgccgaccaccccctggtggagatcgtgctggacgccgacaaccagcagggccccggctacatcgacatccccaagggcaagggcaagcagttcgacgcccagggccactgcctgcccgacggcagaaccgagaacacccccggcgtggagaccaagggcctgaacctgaagatccccagagtgatcgccctggagaaccccagaaccagaagcctgcacagagccctggaggagacccccaagggcatgcccaaggacctgaacgtgggccagcaggccctgagcaacagcggcatcagcgaggtggagggcctgagccagcaccaggtgcccgagctgagctgcaccagcgccgccgacgccatcaacagaaacagcaccggccagcagagccagagcggcagcccctgcatcatggacgacaccgccttcaacagaggcgtgaacgccttccccgaggccaagcacaaggccggcaccgtgtgccccaccgtgacccacagcgtgcacagccaggtgctgaagaaccaggagctgaaggccggcaccagcatcatgggcagccacctgaccagcgccgagaccttcaccctggacagcctgaaggccgtggaggtggtgaacctgagcgtgagctgcaccgccacctgcctgcccttcagcagcgtgcccaaggagacccccgccagagccggcttcagcagcaagcagaccctgttccccatcacccaccagcccctgggcagcttcggcgtggtgagcacccacagcagcaccctggacgaggaggtgagcgagagaatgttcagcttctaccaggccaaggagaagttcaagaaggagctgaagatcgagggcttcctgtacagcgacctgaccgtgctggccagcgacatcccctacttcccccccgaggaggaggaggagaacctggaggacggcatccacctggtggtgtgcgtgcacggcctggacggcaacagcgccgacctgagactggtgaagaccttcatcgagctgggcctgcccggcggcaagctggacttcctgatgagcgagaagaaccagatggacaccttcgccgacttcgacaccatgaccgacagactgctggacgagatcatccagcacatccagctgtacaacctgagcatcagcagaatcagcttcatcggccacagcctgggcaacatcatcatcagaagcgtgctgaccagacccagattcagatactacctgaacaagctgcacaccttcctgagcctgagcggcccccacctgggcaccctgtacaacaacagcaccctggtgagcaccggcctgtggctgatgcagaagctgaagaagagcggcagcctgctgcagctgaccttcagagacaacgccgacctgagaaagtgcttcctgtaccagctgagccagaagaccggcctgcagtacttcaagaacgtggtgctggtggccagcccccaggacagatacgtgcccttccacagcgccagaatcgagatgtgcaagaccgccctgaaggacagacacaccggccccgtgtacgccgagatgatcaacaacctgctgggccccctggtggaggccaaggactgcaccctgatcagacacaacgtgttccacgccctgcccaacaccgccaacaccctgatcggcagagccgcccacatcgccgtgctggacagcgagctgttcctggagaagttcttcctggtggccggcctgaactacttcaagtag

SEQ ID NO: 18142 - DNA, 207 bp, Artificial Sequence
  Description of Artificial Sequence: Synthetic coding sequence
atgagcgagatccagggcaccgtggagttcagcgtggagctgcacaagttctacaacgtggacctgttccagagaggctactaccagatcagagtgaccctgaaggtgagcagcagaatcccccacagactgagcgccagcatcgccggccagaccgaggtgctgaacatccacatgagcgagcaggagcccgcccagggcaagtag

SEQ ID NO: 18143 - DNA, 1197 bp, Artificial Sequence
  Description of Artificial Sequence: Synthetic coding sequence
atggtgtgcagagagcagctgagcaagaaccaggtgaagtgggtgttcgccggcatcacctgcgtgagcgtggtggtgatcgccgccatcgtgctggccatcaccctgagaagacccggctgcgagctggaggcctgcagccccgacgccgacatgctggactacctgctgagcctgggccagatcagcagaagagacgccctggaggtgacctggtaccacgccgccaacagcaagaaggccatgaccgccgccctgaacagcaacatcaccgtgctggaggccgacgtgaacgtggagggcctgggcaccgccaacgagaccggcgtgcccatcatggcccacccccccaccatctacagcgacaacaccctggagcagtggctggacgccgtgctgggcagcagccagaagggcatcaagctggacttcaagaacatcaaggccgtgggccccagcctggacctgctgagacagctgaccgaggagggcaaggtgagaagacccatctggatcaacgccgacatcctgaagggccccaacatgctgatcagcaccgaggtgaacgccacccagttcctggccctggtgcaggagaagtaccccaaggccaccctgagccccggctggaccaccttctacatgagcaccagccccaacagaacctacacccaggccatggtggagaagatgcacgagctggtgggcggcgtgccccagagagtgaccttccccgtgagaagcagcatggtgagagccgcctggccccacttcagctggctgctgagccagagcgagagatacagcctgaccctgtggcaggccgccagcgaccccatgagcgtggaggacctgctgtacgtgagagacaacaccgccgtgcaccaggtgtactacgacatcttcgagcccctgctgctgaccgacatgctggagctgtgccagggcctgtggcagcccgtgagcttccagatgcaggccatgctgctgggccacagcaccgccggcgccatcggcagactgctggccagcagccccagagccaccgtgaccgtggagcacaaccccgccggcggcgactacgccagcgtgagaaccgccctgctggccgccagagccgtggacagaaccagagtgtactacagactgccccagggctaccacaaggacctgctggcccacgtgggcagaaactag

SEQ ID NO: 18144 - DNA, 1758 bp, Artificial Sequence
  Description of Artificial Sequence: Synthetic coding sequence
atggtgtgcagagagcagctgagcaagaaccaggtgaagtgggtgttcgccggcatcacctgcgtgagcgtggtggtgatcgccgccatcgtgctggccatcaccctgagaagacccggctgcgagctggaggcctgcagccccgacgccgacatgctggactacctgctgagcctgggccagatcagcagaagagacgccctggaggtgacctggtaccacgccgccaacagcaagaaggccatgaccgccgccctgaacagcaacatcaccgtgctggaggccgacgtgaacgtggagggcctgggcaccgccaacgagaccggcgtgcccatcatggcccacccccccaccatctacagcgacaacaccctggagcagtggctggacgccgtgctgggcagcagccagaagggcatcaagctggacttcaagaacatcaaggccgtgggccccagcctggacctgctgagacagctgaccgaggagggcaaggtgagaagacccatctggatcaacgccgacatcctgaagggccccaacatgctgatcagcaccgaggtgaacgccacccagttcctggccctggtgcaggagaagtaccccaaggccaccctgagccccggctggaccaccttctacatgagcaccagccccaacagaacctacacccaggccatggtggagaagatgcacgagctggtgggcggcgtgccccagagagtgaccttccccgtgagaagcagcatggtgagagccgcctggccccacttcagctggctgctgagccagagcgagagatacagcctgaccctgtggcaggccgccagcgaccccatgagcgtggaggacctgctgtacgtgagagacaacaccgccgtgcaccaggtgtactacgacatcttcgagcccctgctgagccagttcaagcagctggccctgaacgccaccagaaagcccatgtactacaccggcggcagcctgatccccctgctgcagctgcccggcgacgacggcctgaacgtggagtggctggtgcccgacgtgcagggcagcggcaagaccgccaccatgaccctgcccgacaccgagggcatgatcctgctgaacaccggcctggagggcaccgtggccgagaaccccgtgcccatcgtgcacacccccagcggcaacatcctgaccctggagagctgcctgcagcagctggccacccaccccggccactggggcatccacctgcagatcgccgagcccgccgccctgagacccagcctggccctgctggccagactgagcagcctgggcctgctgcactggcccgtgtgggtgggcgccaagatcagccacggcagcttcagcgtgcccggccacgtggccggcagagagctgctgaccgccgtggccgaggtgttcccccacgtgaccgtggcccccggctggcccgaggaggtgctgggcagcggctacagagagcagctgctgaccgacatgctggagctgtgccagggcctgtggcagcccgtgagcttccagatgcaggccatgctgctgggccacagcaccgccggcgccatcggcagactgctggccagcagccccagagccaccgtgaccgtggagcacaaccccgccggcggcgactacgccagcgtgagaaccgccctgctggccgccagagccgtggacagaaccagagtgtactacagactgccccagggctaccacaaggacctgctggcccacgtgggcagaaactag

SEQ ID NO: 18145 - DNA, 936 bp, Artificial Sequence
  Description of Artificial Sequence: Synthetic coding sequence
atggtgtgcagagagcagctgagcaagaaccaggtgaagtgggtgttcgccggcatcacctgcgtgagcgtggtggtgatcgccgccatcgtgctggccatcaccctgagaagacccggctgcgagctggaggcctgcagccccgacgccgacatgctggactacctgctgagcctgggccagatcagcagaagagacgccctggaggtgacctggtaccacgccgccaacagcaagaaggccatgaccgccgccctgaacagcaacatcaccgtgctggaggccgacgtgaacgtggagggcctgggcaccgccaacgagaccggcgtgcccatcatggcccacccccccaccatctacagcgacaacaccctggagcagtggctggacgccgtgctgggcagcagccagaagggcatcaagctggacttcaagaacatcaaggccgtgggccccagcctggacctgctgagacagctgaccgaggagggcaaggtgagaagacccatctggatcaacgccgacatcctgaagggccccaacatgctgatcagcaccgaggtgaacgccacccagttcctggccctggtgcaggagaagtaccccaaggccaccctgagccccggctggaccaccttctacatgagcaccagccccaacagaacctacacccaggccatggtggagaagatgcacgagctggtgggcggcgtgccccagagagtgaccttccccgtgagaagcagcatggtgagagccgcctggccccacttcagctggctgctgagccagagcgagagatacagcctgaccctgtggcaggccgccagcgaccccatgagcgtggaggacctgctgtacgtgagagacaacaccgccgtgcaccaggtgtactacgacatcttcgagcccctgctgtgcagccagatctgctag

SEQ ID NO: 18146 - DNA, 1377 bp, Artificial Sequence
  Description of Artificial Sequence: Synthetic coding sequence
atgaccagaggcgcctggatgtgcagacagtacgacgacggcctgaagatctggctggccgcccccagagagaacgagaagcccttcatcgacagcgagagagcccagaagtggagactgagcctggccagcctgctgttcttcaccgtgctgctgagcgaccacctgtggttctgcgccgaggccaagctgaccagagccagagacaaggagcaccagcagcagcagagacagcagcagcagcagcagcagcagcagagacagagacagcagcagcagcagcagagaagacagcaggagcccagctggcccgccctgctggccagcatgggcgagagcagccccgccgcccaggcccacagactgctgagcgccagcagcagccccaccctgccccccagccccggcgacggcggcggcggcggcggcaagggcaacagaggcaaggacgacagaggcaaggccctgttcctgggcaacagcgccaagcccgtgtggagactggagacctgctacccccagggcgccagcagcggccagtgcttcaccgtggagaacgccgacgccgtgtgcgccagaaactggagcagaggcgccgccggcggcgacggccaggaggtgagaagcaagcaccccacccccctgtggaacctgagcgacttctacctgagcttctgcaacagctacaccctgtgggagctgttcagcggcctgagcagccccaacaccctgaactgcagcctggacgtggtgctgaaggagggcggcgagatgaccacctgcagacagtgcgtggaggcctaccaggactacgaccaccacgcccaggagaagtacgaggagttcgagagcgtgctgcacaagtacctgcagagcgaggagtacagcgtgaagagctgccccgaggactgcaagatcgtgtacaaggcctggctgtgcagccagtacttcgaggtgacccagttcaactgcagaaagaccatcccctgcaagcagtactgcctggaggtgcagaccagatgccccttcatcctgcccgacaacgacgaggtgatctacggcggcctgagcagcttcatctgcaccggcctgtacgagaccttcctgaccaacgacgagcccgagtgctgcgacgtgagaagagaggagaagagcaacaaccccagcaagggcaccgtggagaagagcggcagctgccacagaaccagcctgaccgtgagcagcgccaccagactgtgcaacagcagactgaagctgtgcgtgctggtgctgatcctgctgcacaccgtgctgaccgccagcgccgcccagaacaccgccggcctgagcttcggcggcatcaacaccctggaggagaacagcaccaacgaggagtag

SEQ ID NO: 18147 - DNA, 1419 bp, Artificial Sequence
  Description of Artificial Sequence: Synthetic coding sequence
atgttcagaggcgcctggatgtggcccggcaaggacgccgccgccctgaccatctgctgctgctgctgctgctgggcccccagacccagcgacaagccctgcgccgacagcgagagagcccagagatggagactgagcctggccagcctgctgttcttcaccgtgctgctggccgaccacctgtggctgtgcgccggcgccagacccagagccagagagctgagcagcgccatgagacccccctggggcgccggcagagagagacagcccgtgccccccagagccgtgctgcccctgcccccccccccccccggcgagcccagcgccccccccggcacctgcggccccagatacagcaacctgaccaaggccgcccccgccgccggcagcagacccgtgtgcggcggcgtgcccgagcccaccggcctggacgccgcctgcaccaagctgcagagcctgcagagactgttcgagcccaccacccccgccccccccctgagaccccccgacagcctgagcagagcccccgccgagttccccagcgccaagaagaacctgctgaagggccacttcagaaacttcaccctgagcttctgcgacacctacaccgtgtgggacctgctgctgggcatggacagacccgacagcctggactgcagcctggacaccctgatgggcgacctgctggccgtggtggccagccccggcagcggcgcctgggaggcctgcagcaactgcatcgaggcctaccagagactggacagacacgcccaggagaagtacgacgagttcgacctggtgctgcacaagtacctgcaggccgaggagtacagcatcagaagctgcaccaagggctgcaaggccgtgtacaaggcctggctgtgcagcgagtacttcagcgtgacccagcaggagtgccagagatgggtgccctgcaagcagtactgcctggaggtgcagaccagatgccccttcatcctgcccgacaacgaggagatggtgtacggcggcctgcccggcttcatctgcaccggcctgctggacaccagccccaagagactggagaccaagtgctgcgacgtgcagtgggtgagctgcgaggccaagaagaagaagttcaaggagagcgaggcccccaagacccaccagcagcagttccaccacagctacttccaccactaccaccagcagtaccaccactaccacccccaccacgacccccccggcagagtgagcaacaagcccgccctgctgcccgtgagcggcggcagcagactgagccccagcagaatcagactgtgcgtgctggtgctgatgctgctgcacaccgtggtgagcttcagcagcaaccagggcggcggcggcctgggcctggagaccctgcccgccctggaggagggcctgaccagagaggagtag

SEQ ID NO: 18148 - DNA, 642 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggccagaatcagccccctgggcgacagaagccagaacagattcagatgcgagtgcagatactgccagagccacagacccaacctgagcggcatccccggcgagagcaacagagccccccaccccagcagctgggagaccctggtgcagggcctgagcggcctgaccctgagcctgggcaccaaccagcccggccccctgcccgaggccgccctgcagccccaggagaccgaggagaagagacagagagagagacagcaggagagcaagatcatgttccagagactgctgaagcagtggctggaggagaactag

SEQ ID NO: 18149 - DNA, 642 bp, Artificial Sequence; identical to SEQ ID NO: 18148
  Description of Artificial Sequence: Synthetic coding sequence

SEQ ID NO: 18150 - DNA, 642 bp, Artificial Sequence; identical to SEQ ID NO: 18148
  Description of Artificial Sequence: Synthetic coding sequence

SEQ ID NO: 18151 - DNA, 381 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggccagaatcagccccctgggcgacagaagccagaacagattcagatgctag

SEQ ID NO: 18152 - DNA, 555 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggccagaatcagccccctgggcgacagaagccagaacagattcagatgcgagtgcagatactgccagagccacagacccaacctgagcggcatccccggcgagagcaacagagccccccaccccagcagctgggagaccctggtgcagggcctgagcggcctgaccctgagcctgggcaccaaccagcccggccccctgcccgaggccgccctgcagccccagtag

SEQ ID NO: 18153 - DNA, 642 bp, Artificial Sequence; identical to SEQ ID NO: 18148
  Description of Artificial Sequence: Synthetic coding sequence

SEQ ID NO: 18154 - DNA, 33 bp, Artificial Sequence
  Description of Artificial Sequence: Synthetic coding sequence
atggaccccctgcagaagagaaaccccgcctag

SEQ ID NO: 18155 - DNA, 567 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggccagaatcagccccctgggcgacagaagccagaacagattcagatgcgagtgcagatactgccagagccacagacccaacctgagcggcatccccggcgagagcaacagagccccccaccccagcagctgggagaccctggtgcagggcctgagcggcctgaccctgagcctgggcaccaaccagcccggccccctgcccgaggccgccctgcagccccaggagaccgaggagtag

SEQ ID NO: 18156 - DNA, 327 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggctag

SEQ ID NO: 18157 - DNA, 336 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggcctag

SEQ ID NO: 18158 - DNA, 396 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagagaaagaaggccttcctgagacacgtgagaagaagacacagagaccacatggccccctacgccgtgggcagagaggccagaatcagccccctgggcgacagaagccagaacagattcagatgcgagtgcagatactgctag

SEQ ID NO: 18159 - DNA, 12 bp, Artificial Sequence
  Description of Artificial Sequence: Synthetic coding sequence
atggacccctag

SEQ ID NO: 18160 - DNA, 258 bp, Artificial Sequence
  Description of Artificial Sequence: Synthetic coding sequence
atggaccccctgcagaagagaaaccccgccagccccagcaagagcagccccatgaccgccgccgagaccagccaggagggccccgcccccagccagcccagctacagcgagcagcccatgatgggcctgagcaacctgagccccggccccggccccagccaggccgtgcccctgcccgagggcctgctgagacagagatacagagaggagaagaccctggaggagagaagatgggagagactggagttcctgcagtag

SEQ ID NO: 18161 - DNA, 642 bp, Artificial Sequence; identical to SEQ ID NO: 18148
  Description of Artificial Sequence: Synthetic coding sequence

SEQ ID NO: 18162 - DNA, 642 bp, Artificial Sequence; identical to SEQ ID NO: 18148
  Description of Artificial Sequence: Synthetic coding sequence

SEQ ID NO: 18163 - DNA, 642 bp, Artificial Sequence; identical to SEQ ID NO: 18148
  Description of Artificial Sequence: Synthetic coding sequence

SEQ ID NO: 18164 - DNA, 642 bp, Artificial Sequence; identical to SEQ ID NO: 18148
  Description of Artificial Sequence: Synthetic coding sequence

SEQ ID NO: 18165 - DNA, 642 bp, Artificial Sequence; identical to SEQ ID NO: 18148
  Description of Artificial Sequence: Synthetic coding sequence

SEQ ID NO: 18166 - DNA, 642 bp, Artificial Sequence; identical to SEQ ID NO: 18148
  Description of Artificial Sequence: Synthetic coding sequence

SEQ ID NO: 18167 - DNA, 642 bp, Artificial Sequence; identical to SEQ ID NO: 18148
  Description of Artificial Sequence: Synthetic coding sequence

SEQ ID NO: 18168 - DNA, 573 bp, Artificial Sequence
  Description of Artificial Sequence: Synthetic coding sequence
atgagcggcgcctgcaccagctacgtgagcgccgagcaggaggtggtgagaggcttcagctgccccagacccggcggcgaggccgccgccgtgttctgctgcggcttcagagaccacaagtactgctgcgacgacccccacagcttcttcccctacgagcacagctacatgtggtggctgagcatcggcgccctgatcggcctgagcgtggccgccgtggtgctgctggccttcatcgtgaccgcctgcgtgctgtgctacctgttcatcagcagcaagccccacaccaagctggacctgggcctgagcctgcagaccgccggccccgaggaggtgagccccgactgccagggcgtgaacaccggcatggccgccgaggtgcccaaggtgagccccctgcagcagagctacagctgcctgaacccccagctggagagcaacgagggccaggccgtgaacagcaagagactgctgcaccactgcttcatggccaccgtgaccaccagcgacatccccggcagccccgaggaggccagcgtgcccaaccccgacctgtgcggccccgtgccctag

SEQ ID NO: 18169 - DNA, 510 bp, Artificial Sequence
  Description of Artificial Sequence: Synthetic coding sequence
atgggcagcctgagcggcctgagactggccgccggcagctgcttcagactgtgcgagagagacgtgagcagcagcctgagactgaccagaagcagcgacctgaagagaatcaacggcttctgcaccaagccccaggagagccccggcgcccccagcagacacctgcagcagagcgccttcacccagacctacggcctggccgagaaggacccccacatggtgagaagcctgcaggaggacgagatccccgagaccgtgagcctggagatgctggacgccgccaagaacaagatgagagtgaagatcagctacctgatgatcgccctgaccgtggtgggctgcatcttctggctgctgagagccagaagctgccccaagaccagagacttcaacaagctggagctgagaaaggagagcagcagcgagagaggcagcagctacgagggccagaacagagtggccgaggtgagcgtgctggccatcctgaagatccaggagctgtgctactag

SEQ ID NO: 18170 - DNA, 465 bp, Artificial Sequence
  Description of Artificial Sequence: Synthetic coding sequence
atgggcagcctgagcggcctgagactggccgccggcagctgcttcagactgtgcgagagagacgtgagcagcagcctgagactgaccagaagcagcgacctgaagagaatcaacggcttctgcaccaagccccaggagagccccggcgcccccagcagaacctacaacagagtgcccctgcacaagcccaccgactggcagaagaagatcctgatctggagcggcagattcaagaaggaggacgagatccccgagaccgtgagcctggagatgctggacgccgccaagaacaagatgagagtgaagatcagctacctgatgatcgccctgaccgtggtgggctgcatcttcatggtgatcgagggcaagaaggccgcccagagacacgagaccctgaccagcctgaacctggagaagaaggccagactgaaggaggaggccgccatgaaggccaagaccgagtag

SEQ ID NO: 18171 - DNA, 489 bp, Artificial Sequence
  Description of Artificial Sequence: Synthetic coding sequence
atgctgagagccgtgggcagcctgctgagactgggcagaggcctgaccgtgagatgcggccccggcgcccccctggaggccaccagaagacccgcccccgccctgccccccagaggcctgccctgctacagcagcggcggcgcccccagcaacagcggcccccagggccacggcgagatccacagagtgcccacccagagaagacccagccagttcgacaagaagatcctgctgtggaccggcagattcaagagcatggaggagatcccccccagaatcccccccgagatgatcgacaccgccagaaacaaggccagagtgaaggcctgctacatcatgatcggcctgaccatcatcgcctgcttcgccgtgatcgtgagcgccaagagagccgtggagagacacgagagcctgaccagctggaacctggccaagaaggccaagtggagagaggaggccgccctggccgcccaggccaaggccaagtag

SEQ ID NO: 18172 - DNA, 504 bp, Artificial Sequence
  Description of Artificial Sequence: Synthetic coding sequence
atgaccgccggcaccgtggtgatcaccggcggcatcctggccaccgtgatcctgctgtgcatcatcgccgtgctgtgctactgcagactgcagtactactgctgcaagaagagcggcaccgaggtggccgacgaggaggaggagagagagcacgacctgcccacccaccccagaggccccacctgcaacgcctgcagcagccaggccctggacggcagaggcagcctggcccccctgaccagcgagccctgcagccagccctgcggcgtggccgccagccactgcaccacctgcagcccctacagcagccccttctacatcagaaccgccgacatggtgcccaacggcggcggcggcgagagactgagcttcgcccccacctactacaaggagggcggcccccccagcctgaagctggccgccccccagagctaccccgtgacctggcccggcagcggcagagaggccttcaccaaccccagagccatcagcaccgacgtgtag

SEQ ID NO: 18173 - DNA, 501 bp, Artificial Sequence
  Description of Artificial Sequence: Synthetic coding sequence
atgaccgccggcaccgtggtgatcaccggcggcatcctggccaccgtgatcctgctgtgcatcatcgccgtgctgtgctactgcagactgcagtactactgctgcaagaaggacgagagcgaggaggacgaggaggagcccgacttcgccgtgcacagccacctgccccccctgcacagcaacagaaacctggtgctgaccaacggccccgccctgtaccccaccgccagcaccagcttcagccagaagagcccccaggccagagccctgtgcagaagctgcagccactgcgagccccccaccttcttcctgcaggagccccccgaggaggaggaggacgtgctgaacggcggcgagagagtgctgtacaagagcgtgagccaggaggacgtggagctgccccccggcggcttcggcggcctgcaggccctgaaccccaacagactgagcgccatgagagaggccttcgccagaagcagaagcatcagcaccgacgtgtag

SEQ ID NO: 18174 - DNA, 501 bp, Artificial Sequence; identical to SEQ ID NO: 18173
  Description of Artificial Sequence: Synthetic coding sequence

SEQ ID NO: 18175 - DNA, 177 bp, Artificial Sequence
  Description of Artificial Sequence: Synthetic coding sequence
atgaactggaaggtgctggagcacgtgcacctgctgctgtacatcctggccgccaagaccctgatcctgtgcctggccttcgccggcgtgaagatctaccagagaaagagactggaggccaagcagcagaagctggaggccgagagaaagaagcagagcgagaagaaggacaactag

SEQ ID NO: 18176 - DNA, 177 bp, Artificial Sequence
  Description of Artificial Sequence: Synthetic coding sequence
atgaactggaaggtgctggagcacgtgcccctgctgctgtacatcctggccgccaagaccctgatcctgtgcctgaccttcgccggcgtgaagatgtaccagagaaagagactggaggccaagcagcagaagctggaggccgagagaaagaagcagagcgagaagaaggacaactag

SEQ ID NO: 18177 - DNA, 177 bp, Artificial Sequence; identical to SEQ ID NO: 18176
  Description of Artificial Sequence: Synthetic coding sequence

SEQ ID NO: 18178 - DNA, 597 bp, Artificial Sequence
  Description of Artificial Sequence: Synthetic coding sequence
atgagcagaagcgccaccctgctgctgtgcctgctgggctgccacgtgtggaaggccgtgaccaagaccctgagagagcccggcgccggcgcccaggaggtgaccctgaaggtgcacatcagcgacgccagcacccaccagcccgtggccgacgccctgatcgagatcttcaccaaccaggccagcatcgccagcggcaccagcggcaccgacggcgtggccttcatcaagttccagtacaagctgggcagccagctgatcgtgaccgccagcaagcacgcctacgtgcccaacagcgccccctggaagcccatcagactgcccgtgttcagcagcctgagcctgggcctgctgcccgagagaagcgccaccctgatggtgtacgaggacgtggtgcagatcgtgagcggcttccagggcaacagcaccagacacgacctgacccccgtgaccgccgtgagcgtgcacctgctgagcagcaacggcacccccgtgctggtggacggccccatctacgtgaccgtgcccctggccacccagagcagcctgagacacaacgcctacgtggccgcctggagattcgaccagaagctgtag

SEQ ID NO: 18179 - DNA, 2673 bp, Artificial Sequence
  Description of Artificial Sequence: Synthetic coding sequence
atgagcagaagcgccaccctgctgctgtgcctgctgggctgccacgtgtggaaggccgtgaccaagaccctgagagagcccggcgccggcgcccaggaggtgaccctgaaggtgcacatcagcgacgccagcacccaccagcccgtggccgacgccctgatcgagatcttcaccaaccaggccagcatcgccagcggcaccagcggcaccgacggcgtggccttcatcaagttccagtacaagctgggcagccagctgatcgtgaccgccagcaagcacgcctacgtgcccaacagcgccccctggaagcccatcagactgcccgtgttcagcagcctgagcctgggcctgctgcccgagagaagcgccaccctgatggtgtacgaggacgtggtgcagatcgtgagcggcttccagggcgccagaccccagcccagagtgcacttccagagaagagccctgagactgcccgagaacaccagctacagcgacctgaccgccttcctgaccgccgccagcagccccagcgaggtggacagcttcccctacctgagaggcctggacggcaacggcaccggcaacagcaccagacacgacctgacccccgtgaccgccgtgagcgtgcacctgctgagcagcaacggcacccccgtgctggtggacggccccatctacgtgaccgtgcccctggccacccagagcagcctgagacacaacgcctacgtggccgcctggagattcgaccagaagctgggcacctggctgaagagcggcctgggcctggtgcaccaggagggcagccagctgacctggacctacatcgccccccagctgggctactgggtggccgccatgagcccccccatccccggccccgtggtgacccaggacatcaccacctaccacaccgtgttcctgctggccatcctgggcggcatggccttcatcctgctggtgctgctgtgcctgctgctgtactactgcagaagaaagtgcctgaagcccagacagcaccacagaaagctgcagctgcccgccggcctggagagcagcaagagagaccagagcaccagcatgagccacatcaacctgctgttcagcagaagagccagcgagttccccggccccctgagcgtgaccagccacggcagacccgaggcccccggcaccaaggagctgatgagcggcgtgcacctggagatgatgagccccggcggcgagggcgacctgcacacccccatgctgaagctgagctacagcaccagccaggagttcagcagcagagaggagctgctgagctgcaaggaggaggacaagagccagatcagcttcgacaacctgacccccagcggcaccctgggcaaggactaccacaagagcgtggaggtgttccccctgaaggccagaaagagcatggagagagagggctacgagagcagcggcaacgacgactacagaggcagctacaacaccgtgctgagccagcccctgttcgagaagcaggacagagagggccccgccagcaccggcagcaagctgaccatccaggagcacctgtaccccgcccccagcagccccgagaaggagcagctgctggacagaagacccaccgagtgcatgatgagcagaagcgtggaccacctggagagacccaccagcttccccagacccggccagctgatctgctgcagcagcgtggaccaggtgaacgacagcgtgtacagaaaggtgctgcccgccctggtgatccccgcccactacatgaagctgcccggcgaccacagctacgtgagccagcccctggtggtgcccgccgaccagcagctggagatcgagagactgcaggccgagctgagcaacccccacgccggcatcttcccccaccccagcagccagatccagccccagcccctgagcagccaggccatcagccagcagcacctgcaggacgccggcaccagagagtggagcccccagaacgccagcatgagcgagagcctgagcatccccgccagcctgaacgacgccgccctggcccagatgaacagcgaggtgcagctgctgaccgagaaggccctgatggagctgggcggcggcaagcccctgccccaccccagagcctggttcgtgagcctggacggcagaagcaacgcccacgtgagacacagctacatcgacctgcagagagccggcagaaacggcagcaacgacgccagcctggacagcggcgtggacatgaacgagcccaagagcgccagaaagggcagaggcgacgccctgagcctgcagcagaactacccccccgtgcaggagcaccagcagaaggagcccagagcccccgacagcaccgcctacacccagctggtgtacctggacgacgtggagcagagcggcagcgagtgcggcaccaccgtgtgcacccccgaggacagcgccctgagatgcctgctggagggcagcagcagaagaagcggcggccagctgcccagcctgcaggaggagaccaccagaagaaccgccgacgcccccagcgagcccgccgccagcccccaccagagaagaagcgcccacgaggaggaggaggacgacgacgacgacgaccagggcgaggacaagaagagcccctggcagaagagagaggagagacccctgatggccttcaacatcaagtag

SEQ ID NO: 18180 - DNA, 2670 bp, Artificial Sequence
  Description of Artificial Sequence: Synthetic coding sequence
ggcggcgacgagcaggtgagagacgccgccgccgtgcccgccggcctgcccagactggagggcggcgacaccctgagagagcccggcgccggcgcccaggaggtgaccctgaaggtgcacatcagcgacgccagcacccaccagcccgtggccgacgccctgatcgagatcttcaccaaccaggccagcatcgccagcggcaccagcggcaccgacggcgtggccttcatcaagttccagtacaagctgggcagccagctgatcgtgaccgccagcaagcacgcctacgtgcccaacagcgccccctggaagcccatcagactgcccgtgttcagcagcctgagcctgggcctgctgcccgagagaagcgccaccctgatggtgtacgaggacgtggtgcagatcgtgagcggcttccagggcgccagaccccagcccagagtgcacttccagagaagagccctgagactgcccgagaacaccagctacagcgacctgaccgccttcctgaccgccgccagcagccccagcgaggtggacagcttcccctacctgagaggcctggacggcaacggcaccggcaacagcaccagacacgacctgacccccgtgaccgccgtgagcgtgcacctgctgagcagcaacggcacccccgtgctggtggacggccccatctacgtgaccgtgcccctggccacccagagcagcctgagacacaacgcctacgtggccgcctggagattcgaccagaagctgggcacctggctgaagagcggcctgggcctggtgcaccaggagggcagccagctgacctggacctacatcgccccccagctgggctactgggtggccgccatgagcccccccatccccggccccgtggtgacccaggacatcaccacctaccacaccgtgttcctgctggccatcctgggcggcatggccttcatcctgctggtgctgctgtgcctgctgctgtactactgcagaagaaagtgcctgaagcccagacagcaccacagaaagctgcagctgcccgccggcctggagagcagcaagagagaccagagcaccagcatgagccacatcaacctgctgttcagcagaagagccagcgagttccccggccccctgagcgtgaccagccacggcagacccgaggcccccggcaccaaggagctgatgagcggcgtgcacctggagatgatgagccccggcggcgagggcgacctgcacacccccatgctgaagctgagctacagcaccagccaggagttcagcagcagagaggagctgctgagctgcaaggaggaggacaagagccagatcagcttcgacaacctgacccccagcggcaccctgggcaaggactaccacaagagcgtggaggtgttccccctgaaggccagaaagagcatggagagagagggctacgagagcagcatgatgaccaccggcgtggtgaccaccccctgcagccacagcctgtacctgaagagcagaaccgagaaggtgcagccccccagagaggccaacagccccttcagaaacatctgcacccccagactgcaccacctgagaaagaacagctgctggaccgccgaccccctgaacatgatgagcagaagcgtggaccacctggagagacccaccagcttccccagacccggccagctgatctgctgcagcagcgtggaccaggtgaacgacagcgtgtacagaaaggtgctgcccgccctggtgatccccgcccactacatgaagctgcccggcgaccacagctacgtgagccagcccctggtggtgcccgccgaccagcagctggagatcgagagactgcaggccgagctgagcaacccccacgccggcatcttcccccaccccagcagccagatccagccccagcccctgagcagccaggccatcagccagcagcacctgcaggacgccggcaccagagagtggagcccccagaacgccagcatgagcgagagcctgagcatccccgccagcctgaacgacgccgccctggcccagatgaacagcgaggtgcagctgctgaccgagaaggccctgatggagctgggcggcggcaagcccctgccccaccccagagcctggttcgtgagcctggacggcagaagcaacgcccacgtgagacacagctacatcgacctgcagagagccggcagaaacggcagcaacgacgccagcctggacagcggcgtggacatgaacgagcccaagagcgccagaaagggcagaggcgacgccctgagcctgcagcagaactacccccccgtgcaggagcaccagcagaaggagcccagagcccccgacagcaccgcctacacccagctggtgtacctggacgacgtggagcagagcggcagcgagtgcggcaccaccgtgtgcacccccgaggacagcgccctgagatgcctgctggagggcagcagcagaagaagcggcggccagctgcccagcctgcaggaggagaccaccagaagaaccgccgacgcccccagcgagcccgccgccagcccccaccagagaagaagcgcccacgaggaggaggaggacgacgacgacgacgaccagggcgaggacaagaagagcccctggcagaagagagaggagagacccctgatggccttcaacatcaagtag

SEQ ID NO: 18181 - DNA, 597 bp, Artificial Sequence; identical to SEQ ID NO: 18178
  Description of Artificial Sequence: Synthetic coding sequence

SEQ ID NO: 18182 - DNA, 2481 bp, Artificial Sequence
  Description of Artificial Sequence: Synthetic coding sequence
atgccccccgccagcggccccagcgtgctggccagactgctgcccctgctgggcctgctgctgggcagcgccagcagagcccccggcaagagcccccccgagccccccagcccccaggagatcctgatcaaggtgcaggtgtacgtgagcggcgagctggtgcccctggccagagccagcgtggacgtgttcggcaacagaaccctgctggccgccggcaccaccgacagcgagggcgtggccaccctgcccctgagctacagactgggcacctgggtgctggtgaccgccgccagacccggcttcctgaccaacagcgtgccctggagagtggacaagctgcccctgtacgccagcgtgagcctgtacctgctgcccgagagacccgccaccctgatcctgtacgaggacctggtgcacatcctgctgggcagccccggcgccagaagccagcccctggtgcagttccagagaagagccgccagactgcccgtgagcagcacctacagccagctgtgggccagcctgacccccgccagcacccagcaggagatgagagccttccccgccttcctgggcaccgaggccagcagcagcggcaacggcagctggctggagctgatgcccctgaccgccgtgagcgtgcacctgctgaccggcaacggcaccgaggtgcccctgagcggccccatccacctgagcctgcccgtgcccagcgagaccagagccctgaccgtgggcaccagcatccccgcctggagattcgaccccaagagcggcctgtgggtgagaaacggcaccggcgtgatcagaaaggagggcagacagctgtactggaccttcgtgagcccccagctgggctactgggtggccgccatggccagccccaccgccggcctggtgaccatcaccagcggcatccaggacatcggcacctaccacaccatcttcctgctgaccatcctggccgccctggccctgctggtgctgatcctgctgtgcctgctgatctactactgcagaagaagatgcctgaagcccagacagcagcacagaaagctgcagctgagcggccccagcgacggcaacaagagagaccaggccaccagcatgagccagctgcacctgatctgcggcggccccctggagcccgcccccagcggcgaccccgaggcccccccccccggccccctgcacagcgccttcagcagcagcagagacctggccagcagcagagacgacttcttcagaaccaagcccagaagcgccagcagacccgccgccgagcccagcggcgccagaggcggcgagagcgccggcctgaagggcgccagaagcgccgagggccccggcggcctggagcccggcctggaggagcacagaagaggccccagcggcgccgccgccttcctgcacgagccccccagcccccccccccccttcgaccactacctgggccacaagggcgccgccgagggcaagacccccgacttcctgctgagccagagcgtggaccagctggccagaccccccagcctgggccaggccggccagctgatcttctgcggcagcatcgaccacctgaaggacaacgtgtacagaaacgtgatgcccaccctggtgatccccgcccactacgtgagactgggcggcgaggccggcgccgccggcgtgggcgacgagcccgccccccccgagggcaccgcccccggccccgccagagccttcccccagcccgacccccagagaccccagatgcccggccacagcggccccggcggcgagggcggcggcggcggcggcgagggctggggcgccggcagagccgcccccgtgagcggcagcgtgaccatccccgtgctgttcaacgagagcaccatggcccagctgaacggcgagctgcaggccctgaccgagaagaagctgctggagctgggcgtgaagccccaccccagagcctggttcgtgagcctggacggcagaagcaacagccaggtgagacacagctacatcgacctgcaggccggcggcggcgccagaagcaccgacgccagcctggacagcggcgtggacgtgcacgaggccagacccgccagaagaagacccgccagagaggagagagagagagccccccccgccgcccccccccccccccccgccccccccagactggccctgagcgaggacaccgagcccagcagcagcgagagcagaaccggcctgtgcagccccgaggacaacagcctgacccccctgctggacgaggtggccgcccccgagggcagagccgccaccgtgcccagaggcagaggcagaagcagaggcgacagcagcagaagcagcgccagcgagctgagaagagacagcctgaccagccccgaggacgagctgggcgccgaggtgggcgacgaggccggcgacaagaagagcccctggcagagaagagaggagagacccctgatggtgttcaacgtgaagtag

SEQ ID NO: 18183 - DNA, 1284 bp, Artificial Sequence
  Description of Artificial Sequence: Synthetic coding sequence
atggccagactgtgcagaagagtgccctgcaccctgctgctgggcctggccgtggtgctgctgaaggccagactggtgcccgccgccgccagagccgagctgagcagaagcgacctgagcctgatccagcagcagcagcagcagcagcagcagcagcagcagcagcagaagcagctggaggaggccgaggaggagagaaccgaggtgcccggcgccaccagcaccctgaccgtgcccgtgagcgtgttcatgctgaaggtgcaggtgaacgacatcatcagcagacagtacctgagccaggccgtggtggaggtgttcgtgaactacaccaagaccaacagcaccgtgaccaagagcaacggcgccgtgctgatcaaggtgccctacaagctgggcctgagcctgaccatcatcgcctacaaggacggctacgtgctgacccccctgccctggaagaccagaagaatgcccatctacagcagcgtgaccctgagcctgttcccccagagccaggccaacatctggctgttcgaggacaccgtgctgatcaccggcaagctggccgacgccaagagccagcccagcgtgcagttcagcaaggccctgatcaagctgcccgacaaccaccacatcagcaacgtgaccggctacctgaccgtgctgcagcagttcctgaaggtggacaacttcctgcacaccaccggcatcaccctgaacaagcccggcttcgagaacatcgagctgacccccctggccgccatctgcgtgaagatctacagcggcggcaaggagctgaaggtgaacggcagcatccaggtgagcctgcccctgctgagactgaacgacatcagcgccggcgacagaatccccgcctggaccttcgacatgaacaccggcgcctgggtgaaccacggcagaggcatggtgaaggagcacaacaaccacctgatctggacctacgacgccccccacctgggctactggatcgccgcccccctgcccggcaccagaggcagcggcatcaacgaggacagcaaggacatcaccgcctaccacaccgtgttcctgaccgccatcctgggcggcaccatcgtgatcgtgatcggcttcttcgccgtgctgctgtgctactgcagagacaagtgcggcaccccccagaagagagagagaaacatcaccaagctggaggtgctgaagagagaccagaccaccagcaccacccacatcaaccacatcagaaacagaagaaagagcttccacggcaagaacagcggcagattctag

SEQ ID NO: 18184 - DNA, 2481 bp, Artificial Sequence
  Description of Artificial Sequence: Synthetic coding sequence
atggccagactgtgcagaagagtgccctgcaccctgctgctgggcctggccgtggtgctgctgaaggccagactggtgcccgccgccgccagagccgagctgagcagaagcgacctgagcctgatccagcagcagcagcagcagcagcagcagcagcagcagcagcagaagcagctggaggaggccgaggaggagagaaccgaggtgcccggcgccaccagcaccctgaccgtgcccgtgagcgtgttcatgctgaaggtgcaggtgaacgacatcatcagcagacagtacctgagccaggccgtggtggaggtgttcgtgaactacaccaagaccaacagcaccgtgaccaagagcaacggcgccgtgctgatcaaggtgccctacaagctgggcctgagcctgaccatcatcgcctacaaggacggctacgtgctgacccccctgccctggaagaccagaagaatgcccatctacagcagcgtgaccctgagcctgttcccccagagccaggccaacatctggctgttcgaggacaccgtgctgatcaccggcaagctggccgacgccaagagccagcccagcgtgcagttcagcaaggccctgatcaagctgcccgacaaccaccacatcagcaacgtgaccggctacctgaccgtgctgcagcagttcctgaaggtggacaacttcctgcacaccaccggcatcaccctgaacaagcccggcttcgagaacatcgagctgacccccctggccgccatctgcgtgaagatctacagcggcggcaaggagctgaaggtgaacggcagcatccaggtgagcctgcccctgctgagactgaacgacatcagcgccggcgacagaatccccgcctggaccttcgacatgaacaccggcgcctgggtgaaccacggcagaggcatggtgaaggagcacaacaaccacctgatctggacctacgacgccccccacctgggctactggatcgccgcccccctgcccggcaccagaggcagcggcatcaacgaggacagcaaggacatcaccgcctaccacaccgtgttcctgaccgccatcctgggcggcaccatcgtgatcgtgatcggcttcttcgccgtgctgctgtgctactgcagagacaagtgcggcaccccccagaagagagagagaaacatcaccaagctggaggtgctgaagagagaccagaccaccagcaccacccacatcaaccacatcagcaccgtgaaggtggccctgaaggccgaggacaagagccagctgttcaacgccaagaacagcagctacagcccccagaagaaggagcccagcaaggccgagaccgaggagagagtgagcatggtgaagaccagagacgacttcaagatctacaacgaggacgtgagcttcctgagcgtgaaccagaacaactacagcagaaaccccacccagagcctggagcccaacgtgggcagcaagcagcccaagcacatcaacaacaacctgagcagcagcctgggcgacgcccaggacgagaagagatacctgaccggcaacgaggaggcctacggcagaagccacatccccgagcagctgatgcacatctacagccagcccatcgccatcctgcagaccagcgacctgttcagcacccccgagcagctgcacaccgccaagagcgccaccctgcccagaaagggccagctggtgtacggccagctgatggagcccgtgaacagagagaacttcacccagaccctgcccaagatgcccatccacagccacgcccagccccccgacgccagagaggaggacatcatcctggagggccagcagagcctgcccagccaggccagcgactggagcagatacagcagcagcctgctggagagcgtgagcgtgcccggcaccctgaacgaggccgtggtgatgacccccttcagcagcgagctgcagggcatcagcgagcagaccctgctggagctgagcaagggcaagcccagcccccaccccagagcctggttcgtgagcctggacggcaagcccgtggcccaggtgagacacagcttcatcgacctgaagaagggcaagagaacccagagcaacgacaccagcctggacagcggcgtggacatgaacgagctgcacagcagcagaaagctggagagagagaagaccttcatcaagagcatgcaccagcccaagatcctgtacctggaggacctggacctgagcagcagcgagagcggcaccaccgtgtgcagccccgaggaccccgccctgagacacatcctggacggcggcagcggcgtgatcatggagcaccccggcgaggagagccccggcagaaagagcaccgtggaggacttcgaggccaacaccagccccaccaagagaagaggcagaccccccctggccaagagagacagcaagaccaacatctggaagaagagagaggagagacccctgatccccatcaactag

SEQ ID NO: 18185 - DNA, 708 bp, Artificial Sequence
  Description of Artificial Sequence: Synthetic coding sequence
atggagcaggacgaccccgtggaggccctgaccgagctgagagagagaagactgggcgccctggagctgctgcaggccgccgccggcagcggcctggccgcctacgccgtgtgggccctgctgctgcagcccggcttcagaagagtgcccctgagactgcaggtgccctacgtgggcgccagcgccagacaggtggagcacgtgctgagcctgctgagaggcagacccggcaagaccgtggacctgggcagcggcgacggcagaatcgtgctggccgcccacagatgcggcctgagacccgccgtgggctacgagctgaacccctggctggtggccctggccagactgcacgcctggagagccggctgcgccggcagcgtgtgctacagaagaaaggacctgtggaaggtgagcctgagagactgcagaaacgtgagcgtgttcctggcccccagcgtgctgcccctgctggaggacaagctgagaaccgagctgcccgccggcgccagagtggtgagcggcagattccccctgcccacctggcagcccgtgaccgccgtgggcgagggcctggacagagtgtgggcctacgacgtgcccgagggcggccaggccggcgaggccgccagcagcagaatccccatccaggccgcccccggccccagcagcgcccccatccccggcggcctgatcagccaggccagctag

SEQ ID NO: 18186 - DNA, 879 bp, Artificial Sequence
  Description of Artificial Sequence: Synthetic coding sequence
atggcccagcccccccccgacgtggagggcgacgactgcctgcccgcctacagacacctgttctgccccgacctgctgagagacaaggtggccttcatcaccggcggcggcagcggcatcggcttcagaatcgccgagatcttcatgagacacggctgccacaccgtgatcgccagcagaagcctgcccagagtgctgaccgccgccagaaagctggccggcgccaccggcagaagatgcctgcccctgagcatggacgtgagagccccccccgccgtgatggccgccgtggaccaggccctgaaggagttcggcagaatcgacatcctgatcaactgcgccgccggcaacttcctgtgccccgccggcgccctgagcttcaacgccttcaagaccgtgatggacatcgacaccagcggcaccttcaacgtgagcagagtgctgtacgagaagttcttcagagaccacggcggcgtgatcgtgaacatcaccgccaccctgggcaacagaggccaggccctgcaggtgcacgccggcagcgccaaggccgccgtggacgccatgaccagacacctggccgtggagtggggcccccagaacatcagagtgaacagcctggcccccggccccatcagcggcaccgagggcctgagaagactgggcggcccccaggccagcctgagcaccaaggtgaccgccagccccctgcagagactgggcaacaagaccgagatcgcccacagcgtgctgtacctggccagccccctggccagctacgtgaccggcgccgtgctggtggccgacggcggcgcctggctgaccttccccaacggcgtgaagggcctgcccgacttcgccagcttcagcgccaagctgtag

SEQ ID NO: 18187 - DNA, 702 bp, Artificial Sequence
  Description of Artificial Sequence: Synthetic coding sequence
atggagggcggcggcggcatccccctggagaccctgaaggaggagagccagagcagacacgtgctgcccgccagcttcgaggtgaacagcctgcagaagagcaactggggcttcctgctgaccggcctggtgggcggcaccctggtggccgtgtacgccgtggccacccccttcgtgacccccgccctgagaaaggtgtgcctgcccttcgtgcccgccaccaccaagcagatcgagaacgtggtgaagatgctgagatgcagaagaggcagcctggtggacatcggcagcggcgacggcagaatcgtgatcgccgccgccaagaagggcttcaccgccgtgggctacgagctgaacccctggctggtgtggtacagcagatacagagcctggagagagggcgtgcacggcagcgccaagttctacatcagcgacctgtggaaggtgaccttcagccagtacagcaacgtggtgatcttcggcgtgccccagatgatgctgcagctggagaagaagctggagagagagctggaggacgacgccagagtgatcgcctgcagattccccttcccccactggacccccgaccacgtgaccggcgagggcatcgacaccgtgtgggcctacgacgccagcaccttcagaggcagagagaagagaccctgcaccagcatgcacttccagctgcccatccaggcctag

SEQ ID NO: 18188 - DNA, 573 bp, Artificial Sequence
  Description of Artificial Sequence: Synthetic coding sequence
atgaaggccagccagtgctgctgctgcctgagccacctgctggccagcgtgctgctgctgctgctgctgcccgagctgagcggccccctggccgtgctgctgcaggccgccgaggccgcccccggcctgggcccccccgaccccagacccagaaccctgccccccctgccccccggccccacccccgcccagcagcccggcagaggcctggccgaggccgccggccccagaggcagcgagggcggcaacggcagcaaccccgtggccggcctggagaccgacgaccacggcggcaaggccggcgagggcagcgtgggcggcggcctggccgtgagccccaaccccggcgacaagcccatgacccagagagccctgaccgtgctgatggtggtgagcggcgccgtgctggtgtacttcgtggtgagaaccgtgagaatgagaagaagaaacagaaagaccagaagatacggcgtgctggacaccaacatcgagaacatggagctgacccccctggagcaggacgacgaggacgacgacaacaccctgttcgacgccaaccaccccagaagatag

SEQ ID NO: 18189 - DNA, 480 bp, Artificial Sequence
  Description of Artificial Sequence: Synthetic coding sequence
atgagagccgtgcccctgcccgcccccctgctgcccctgctgctgctggccctgctggccgcccccgccgccagagccagcagagccgagagcgtgagcgccccctggcccgagcccgagagagagagcagacccccccccggccccggccccggcaacaccaccagattcggcagcggcgccgccggcggcagcggcagcagcagcagcaacagcagcggcgacgccctggtgaccagaatcagcatcctgctgagagacctgcccaccctgaaggccgccgtgatcgtggccttcgccttcaccaccctgctgatcgcctgcctgctgctgagagtgttcagaagcggcaagagactgaagaagaccagaaagtacgacatcatcaccacccccgccgagagagtggagatggcccccctgaacgaggaggacgacgaggacgaggacagcaccgtgttcgacatcaagtacagatag

SEQ ID NO: 18190 - DNA, 1293 bp, Artificial Sequence
  Description of Artificial Sequence: Synthetic coding sequence
atggccgccagactgctgagaggcagcctgagagtgctgggcggccacagagcccccagacagctgcccgccgccagatgcagccacagcggcggcgaggagagactggagacccccagcgccaagaagctgaccgacatcggcatcagaagaatcttcagccccgagcacgacatcttcagaaagagcgtgagaaagttcttccaggaggaggtgatcccccaccacagcgagtgggagaaggccggcgaggtgagcagagaggtgtgggagaaggccggcaagcagggcctgctgggcgtgaacatcgccgagcacctgggcggcatcggcggcgacctgtacagcgccgccatcgtgtgggaggagcaggcctacagcaactgcagcggccccggcttcagcatccacagcggcatcgtgatgagctacatcaccaaccacggcagcgaggagcagatcaagcacttcatcccccagatgaccgccggcaagtgcatcggcgccatcgccatgaccgagcccggcgccggcagcgacctgcagggcatcaagaccaacgccaagaaggacggcagcgactggatcctgaacggcagcaaggtgttcatcagcaacggcagcctgagcgacgtggtgatcgtggtggccgtgaccaaccacgaggcccccagccccgcccacggcatcagcctgttcctggtggagaacggcatgaagggcttcatcaagggcagaaagctgcacaagatgggcctgaaggcccaggacaccgccgagctgttcttcgaggacatcagactgcccgccagcgccctgctgggcgaggagaacaagggcttctactacatcatgaaggagctgccccaggagagactgctgatcgccgacgtggccatcagcgccagcgagttcatgttcgaggagaccagaaactacgtgaagcagagaaaggccttcggcaagaccgtggcccacctgcagaccgtgcagcacaagctggccgagctgaagacccacatctgcgtgaccagagccttcgtggacaactgcctgcagctgcacgaggccaagagactggacagcgccaccgcctgcatggccaagtactgggccagcgagctgcagaacagcgtggcctacgactgcgtgcagctgcacggcggctggggctacatgtgggagtaccccatcgccaaggcctacgtggacgccagagtgcagcccatctacggcggcaccaacgagatcatgaaggagctgatcgccagagagatcgtgttcgacaagtag

SEQ ID NO: 18191 - DNA, 459 bp, Artificial Sequence
  Description of Artificial Sequence: Synthetic coding sequence
atgagactgcccctgagccacagccccgagcacgtggagatggccctgctgagcaacatcctggccgcctacagcttcgtgagcgagaaccccgagagagccgccctgtacttcgtgagcggcgtgtgcatcggcctggtgctgaccctggccgccctggtgatcagaatcagctgccacaccgactgcagaagaagacccggcaagaagttcctgcaggacagagagagcagcagcgacagcagcgacagcgaggacggcagcgaggacaccgtgagcgacctgagcgtgagaagacacagaagattcgagagaaccctgaacaagaacgtgttcaccagcgccgaggagctggagagagcccagagactggaggagagagagagaatcatcagagagatctggatgaacggccagcccgaggtgcccggcaccagaagcctgaacagatactactag

SEQ ID NO: 18192 - DNA, 459 bp, Artificial Sequence; identical to SEQ ID NO: 18191
  Description of Artificial Sequence: Synthetic coding sequence

SEQ ID NO: 18193 - DNA, 459 bp, Artificial Sequence; identical to SEQ ID NO: 18191
  Description of Artificial Sequence: Synthetic coding sequence

SEQ ID NO: 18194 - DNA, 432 bp, Artificial Sequence
  Description of Artificial Sequence: Synthetic coding sequence
atgagactgcccctgagccacagccccgagcacgtggagatggccctgctgagcaacatcctggccgcctacagcttcgtgagcgagaaccccgagagagccgccctgtacttcgtgagcggcgtgtgcatcggcctggtgctgaccctggccgccctggtgatcagaatcagctgccacaccgactgcagaagaagacccggcaagaagttcctgcaggacagagagagcagcagcgacagcagcgacagcgaggacggcagcgaggacaccgtgagcgacctgagcgtgagaagacacagaagattcgagagaaccctgaacaagaacgtgttcaccagcgccgaggagctggagagagcccagagactggaggagagagagagaatcatcagagagatctggatgaacggccagcccgaggtgccctag

SEQ ID NO: 18195 - DNA, 306 bp, Artificial Sequence
  Description of Artificial Sequence: Synthetic coding sequence
atgagactgcccctgagccacagccccgagcacgtggagatggccctgctgagcaacatcctggccgcctacagcttcgtgagcgagaaccccgagagagccgccctgtacttcgtgagcggcgtgtgcatcggcctggtgctgaccctggccgccctggtgatcagaatcagctgccacaccgactgcagaagaagacccggcaagaagttcctgcaggacagagagagcagcagcgacagcagcgacagcgaggacggcagcgaggacaccgtgagcgacctgagcgtgagaagacacagatag

SEQ ID NO: 18196 - DNA, 612 bp, Artificial Sequence
  Description of Artificial Sequence: Synthetic coding sequence
atgctgcagcaggacagcaacgacgacaccgaggacgtgagcctgttcgacgccgaggaggagaccaccaacagacccagaaaggccaagatcagacaccccgtggccagcttcttccacctgttcttcagagtgagcgccatcatcgtgtgcctgctgtgcgagctgctgagcagcagcttcatcacctgcatggtgaccatcatcctgctgctgagctgcgacttctgggccgtgaagaacgtgaccggcagactgatggtgggcctgagatggtggaaccacatcgacgaggacggcaagagccactgggtgttcgagagcagaaaggagagcagccaggagaacaagaccgtgagcgaggccgagagcagaatcttctggctgggcctgatcgcctgcagcgtgctgtgggtgatcttcgccttcagcgccctgttcagcttcaccgtgaagtggctggccgtggtgatcatgggcgtggtgctgcagggcgccaacctgtacggctacatcagatgcaaggtgagaagcagaaagcacctgaccagcatggccaccagctacttcggcaagcagttcctgagacaggtgagcgtgttctggatgtag

SEQ ID NO: 18197 - DNA, 642 bp, Artificial Sequence
  Description of Artificial Sequence: Synthetic coding sequence
atgaagcaggccctggtggacgacaccgaggacgtgagcctggacttcggcaacgaggaggagctggccttcagaaaggccaagatcagacaccccctggccaccttcttccacctgttcttcagagtgagcgccatcgtgacctacgtgagctgcgactggttcagcaagagcttcgtgggctgcttcgtgatggtgctgctgctgctgagcctggacttctggagcgtgaagaacgtgaccggcagactgctggtgggcctgagatggtggaaccagatcgacgaggacggcaagagccactggatcttcgaggccagaaaggtgagccccaacagcatcgccgccaccgaggccgaggccagaatcttctggctgggcctgatcatctgccccatgatctggatcgtgttcttcttcagcaccctgttcagcctgaagctgaagtggctggccctggtggtggccggcatcagcctgcaggccgccaacctgtacggctacatcctgtgcaagatgggcggcaacagcgacatcggcaaggtgaccgccagcttcctgagccagaccgtgttccagaccgcctgccccggcgacttccagaagcccggcctggagggcctggagatccaccagcactag

SEQ ID NO: 18198 - DNA, 567 bp, Artificial Sequence
  Description of Artificial Sequence: Synthetic coding sequence
atgaagcaggccctggtggacgacaccgaggacgtgagcctggacttcggcaacgaggaggagctggccttcagaaaggccaagatcagagacagagtgagcaagctgctggccagcgtgatcctgctgccctggccccccaaggtgctgggcctgaagaacgtgaccggcagactgctggtgggcctgagatggtggaaccagatcgacgaggacggcaagagccactggatcttcgaggccagaaaggtgagccccaacagcatcgccgccaccgaggccgaggccagaatcttctggctgggcctgatcatctgccccatgatctggatcgtgttcttcttcagcaccctgttcagcctgaagctgaagtggctggccctggtggtggccggcatcagcctgcaggccgccaacctgtacggctacatcctgtgcaagatgggcggcaacagcgacatcggcaaggtgaccgccagcttcctgagccagaccgtgttccagaccgcctgccccggcgacttccagaagcccggcctggagggcctggagatccaccagcactag

SEQ ID NO: 18199 - DNA, 618 bp, Artificial Sequence
  Description of Artificial Sequence: Synthetic coding sequence
atgctgcagcaggacagcaacgacgacaccgaggacgtgagcctgttcgacgccgaggaggagaccaccaacagacccagaaaggccaagatcagacaccccgtggccagcttcttccacctgttcttcagagtgagcgccatcatcgtgtacctgctgtgcggcctgctgagcagcagcttcatcacctgcatggtgaccatcatcctgctgctgagctgcgacttctgggccgtgaagaacgtgaccggcagactgatggtgggcctgagatggtggaaccacatcgacgaggacggcaagagccactgggtgttcgagagcagaaaggagagcagccaggagaacaagaccgtgagcgaggccgagagcagaatcttctggctgggcctgatcgcctgccccgtgctgtgggtgatcttcgccttcagcgccctgttcagcttcagagtgaagtggctggccgtggtgatcatgggcgtggtgctgcagggcgccaacctgtacggctacatcagatgcaaggtgagaagcagaaagcacctgaccagcatggccaccagctacttcggcaagcagttcctgagacagaacaccggcgacgaccagaccagctag

SEQ ID NO: 18200 - DNA, 786 bp, Artificial Sequence
  Description of Artificial Sequence: Synthetic coding sequence
atgacctgctggctgagaggcgtgaccgccaccttcggcagacccgccgagtggcccggctacctgagccacctgtgcggcagaagcgccgccatggacctgggccccatgagaaagagctacagaggcgacagagaggccttcgaggagacccacctgaccagcctggaccccgtgaagcagttcgccgcctggttcgaggaggccgtgcagtgccccgacatcggcgaggccaacgccatgtgcctggccacctgcaccagagacggcaagcccagcgccagaatgctgctgctgaagggcttcggcaaggacggcttcagattcttcaccaacttcgagagcagaaagggcaaggagctggacagcaaccccttcgccagcctggtgttctactgggagcccctgaacagacaggtgagagtggagggccccgtgaagaagctgcccgaggaggaggccgagtgctacttccacagcagacccaagagcagccagatcggcgccgtggtgagccaccagagcagcgtgatccccgacagagagtacctgagaaagaagaacgaggagctggagcagctgtaccaggaccaggaggtgcccaagcccaagagctggggcggctacgtgctgtacccccaggtgatggagttctggcagggccagaccaacagactgcacgacagaatcgtgttcagaagaggcctgcccaccggcgacagccccctgggccccatgacccacagaggcgaggaggactggctgtacgagagactggccccctag

SEQ ID NO: 18201 - DNA, 612 bp, Artificial Sequence; identical to SEQ ID NO: 18196
  Description of Artificial Sequence: Synthetic coding sequence

SEQ ID NO: 18202 - DNA, 558 bp, Artificial Sequence; identical to SEQ ID NO: 18114
  Description of Artificial Sequence: Synthetic coding sequence

SEQ ID NO: 18203 - DNA, 1110 bp, Artificial Sequence
  Description of Artificial Sequence: Synthetic coding sequence
atgccccccatgctgtggctgctgctgcacttcgccgcccccgccctgggcttctacttcagcatcagctgccccagcggcaagcagtgccagcaggccctgctgagcggcaacgacatcctgctgtactgcaacagcagcggcgcccactggtactacctgttcacccagggcaagaagggcagactgaccagcctgaccaacatcagcaacatggagatcatgcccgagggcagcctgctgatcaaggaccccctgcccagccagaccggcctgtaccactgctggaacaagaacggcagacaggtggtgcagtacgagatcgacttccaggacgtgaccaccctgcacatcacccacaaggacctgggccagagacccctgcagaacgagaccctgcacctgggcagcaagcagctgatcttcacctggtgggagccctggcaggactgcaacagatgcgaggagcccggcgagtgcaagagactgggctacagatacatcgaggagcccctggaggaggccatgccctgctggctgtacctgggcgaggtgctggtgtggagcagcagactgagacccgagctgcaggtggaggcctgccacgtgcagtgcaccaacaacacccagctgagagtggactacgtgatcttcgacaacttcagactggacgagaagaccgagttcgtgtggctggactgccccctgggcagcatgtacagacccgtgaactggagagccaacgacacccccctgacctgggagagccagctgagcggccaggacttcaccaccttcctggaccccagcaccggcggcagacagctgcaggtgttccagcccgccgtgtacaagtgcttcgtgcagcaggagctggtggcccagttcaagcccgccgccagcctggagaccctggaggcccagtggagagagaacgacgcccagtggagagaggccagaaaggccctgagaggcagagccgacagcgtgctgaagggcctgaagctggtgctgctggtggtgaccgtgctggccctgctgggcgccctgctgaagtgcatccaccccagccccggcagaagaagcacccaggtgctggtggtgaagtag

SEQ ID NO: 18204 - DNA, 1620 bp, Artificial Sequence
  Description of Artificial Sequence: Synthetic coding sequence
atgccccccgccggcggccccagagcccccagacccgccgccctgcccagaagcctgagcagactgagagagtgccccggcagaagcagaatcgtgctggccctgggcgccacccagatggccctgggctgcctgatcgtggccgtgagcttcgccgccctggccctgaccaccagcgccagagtgagacacagctgccccttctgggccggcttcagcgtgctgctgagcggcctgatcggcgtggtgagctggaagagacccctgagcctggtgatcaccttcttcatgctgctgagcgccgtgtgcgtgatgctgaacctggccggcagcatcctgagctgccagaacgcccagctggtgaacagcctggagggctgccagctgatcaagttcgacagcgtggaggtgtgcgtgtgctgcgagctgcagcaccagagcagcggctgcagcaacctgggcgagaccctgaagctgaaccccctgcaggagaactgcaacgccgtgagactgaccctgaaggacctgctgttcagcgtgtgcgccctgaacgtgctgagcaccatcgtgtgcgccctggccaccgccatgtgctgcatgcagatggtgagcagcgacgtgctgcagatgttcctgccccagagaagccaccccgccaaccccacctgcgtgaccccccacggcaccgtgctgcaccagaccctggacttcgacgagttcatcccccccctgcccccccccccctactacccccccgagtacacctgcacccccagcaccgaggcccagagaggcctgcacctggacttcgcccccagccccttcggcaccctgtacgacgtggccatcaacagccccggcctgctgtaccccgccgagctgccccccccctacgaggccgtggtgggccagccccccgccagccaggtgaccagcatcggccagcaggtggccgagagcagcagcggcgaccccaacaccagcgccggcttcagcacccccgtgcccgccgacagcaccagcctgctggtgagcgagggcaccgccacccccggcagcagccccagccccgacggccccgtgggcgcccccgcccccagcgagcccgccctgccccccggccacgtgagccccgaggaccccggcatgggcagccaggtgcagcccggccccggcagagtgagcagaagcaccagcgaccccaccctgtgcaccagcagcatggccggcgacgccagcagccacagacccagctgcagccaggacctggaggccggcctgagcgaggccgtgcccggcagcgccagcatgagcagaagcgccaccgccgcctgcagagcccagctgagccccgccggcgaccccgacacctggaagaccgaccagagacccacccccgagcccttccccgccaccagcaaggagagacccagaagcctggtggacagcaaggcctacgccgacgccagagtgctggtggccaagttcctggagcacagccactgcgccctgcccaccgaggcccagcacatggtgggcgccatgagactggccgtgaccaacgaggagagactggaggaggaggccgtgttcggcgccgacgtgctggaccaggtgtag

SEQ ID NO: 18205 - DNA, 1353 bp, Artificial Sequence
  Description of Artificial Sequence: Synthetic coding sequence
atgatcctgctggtgaacctgttcgtgctgctgagcgtggtgtgcgtgctgctgaacctggccggcttcatcctgggctgccagggcgcccagttcgtgagcagcgtgcccagatgcgacctggtggacctgggcgagggcaagatctgcttctgctgcgaggagttccagcccgccaagtgcaccgacaaggagaacgccctgaagctgttccccgtgcagccctgcagcgccgtgcacctgctgctgaagaaggtgctgttcgccctgtgcgccctgaacgccctgaccaccaccgtgtgcctggtggccgccgccctgagatacctgcagatcttcgccaccagaagaagctgcatcgacgagagccagatcagcgccgaggaggccgaggaccacggcagaatccccgaccccgacgacttcgtgccccccgtgcccccccccagctacttcgccaccttctacagctgcacccccagaatgaacagaagaatggtgggccccgacgtgatccccctgccccacatctacggcgccagaatcaagggcgtggaggtgttctgccccctggaccccccccccccctacgaggccgtggtgagccagatggaccaggagcagggcagcagcttccagatgagcgagggcagcgaggccgccgtgatccccctggacctgggctgcacccaggtgacccaggacggcgacatccccaacatccccgccgaggagaacgccagcaccagcacccccagcagcaccctggtgagacccatcagaagcagaagagccctgccccccctgagaaccagaagcaagagcgaccccgtgctgcaccccagcgaggagagagccgcccccgtgctgagctgcgaggccgccacccagaccgagagaagactggacctggccgccgtgaccctgagaagaggcctgagaagcagagccagcagatgcagacccagaagcctgatcgactacaagagctacatggacaccaagctgctggtggccagattcctggagcagagcagctgcaccatgacccccgacatccacgagctggtggagaacatcaagagcgtgctgaagagcgacgaggagcacatggaggaggccatcaccagcgccagcttcctggagcagatcatggcccccctgcagcccagcaccagcagagcccacaagctgcccagcagaagacagcccggcctgctgcacctgcagagctgcggcgacctgcacaccttcacccccgccggcagacccagagccgagagaagacccagaagagtggaggccgagagaccccacagcctgatcggcgtgatcagagagaccgtgctgtag

SEQ ID NO: 18206 - DNA, 858 bp, Artificial Sequence
  Description of Artificial Sequence: Synthetic coding sequence
atggtgggccccgacgtgatccccctgccccacatctacggcgccagaatcaagggcgtggaggtgttctgccccctggaccccccccccccctacgaggccgtggtgagccagatggaccaggagcagggcagcagcttccagatgagcgagggcagcgaggccgccgtgatccccctggacctgggctgcacccaggtgacccaggacggcgacatccccaacatccccgccgaggagaacgccagcaccagcacccccagcagcaccctggtgagacccatcagaagcagaagagccctgccccccctgagaaccagaagcaagagcgaccccgtgctgcaccccagcgaggagagagccgcccccgtgctgagctgcgaggccgccacccagaccgagagaagactggacctggccgccgtgaccctgagaagaggcctgagaagcagagccagcagatgcagacccagaagcctgatcgactacaagagctacatggacaccaagctgctggtggccagattcctggagcagagcagctgcaccatgacccccgacatccacgagctggtggagaacatcaagagcgtgctgaagagcgacgaggagcacatggaggaggccatcaccagcgccagcttcctggagcagatcatggcccccctgcagcccagcaccagcagagcccacaagctgcccagcagaagacagcccggcctgctgcacctgcagagctgcggcgacctgcacaccttcacccccgccggcagacccagagccgagagaagacccagaagagtggaggccgagagaccccacagcctgatcggcgtgatcagagagaccgtgctgtag

SEQ ID NO: 18207 - DNA, 714 bp, Artificial Sequence
  Description of Artificial Sequence: Synthetic coding sequence
atgacctgcttcggcccctaccccatcggcaccggcctgcagggcatcaccctgtgctgcttccccagcttctgcaagatgaagagcagaatgtgcatggccatcagcatctgccagatgctgagcatgctgagcttcgtggtgtgcgccttcagatacagacacatgttcaagagaggctggcccatgggcacctgctgcctgttcctgcccaccgccgcccccgtgctgagctgcgaggccgccacccagaccgagagaagactggacctggccgccgtgaccctgagaagaggcctgagaagcagagccagcagatgcagacccagaagcctgatcgactacaagagctacatggacaccaagctgctggtggccagattcctggagcagagcagctgcaccatgacccccgacatccacgagctggtggagaacatcaagagcgtgctgaagagcgacgaggagcacatggaggaggccatcaccagcgccagcttcctggagcagatcatggcccccctgcagcccagcaccagcagagcccacaagctgcccagcagaagacagcccggcctgctgcacctgcagagctgcggcgacctgcacaccttcacccccgccggcagacccagagccgagagaagacccagaagagtggaggccgagagaccccacagcctgatcggcgtgatcagagagaccgtgctgtag

SEQ ID NO: 18208 - DNA, 1350 bp, Artificial Sequence
  Description of Artificial Sequence: Synthetic coding sequence
gtgctgctggtgaacctgttcgtgctgctgagcgtggtgtgcgtgctgctgaacctggccggcttcatcctgggctgccagggcgcccagttcgtgagcagcgtgcccagatgcgacctggtggacctgggcgagggcaagatctgcttctgctgcgaggagttccagcccgccaagtgcaccgacaaggagaacgccctgaagctgttccccgtgcagccctgcagcgccgtgcacctgctgctgaagaaggtgctgttcgccctgtgcgccctgaacgccctgaccaccaccgtgtgcctggtggccgccgccctgagatacctgcagatcttcgccaccagaagaagctgcatcgacgagagccagatcagcgccgaggaggccgaggaccacggcagaatccccgaccccgacgacttcgtgccccccgtgcccccccccagctacttcgccaccttctacagctgcacccccagaatgaacagaagaatggtgggccccgacgtgatccccctgccccacatctacggcgccagaatcaagggcgtggaggtgttctgccccctggaccccccccccccctacgaggccgtggtgagccagatggaccaggagcagggcagcagcttccagatgagcgagggcagcgaggccgccgtgatccccctggacctgggctgcacccaggtgacccaggacggcgacatccccaacatccccgccgaggagaacgccagcaccagcacccccagcagcaccctggtgagacccatcagaagcagaagagccctgccccccctgagaaccagaagcaagagcgaccccgtgctgcaccccagcgaggagagagccgcccccgtgctgagctgcgaggccgccacccagaccgagagaagactggacctggccgccgtgaccctgagaagaggcctgagaagcagagccagcagatgcagacccagaagcctgatcgactacaagagctacatggacaccaagctgctggtggccagattcctggagcagagcagctgcaccatgacccccgacatccacgagctggtggagaacatcaagagcgtgctgaagagcgacgaggagcacatggaggaggccatcaccagcgccagcttcctggagcagatcatggcccccctgcagcccagcaccagcagagcccacaagctgcccagcagaagacagcccggcctgctgcacctgcagagctgcggcgacctgcacaccttcacccccgccggcagacccagagccgagagaagacccagaagagtggaggccgagagaccccacagcctgatcggcgtgatcagagagaccgtgctgtag

SEQ ID NO: 18209 - DNA, 1353 bp, Artificial Sequence; identical to SEQ ID NO: 18205
  Description of Artificial Sequence: Synthetic coding sequence

SEQ ID NO: 18210 - DNA, 1074 bp, Artificial Sequence
  Description of Artificial Sequence: Synthetic coding sequence
atgggcctgagaggcgacagccaggccaccctgttcgacccccagctgcacgacggcagctgcatctgcgagagagtggccagcatcgtggacgtgagcatggacagcggcagcctggtgctgagcgccatcggcgacctgcccggcggcagcagccccagcgaggacagctgcctgctggagctgcagggcagcgtgagaagcgtggactacgtgctgttcagaagcatccagagaagcagagccggctactgcctgagcctggactgcggcctgagaggccccttcgaggagagccccctgcccagaagaccccccagagccgccagaagctacagctgcagcgcccccgaggcccccccccccctgggcgcccccaccgccgccagaagctgccacagactggagggctggcccccctgggtgggcccctgcttccccgacagcagcggcagcctgaccccccccggccacagacccccccaccccgccagccccccccccctgctgctgcccagaagccacagcgaccccggcatcaccaccagcagcgacaccgccgacttcagagacctgtacaccaaggtgctggaggaggaggccgccagcgtgagcagcgccgacaccggcctgtgcagcgaggcctgcctgttcagactggccagatgccccagccccaagctgctgagagccagaagcgccgagaagagaagacccgtgcccaccttccagaaggtgcccctgcccagcggccccgcccccgcccacagcctgggcgacctgaagggcagctggcccggcagaggcctggtgaccagattcctgcagatcagcagaaaggcccccgaccccagcggcaccggcgcccacggccacaagcaggtgcccagaagcctgtggggcagacccggcagagagagcctgcacctgagaagctgcggcgacctgagcagcagcagctgcggcgtgagctgcctggccgccggctggagcgtggtgcccgcccccaccgccagcgccagcaccggcgccgccggcagactgggcagcgacctgggcttcctgagccactag

SEQ ID NO: 18211 - DNA, 729 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcaacctgctgttcagcgtgtgcggcctgaccatctgcgccgccatcatctgcaccctgagcgccatcgtgtgctgcatccagatcttcagcctggacctggtgcacaccctggcccccgagagaagcgtgagcggccccctgggccccctgggctgcaccagccccccccccgcccccctgctgcacaccatgctggacctggaggagttcgtgccccccgtgcccccccccccctactacccccccgagtacacctgcagcagcgagaccgacgcccagagcatcacctacaacggcagcatggacagccccgtgcccctgtaccccaccgactgcccccccagctacgaggccgtgatgggcctgagaggcggcaagcagatcctggtgcccctgagaatgagagtggccctgagcgacctgcagggccactacggccagggcaagggcatggcccaggtgttcaagtacagagtgacctgcgcctacgccatgggctggtag

SEQ ID NO: 18212 - DNA, 1719 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcaacctgctgttcagcgtgtgcggcctgaccatctgcgccgccatcatctgcaccctgagcgccatcgtgtgctgcatccagatcttcagcctggacctggtgcacaccctggcccccgagagaagcgtgagcggccccctgggccccctgggctgcaccagccccccccccgcccccctgctgcacaccatgctggacctggaggagttcgtgccccccgtgcccccccccccctactacccccccgagtacacctgcagcagcgagaccgacgcccagagcatcacctacaacggcagcatggacagccccgtgcccctgtaccccaccgactgcccccccagctacgaggccgtgatgggcctgagaggcgacagccaggccaccctgttcgacccccagctgcacgacggcagctgcatctgcgagagagtggccagcatcgtggacgtgagcatggacagcggcagcctggtgctgagcgccatcggcgacctgcccggcggcagcagccccagcgaggacagctgcctgctggagctgcagggcagcgtgagaagcgtggactacgtgctgttcagaagcatccagagaagcagagccggctactgcctgagcctggactgcggcctgagaggccccttcgaggagagccccctgcccagaagaccccccagagccgccagaagctacagctgcagcgcccccgaggcccccccccccctgggcgcccccaccgccgccagaagctgccacagactggagggctggcccccctgggtgggcccctgcttccccgagctgagaagaagagtgcccagaggcggcggcagacccgccgccgccccccccaccagagcccccaccagaagattcagcgacagcagcggcagcctgaccccccccggccacagacccccccaccccgccagccccccccccctgctgctgcccagaagccacagcgaccccggcatcaccaccagcagcgacaccgccgacttcagagacctgtacaccaaggtgctggaggaggaggccgccagcgtgagcagcgccgacaccggcctgtgcagcgaggcctgcctgttcagactggccagatgccccagccccaagctgctgagagccagaagcgccgagaagagaagacccgtgcccaccttccagaaggtgcccctgcccagcggccccgcccccgcccacagcctgggcgacctgaagggcagctggcccggcagaggcctggtgaccagattcctgcagatcagcagaaaggcccccgaccccagcggcaccggcgcccacggccacaagcaggtgcccagaagcctgtggggcagacccggcagagagagcctgcacctgagaagctgcggcgacctgagcagcagcagcagcctgagaagactgctgagcggcagaagactggagagaggcaccagaccccacagcctgagcctgaacggcggcagcagagagaccggcctgtag

SEQ ID NO: 18213 - DNA, 2007 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcctggccttcagcggcgtggtgggcatcgtgagctggaagagacccttcaccctggtgatcagcttcttcagcctgctgagcgtgctgtgcgtgatgctgagcatggccggcagcgtgctgagctgcaagaacgcccagctggccagagacttccagcagtgcagcctggagggcaaggtgtgcgtgtgctgccccagcgtgcccctgctgagaccctgccccgagagcggccaggagctgaaggtggcccccaacagcacctgcgacgaggccagaggcgccctgaagaacctgctgttcagcgtgtgcggcctgaccatctgcgccgccatcatctgcaccctgagcgccatcgtgtgctgcatccagatcttcagcctggacctggtgcacaccctggcccccgagagaagcgtgagcggccccctgggccccctgggctgcaccagccccccccccgcccccctgctgcacaccatgctggacctggaggagttcgtgccccccgtgcccccccccccctactacccccccgagtacacctgcagcagcgagaccgacgcccagagcatcacctacaacggcagcatggacagccccgtgcccctgtaccccaccgactgcccccccagctacgaggccgtgatgggcctgagaggcgacagccaggccaccctgttcgacccccagctgcacgacggcagctgcatctgcgagagagtggccagcatcgtggacgtgagcatggacagcggcagcctggtgctgagcgccatcggcgacctgcccggcggcagcagccccagcgaggacagctgcctgctggagctgcagggcagcgtgagaagcgtggactacgtgctgttcagaagcatccagagaagcagagccggctactgcctgagcctggactgcggcctgagaggccccttcgaggagagccccctgcccagaagaccccccagagccgccagaagctacagctgcagcgcccccgaggcccccccccccctgggcgcccccaccgccgccagaagctgccacagactggagggctggcccccctgggtgggcccctgcttccccgagctgagaagaagagtgcccagaggcggcggcagacccgccgccgccccccccaccagagcccccaccagaagattcagcgacagcagcggcagcctgaccccccccggccacagacccccccaccccgccagccccccccccctgctgctgcccagaagccacagcgaccccggcatcaccaccagcagcgacaccgccgacttcagagacctgtacaccaaggtgctggaggaggaggccgccagcgtgagcagcgccgacaccggcctgtgcagcgaggcctgcctgttcagactggccagatgccccagccccaagctgctgagagccagaagcgccgagaagagaagacccgtgcccaccttccagaaggtgcccctgcccagcggccccgcccccgcccacagcctgggcgacctgaagggcagctggcccggcagaggcctggtgaccagattcctgcagatcagcagaaaggcccccgaccccagcggcaccggcgcccacggccacaagcaggtgcccagaagcctgtggggcagacccggcagagagagcctgcacctgagaagctgcggcgacctgagcagcagcagcagcctgagaagactgctgagcggcagaagactggagagaggcaccagaccccacagcctgagcctgaacggcggcagcagagagaccggcctgtag

SEQ ID NO: 18214 - DNA, 1953 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcatcagcttcttcagcctgctgagcgtgctgtgcgtgatgctgagcatggccggcagcgtgctgagctgcaagaacgcccagctggccagagacttccagcagtgcagcctggagggcaaggtgtgcgtgtgctgccccagcgtgcccctgctgagaccctgccccgagagcggccaggagctgaaggtggcccccaacagcacctgcgacgaggccagaggcgccctgaagaacctgctgttcagcgtgtgcggcctgaccatctgcgccgccatcatctgcaccctgagcgccatcgtgtgctgcatccagatcttcagcctggacctggtgcacacccagctggcccccgagagaagcgtgagcggccccctgggccccctgggctgcaccagccccccccccgcccccctgctgcacaccatgctggacctggaggagttcgtgccccccgtgcccccccccccctactacccccccgagtacacctgcagcagcgagaccgacgcccagagcatcacctacaacggcagcatggacagccccgtgcccctgtaccccaccgactgcccccccagctacgaggccgtgatgggcctgagaggcgacagccaggccaccctgttcgacccccagctgcacgacggcagctgcatctgcgagagagtggccagcatcgtggacgtgagcatggacagcggcagcctggtgctgagcgccatcggcgacctgcccggcggcagcagccccagcgaggacagctgcctgctggagctgcagggcagcgtgagaagcgtggactacgtgctgttcagaagcatccagagaagcagagccggctactgcctgagcctggactgcggcctgagaggccccttcgaggagagccccctgcccagaagaccccccagagccgccagaagctacagctgcagcgcccccgaggcccccccccccctgggcgcccccaccgccgccagaagctgccacagactggagggctggcccccctgggtgggcccctgcttccccgagctgagaagaagagtgcccagaggcggcggcagacccgccgccgccccccccaccagagcccccaccagaagattcagcgacagcagcggcagcctgaccccccccggccacagacccccccaccccgccagccccccccccctgctgctgcccagaagccacagcgaccccggcatcaccaccagcagcgacaccgccgacttcagagacctgtacaccaaggtgctggaggaggaggccgccagcgtgagcagcgccgacaccggcctgtgcagcgaggcctgcctgttcagactggccagatgccccagccccaagctgctgagagccagaagcgccgagaagagaagacccgtgcccaccttccagaaggtgcccctgcccagcggccccgcccccgcccacagcctgggcgacctgaagggcagctggcccggcagaggcctggtgaccagattcctgcagatcagcagaaaggcccccgaccccagcggcaccggcgcccacggccacaagcaggtgcccagaagcctgtggggcagacccggcagagagagcctgcacctgagaagctgcggcgacctgagcagcagcagcagcctgagaagactgctgagcggcagaagactggagagaggcaccagaccccacagcctgagcctgaacggcggcagcagagagaccggcctgtag

SEQ ID NO: 18215 - DNA, 435 bp, Artificial Sequence
  Description of Artificial Sequence: Synthetic coding sequence
atgatgcccagccccagcgacagcagcagaagcctgaccagcagacccagcaccagaggcctgacccacctgagactgcacagaccctggctgcaggccctgctgaccctgggcctggtgcaggtgctgctgggcatcctggtggtgaccttcagcatggtggccagcagcgtgaccaccaccgagagcatcaagagaagctgccccagctgggccggcttcagcaacctgctgttcagcgtgtgcggcctgaccatctgcgccgccatcatctgcaccctgagcgccatcgtgtgctgcatccagatcttcagcctggacctggtgcacaccctgaccagcggcaccttcatccccaagtgcctgagaaagaagctgctgctgttccccctgcagatccagggcagcgccctgaagcccgccagcagcgcctag

SEQ ID NO: 18216 - DNA, 1560 bp, Artificial Sequence
  Description of Artificial Sequence: Synthetic coding sequence
atgacctgccccgacaagcccggccagctgatcaactggttcatctgcagcctgtgcgtgcccagagtgagaaagctgtggagcagcagaagacccagaaccagaagaaacctgctgctgggcaccgcctgcgccatctacctgggcttcctggtgagccaggtgggcagagccagcctgcagcacggccaggccgccgagaagggcccccacagaagcagagacaccgccgagcccagcttccccgagatccccctggacggcaccctggccccccccgagagccagggcaacggcagcaccctgcagcccaacgtggtgtacatcaccctgagaagcaagagaagcaagcccgccaacatcagaggcaccgtgaagcccaagagaagaaagaagcacgccgtggccagcgccgcccccggccaggaggccctggtgggccccagcctgcagccccaggaggccgccagagaggccgacgccgtggcccccggctacgcccagggcgccaacctggtgaagatcggcgagagaccctggagactggtgagaggccccggcgtgagagccggcggccccgacttcctgcagcccagcagcagagagagcaacatcagaatctacagcgagagcgcccccagctggctgagcaaggacgacatcagaagaatgagactgctggccgacagcgccgtggccggcctgagacccgtgagcagcagaagcggcgccagactgctggtgctggagggcggcgcccccggcgccgtgctgagatgcggccccagcccctgcggcctgctgaagcagcccctggacatgagcgaggtgttcgccttccacctggacagaatcctgggcctgaacagaaccctgcccagcgtgagcagaaaggccgagttcatccaggacggcagaccctgccccatcatcctgtgggacgccagcctgagcagcgccagcaacgacacccacagcagcgtgaagctgacctggggcacctaccagcagctgctgaagcagaagtgctggcagaacggcagagtgcccaagcccgagagcggctgcaccgagatccaccaccacgagtggagcaagatggccctgttcgacttcctgctgcagatctacaacagactggacaccaactgctgcggcttcagacccagaaaggaggacgcctgcgtgcagaacggcctgagacccaagtgcgacgaccagggcagcgccgccctggcccacatcatccagagaaagcacgaccccagacacctggtgttcatcgacaacaagggcttcttcgacagaagcgaggacaacctgaacttcaagctgctggagggcatcaaggagttccccgccagcgccgtgagcgtgctgaagagccagcacctgagacagaagctgctgcagagcctgttcctggacaaggtgtactgggagagccagggcggcagacagggcatcgagaagctgatcgacgtgatcgagcacagagccaagatcctgatcacctacatcaacgcccacggcgtgaaggtgctgcccatgaacgagtag

SEQ ID NO: 18217 - DNA, 1560 bp, Artificial Sequence; identical to SEQ ID NO: 18216
  Description of Artificial Sequence: Synthetic coding sequence

SEQ ID NO: 18218 - DNA, 1560 bp, Artificial Sequence; identical to SEQ ID NO: 18216
  Description of Artificial Sequence: Synthetic coding sequence

SEQ ID NO: 18219 - DNA, 1584 bp, Artificial Sequence
  Description of Artificial Sequence: Synthetic coding sequence
atgacctgccccgacaagcccggccagctgatcaactggttcatctgcagcctgtgcgtgcccagagtgagaaagctgtggagcagcagaagacccagaaccagaagaaacctgctgctgggcaccgcctgcgccatctacctgggcttcctggtgagccaggtgggcagagccagcctgcagcacggccaggccgccgagaagggcccccacagaagcagagacaccgccgagcccagcttccccgagatccccctggacggcaccctggccccccccgagagccagggcaacggcagcaccctgcagcccaacgtggtgtacatcaccctgagaagcaagagaagcaagcccgccaacatcagaggcaccgtgaagcccaagagaagaaagaagcacgccgtggccagcgccgcccccggccaggaggccctggtgggccccagcctgcagccccaggaggccgccagagaggccgacgccgtggcccccggctacgcccagggcgccaacctggtgaagatcggcgagagaccctggagactggtgagaggccccggcgtgagagccggcggccccgacttcctgcagcccagcagcagagagagcaacatcagaatctacagcgagagcgcccccagctggctgagcaaggacgacatcagaagaatgagactgctggccgacagcgccgtggccggcctgagacccgtgagcagcagaagcggcgccagactgctggtgctggagggcggcgcccccggcgccgtgctgagatgcggccccagcccctgcggcctgctgaagcagcccctggacatgagcgaggtgttcgccttccacctggacagaatcctgggcctgaacagaaccctgcccagcgtgagcagaaaggccgagttcatccaggccgccgccgccgcctgcctgagcatgagactggccttcttcatcttccccgcctgggaggacatgagagtgcccggcaagtgctgcatcggccacgccagactgacctggggcacctaccagcagctgctgaagcagaagtgctggcagaacggcagagtgcccaagcccgagagcggctgcaccgagatccaccaccacgagtggagcaagatggccctgttcgacttcctgctgcagatctacaacagactggacaccaactgctgcggcttcagacccagaaaggaggacgcctgcgtgcagaacggcctgagacccaagtgcgacgaccagggcagcgccgccctggcccacatcatccagagaaagcacgaccccagacacctggtgttcatcgacaacaagggcttcttcgacagaagcgaggacaacctgaacttcaagctgctggagggcatcaaggagttccccgccagcgccgtgagcgtgctgaagagccagcacctgagacagaagctgctgcagagcctgttcctggacaaggtgtactgggagagccagggcggcagacagggcatcgagaagctgatcgacgtgatcgagcacagagccaagatcctgatcacctacatcaacgcccacggcgtgaaggtgctgcccatgaacgagtag

SEQ ID NO: 18220 - DNA, 996 bp, Artificial Sequence
  Description of Artificial Sequence: Synthetic coding sequence
atgacctgccccgacaagcccggccagctgatcaactggttcatctgcagcctgtgcgtgcccagagtgagaaagctgtggagcagcagaagacccagaaccagaagaaacctgctgctgggcaccgcctgcgccatctacctgggcttcctggtgagccaggtgggcagagccagcctgcagcacggccaggccgccgagaagggcccccacagaagcagagacaccgccgagcccagcttccccgagatccccctggacggcaccctggccccccccgagagccagggcaacggcagcaccctgcagcccaacgtggtgtacatcaccctgagaagcaagagaagcaagcccgccaacatcagaggcaccgtgaagcccaagagaagaaagaagcacgccgtggccagcgccgcccccggccaggaggccctggtgggccccagcctgcagccccaggaggccgccagagaggccgacgccgtggcccccggctacgcccagggcgccaacctggtgaagatcggcgagagaccctggagactggtgagaggccccggcgtgagagccggcggccccgacttcctgcagcccagcagcagagagagcaacatcagaatctacagcgagagcgcccccagctggctgagcaaggacgacatcagaagaatgagactgctggccgacagcgccgtggccggcctgagacccgtgagcagcagaagcggcgccagactgctggtgctggagggcggcgcccccggcgccgtgctgagatgcggccccagcccctgcggcctgctgaagcagcccctggacatgagcgaggtgttcgccttccacctggacagaatcctgggcctgaacagaaccctgcccagcgtgagcagaaaggccgagttcatccagggcaacagattcacctgcttcgtgatctgcagctgctggggcttctggttcatcttcttcttccccagcctgagcttcagcaagtag

SEQ ID NO: 18221 - DNA, 1608 bp, Artificial Sequence
  Description of Artificial Sequence: Synthetic coding sequence
atgacccccgagagcagagacaccaccgacctgagccccggcggcacccaggagatggagggcatcgtgatcgtgaaggtggaggaggaggacgaggaggaccacttccagaaggagagaaacaaggtggagagcagcccccaggtgctgagcagaagcaccaccatgaacgagagagccctgctgagcagctacctggtggcctacagagtggccaaggagaagatggcccacaccgccgccgagaagatcatcctgcccgcctgcatggacatggtgagaaccatcttcgacgacaagagcgccgacaagctgagaaccatccccctgagcgacaacaccatcagcagaagaatctgcaccatcgccaagcacctggaggccatgctgatcaccagactgcagagcggcatcgacttcgccatccagctggacgagagcaccgacatcgccagctgccccaccctgctggtgtacgtgagatacgtgtggcaggacgacttcgtggaggacctgctgtgctgcctgaacctgaacagccacatcaccggcctggacctgttcaccgagctggagaactgcctgctgggccagtacaagctgaactggaagcactgcaagggcatcagcagcgacggcaccgccaacatgaccggcaagcacagcagactgaccgagaagctgctggaggccacccacaacaacgccgtgtggaaccactgcttcatccacagagaggccctggtgagcaaggagatcagccccagcctgatggacgtgctgaagaacgccgtgaagaccgtgaacttcatcaagggcagcagcctgaacagcagactgctggagatcttctgcagcgagatcggcgtgaaccacacccacctgctgttccacaccgaggtgagatggctgagccagggcaaggtgctgagcagagtgtacgagctgagaaacgagatctacatcttcctggtggagaagcagagccacctggccaacatcttcgaggacgacatctgggtgaccaagctggcctacctgagcgacatcttcggcatcctgaacgagctgagcctgaagatgcagggcaagaacaacgacatcttccagtacctggagcacatcctgggcttccagaagaccctgctgctgtggcaggccagactgaagagcaacagacccagctactacatgttccccaccctgctgcagcacatcgaggagaacatcatcaacgaggactgcctgaaggagatcaagctggagatcctgctgcacctgaccagcctgagccagaccttcaactactacttccccgaggagaagttcgagagcctgaaggagaacatctggatgaaggaccccttcgccttccagaaccccgagagcatcatcgagctgaacctggagcccgaggaggagaacgagctgctgcagctgagcagcagcttcaccctgaagaactactacaagatcctgagcctgagcgccttctggatcaagatcaaggacgacttccccctgctgagcagaaagagcatcctgctgctgctgcccttcaccaccacctacctgtgcgagctgggcttcagcatcctgaccagatag

SEQ ID NO: 18222 - DNA, 1722 bp, Artificial Sequence
  Description of Artificial Sequence: Synthetic coding sequence
atgacccccgagagcagagacaccaccgacctgagccccggcggcacccaggagatggagggcatcgtgatcgtgaaggtggaggaggaggacgaggaggaccacttccagaaggagagaaacaaggtggagagcagcccccaggtgctgagcagaagcaccaccatgaacgagagagccctgctgagcagctacctggtggcctacagagtggccaaggagaagatggcccacaccgccgccgagaagatcatcctgcccgcctgcatggacatggtgagaaccatcttcgacgacaagagcgccgacaagctgagaaccatccccctgagcgacaacaccatcagcagaagaatctgcaccatcgccaagcacctggaggccatgctgatcaccagactgcagagcggcatcgacttcgccatccagctggacgagagcaccgacatcgccagctgccccaccctgctggtgtacgtgagatacgtgtggcaggacgacttcgtggaggacctgctgtgctgcctgaacctgaacagccacatcaccggcctggacctgttcaccgagctggagaactgcctgctgggccagtacaagctgaactggaagcactgcaagggcatcagcagcgacggcaccgccaacatgaccggcaagcacagcagactgaccgagaagctgctggaggccacccacaacaacgccgtgtggaaccactgcttcatccacagagaggccctggtgagcaaggagatcagccccagcctgatggacgtgctgaagaacgccgtgaagaccgtgaacttcatcaagggcagcagcctgaacagcagactgctggagatcttctgcagcgagatcggcgtgaaccacacccacctgctgttccacaccgaggtgagatggctgagccagggcaaggtgctgagcagagtgtacgagctgagaaacgagatctacatcttcctggtggagaagcagagccacctggccaacatcttcgaggacgacatctgggtgaccaagctggcctacctgagcgacatcttcggcatcctgaacgagctgagcctgaagatgcagggcaagaacaacgacatcttccagtacctggagcacatcctgggcttccagaagaccctgctgctgtggcaggccagactgaagagcaacagacccagctactacatgttccccaccctgctgcagcacatcgaggagaacatcatcaacgaggactgcctgaaggagatcaagctggagatcctgctgcacctgaccagcctgagccagaccttcaactactacttccccgaggagaagttcgagagcctgaaggagaacatctggatgaaggaccccttcgccttccagaaccccgagagcatcatcgagctgaacctggagcccgaggaggagaacgagctgctgcagctgagcagcagcttcaccctgaagaactactacaagatcctgagcctgagcgccttctggatcaagatcaaggacgacttccccctgctgagcagaaagagcatcctgctgctgctgcccttcaccaccacctacctgtgcgagctgggcttcagcatcctgaccagactgaagaccaagaagagaaacagactgaacagcgcccccgacatgagagtggccctgagcagctgcgtgcccgactggaaggagctgatgaacagacaggcccaccccagccactag

SEQ ID NO: 18223 - DNA, 4008 bp, Artificial Sequence
  Description of Artificial Sequence: Synthetic coding sequence
atgctgagccccaccttcgtgctgtgggaggtgggctaccccctgtacatctacggcagcatcttcatcgtgatcgtgatcatctggcaggtgaagagaagccaccacgagctgagcagcgagcccaagagaagctgctgcagatgccaccagaaggtgagacagagagccagagacgccgccagcaccgccagaagaagaagcagagaggaggccgagaagccccagaagctgctgagcatcatcaagagccagggctggctgcccctggagagaagcgtgagaagaatcctgtgcgccgacccctgctgccagatctgcaacagcgtggccctggagatccagcagctgctggtgggcgagaacaaccagatcagcctgaccctgagcggccccctgcagggcagcagctgcctggagatgctgagcaccagcagcatgagcctggaccagagcctggagttccacagctggcacaccagagagctgagcctgagcagcgtgacccccaccctgagccagctgaccgaccagaagagcctgacccagagcgccgcccagagcacctacgccgacggcatccaggactactgggccgaccacctgcagctgggccaggagttccaggtgcccgacgtgctgagaggccccaacaccatcgccagcagcagaatcgagaagcccagagcccccctgaaccaggaggagatgacccagagcaaccccagcctggtgcagggcaaccagggccagcaccacctgaacagccaggtgagcctgctgagcctgaaccccgagaccctgaacagaatgcaccccatggccctgcacatggtgctgcccgcccacctgcccttcctgagccccgaggtgctgagactgctggaggtgcacgtgaagaagtggatgcacttccagagatggggcctgcccagaagagtggaggagagcctgagacagctgatgcccaacccccccctgtactaccagcccggcaacgaccagcccgtgagcttcaacctgaagaacaccccccaggtgagcctgcacagattcgagaccatcagcctgcagacctggtgcagctgcgtggccggccagcccatccagaccttctgggtgagcgagtggagcaccatgaaccccgagcagagacaccactgccagcagacccccaaccccatggccctggccctgcccagccccgccctgaaggccctgagcggcccccacccccagagcggcggccaggacaacgacagcggcagcgacctgcagcagaagtacagccagctgttctgcggcctgcccagcctgcacagcgagagcctggtggccaccttcatgggcagccagggcctgcccaagatcgagaacgtgcccaagccccccctgaaggaccccttcctgttcaacgagctgagcttcccccagctgctgcccaagaccagcccccagagcgccccccccagcagccccctgagccccaactggatgagccccagcgaccaccagagagcccagatcaacgtgcccttcctgaccctggccgagtacgaggccctggagtggcacctgctgcagagacagctgcagctgcagtggggctggcccgccgccctgcagagaagccagcacacccagtgcctgatgcagcacgagccctgcggcaaggcccagagccccgagaccaccaccgccagccagaccggcaagagcatcagcgtgctgaccagagagctgctgttcttccccgagcacgccagaaagctgctggagttccacatccagaagcagctgatcagacacagatggggcctgccccagaagatccagcagagcatccagctgctgctgaccagcaccgaccagcagaccgtgagcagcagcagcaccgccctggccaacgtgagcatcccccagcccgtggccctggaggccaacggcgcctgcgacgtgctgagccccatcgccgcccccgtgagcatccccagaccccacctgctgacccaggtgaaggccatcctgcagagccacatcgacagcaagtgcggccagatccaccagggcaagatccccgcctgcgtgcacagaagctgggactgcagaatcagcggcgtgctggccgtggcccccttcccctgcatccccgagagccagttcctggagctgcagaccgccagcgaccccgacctgcaccacaaggtgatgccctggatgcccaccgccctggaccagcagcagcaggccctgcccggcaccgtgaccgagcaccccaagctgctgagagtgctgagcgtggaggccatcgagaagctggagaccaccctgagacacaagcacctggccttcctgagcggcctgcccgccctgtactacgtggccctgcccagagccctggcccccgccgtgaccagccagagcgtgatcaccgagatggagcccagccccgtggagatccccgccgagcccctgatccagatggtgagcttcgaggagcagtgcatcagcctgggcccctgcccccagggcaacaacgagagctgcaccgacgtggccaaggagttccagcccgccgtgcccgtgaagggcaccatggagaccctgcccctggagagccagacccaccccaccagcccccacagcctgcagacccacatcctgaccaagctgaacttccacctgagaaagaaggtgctggagatccagtggggcatccccatcagagccagaaagagcagagagcagaccgtggccgcccccgagaacatcagcacccagaagagcctggagagcctgaaccaccagggcgagaccctgctgcaggagctgcccatcccccccgacaccctgcccgcccccaaccccgagggcgtgcacctgaaggagcagctggccaacgacctgaaggccgtgcagcagaaccagaagcagagcaacagcaaggccgtgccccagggcagcgcccacagcgtgagcaagatcagccagcccagcggcgacatgaccgaggcccacatgccctgcgtgcaggtggaggccaacgtgaacaagcccagcctggaggagccctgcggccccgagccccagagccccagcaagagcaaggaccccgcccacgtgcccatgctggccggcaacagagaggaccccgaggagaccaaggccgccagagaccacagagagggcgacgccggcttcggcagaagcagcaccagagaggagagaagacccgccgaggaccagagacccgccggcatgctgcccaacaagacccccagaggcagctggagatggagcagaagcttccacctggccgacccctgccagcacagcccccagcaccacccccagctgaagctgccccagctgccccccagagtgcccggcgagaaggagagcgagaaggacctgcaggacagccagaccaagctgaccgtgatcctggagcccgccaccatccccgagaacgcccagaccgtgctgccccaggccagccagggccagcccttcctgagccagcccacccaggccaagcccctgcagggccagaccctgcagggccaggtgctgcacggcctggtgatgcccgtgcacgcccagaagaagcccagcctgaccgagagcagcttcagaaacaagatcaagtgcttcctgcagcacatcaaccccaagaccaagggcaagggccacgaggacagcatgttcagcgccgccgccaaggtggccaagaccagaaaggagaacgtggccaagagcctggcccccgccaagagccccgtgggcagaagcaagaccgagaagcccaccggctgcagcaaggcccagagcagacccgcccagaagctggtgggccccgccttcctggacggcccccagagcctggacgacaagctgagactgcacagcagacagcccggcagcgccagcgccctgggctaccccagacactgccccagacactgccccagagaggcctgcgccaacaagcccggccaccccacctag

SEQ ID NO: 18224 - DNA, 516 bp, Artificial Sequence
  Description of Artificial Sequence: Synthetic coding sequence
atgtggaccctgaagagcagcctggtgctgctgctgtgcctgacctgcagctacgccttcatgttcagcagcctgagacagaagaccagcgagccccagggcaaggtgcagtacggcgagcacttcagaatcagacagaacctgcccgagcacacccagggctggctgggcagcaagtggctgtggctgctgttcgtggtggtgcccttcgtgatcctgcagtgccagagagacagcgagaagaacaaggagcagagcccccccggcctgagaggcggccagctgcacagccccctgaagaagaagagaaacgccagccccaacaaggactgcgccttcaacaccctgatggagctggaggtggagctgatgaagttcgtgagcaaggtgagaaacctgaagagagccatggccaccggcagcggcagcaacctgagactgagaaagagcgagatgcccgccgacccctaccacgtgaccatctgcgagatctggggcgaggagagcagcagctag

SEQ ID NO: 18225 - DNA, 516 bp, Artificial Sequence
  Description of Artificial Sequence: Synthetic coding sequence
atgtggaccctgaagagcagcctggtgctgctgctgtgcctgacctgcagctacgccttcatgttcagcagcctgagacagaagaccagcgagccccagggcaaggtgccctgcggcgagcacttcagaatcagacagaacctgcccgagcacacccagggctggctgggcagcaagtggctgtggctgctgttcgccgtggtgcccttcgtgatcctgcagtgccagagagacagcgagaagaacaaggagcagagcccccccggcctgagaggcttccccttcagaacccccctgaagaagaaccagaacgccagcctgtacaaggactgcgtgttcaacaccctgaacgagctggaggtggagctgctgaagttcgtgagcgaggtgcagaacctgaagggcgccatggccaccggcagcggcagcaacctgaagctgagaagaagcgagatgcccgccgacccctaccacgtgaccatctgcaagatctggggcgaggagagcagcagctag

SEQ ID NO: 18226 - DNA, 4026 bp, Artificial Sequence
  Description of Artificial Sequence: Synthetic coding sequence
atgatgaacagaaccacccccgaccaggagctggcccccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccctggtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18227 - DNA, 3840 bp, Artificial Sequence
  Description of Artificial Sequence: Synthetic coding sequence
atgatgaacagaaccacccccgaccaggagctggcccccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccctggtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18228 - DNA, 3963 bp, Artificial Sequence
  Description of Artificial Sequence: Synthetic coding sequence
atgatgaacagaaccacccccgaccaggagctggcccccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccctggtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18229 - DNA, 3762 bp, Artificial Sequence
  Description of Artificial Sequence: Synthetic coding sequence
atgcccagactgagcggcaagagcgtgagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccctggtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18230 - DNA, 3204 bp, Artificial Sequence
  Description of Artificial Sequence: Synthetic coding sequence
atgaacagaaccacccccgaccaggagctggcccccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccctggtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagttcggcaagctgtggcccccccactgccacatcctgctgatcaagttctactggaacacctag

SEQ ID NO: 18231 - DNA, 471 bp, Artificial Sequence
  Description of Artificial Sequence: Synthetic coding sequence
agcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggtgagaaaccccctgtag

SEQ ID NO: 18232 - DNA, 3672 bp, Artificial Sequence
  Description of Artificial Sequence: Synthetic coding sequence
agagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcaccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccagcgtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcagaggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaacaccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18233 - DNA, 3762 bp, Artificial Sequence
  Description of Artificial Sequence: Synthetic coding sequence
atgcccagactgagcggcaagagcgtgagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaacagacacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccgtgggcagagtggacgaggagcccaccaccctgcccagcggcgaggccaagcccagaaagaccctgaaggagaagaaggagagaagaacccccagcgacgacgaggaggacaacctgttcaccccccccaagctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccagcgtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcagaggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaacaccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18234 - DNA, 828 bp, Artificial Sequence
  Description of Artificial Sequence: Synthetic coding sequence
gagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagtag

SEQ ID NO: 18235 - DNA, 2769 bp, Artificial Sequence
  Description of Artificial Sequence: Synthetic coding sequence
atgagaaagagaatgatgatggccgtgaccttcagcctgaccctgagaagaagaagaaagatcctgagaaccctgaagaagatcctggacctgaaggaggccgacctgcacagactgcagatgagctggctgcccgccagcagaggcatgccctgggtggagtggaccagaagcagacagccctacccccaggagaagcagaacctgggcagacacagcaagagaagaagaaagggcgagctgctgcagaccatgaagagaatcacctacagccacccccccctgaccgacgaggacttcagccccttcggcagcggcggcggcctgttcagcggcggcaagggcctgttcgacgacgaggacgaggagagcgacctgttcaccgaggccccccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcatgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagcagcagcaagaacctgaagcccagcagcgagaccaagacccagaagggcctgttcagcgacgaggaggacagcgaggacctgttcagcagccagagcgccagcaagctgaagggcgccagcctgctgcccggcaagctgcccaccagcgtgagcctgttcgacgacgaggacgaggaggacaacctgttcggcggcaccgccgccaagaagcagaccctgtgcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacgaggaggacgacctgttcgccatcgccaaggacagccagaagaagacccagagagtgagcctgctgttcgaggacgacgtggacagcagaggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagttcggcaagctgtggcccccccactgccacatcctgctgatcaagttctactggaacacctag

SEQ ID NO: 18236 - DNA, 1533 bp, Artificial Sequence
  Description of Artificial Sequence: Synthetic coding sequence
atggaggaccagaacatcatccaggccccccagaaggaggtgggcaagggcagagaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtggacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgagaccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacagaagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaacaccttccccctgctggaggacgaggacgacctgttcaccgaccagaaggtgaagaagaacgagaccaagagcaacagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcagcggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 18237 - DNA, 819 bp, Artificial Sequence
  Description of Artificial Sequence: Synthetic coding sequence
atgcagtggaacgtgcccagaaccgtgagcagactggccagaagaacctgcctggagccccacaacgccggcctgttcggccactgccagaacgtgaagggccccctgctgctgtacaacgccgagagcaaggtggtgctggtgcagggcccccagaagcagtggctgcacctgagcgccgcccagtgcgtggccaaggagagaagacccctggacgcccaccccccccagcccggcgtgctgagacacaagcagggcaagcagcacgtgagcttcagaagagtgttcagcagcagcgccaccgcccagggcacccccgagaagaaggaggagcccgaccccctgcaggacaagagcatcagcctgtaccagagattcaagaagaccttcagacagtacggcaaggtgctgatccccgtgcacctgatcaccagcggcgtgtggttcggcaccttctactacgccgccctgaagggcgtgaacgtggtgcccttcctggagctgatcggcctgcccgacagcgtggtgagcatcctgaagaacagccagagcggcaacgccctgaccgcctacgccctgttcaagatcgccacccccgccagatacaccgtgaccctgggcggcaccagcgtgaccgtgaagtacctgagaagccacggctacatgagcacccccccccccgtgaaggagtacctgcaggacagaatggaggagaccaaggagctgatcaccgagaagatggaggagaccaaggacagactgaccgagaagctgcaggagaccaaggagaaggtgagcttcaagaagaaggtggagtag

SEQ ID NO: 18238 - DNA, 819 bp, Artificial Sequence; identical to SEQ ID NO: 18237
  Description of Artificial Sequence: Synthetic coding sequence

SEQ ID NO: 18239 - DNA, 579 bp, Artificial Sequence
  Description of Artificial Sequence: Synthetic coding sequence
atggccggcctgctggccctgctgggccccgccggcagagtgggcgccagagtgagacccagagccacctggctgctgggcgccaccgccccctgcgcccccccccccctggccctggccctgctgccccccagactggacgccagactgctgagaaccgccagaggcgactgcagaggccaccaggaccccagccaggccaccggcaccaccggcagcagcgtgagctgcaccgaggagaagaagcagagcaagagccagcagctgaagaagatcttccaggagtacggcaccgtgggcgtgagcctgcacatcggcatcagcctgatcagcctgggcatcttctacatggtggtgagcagcggcgtggacatgcccgccatcctgctgaagctgggcttcaaggagagcctggtgcagagcaagatggccgccggcaccagcaccttcgtggtggcctacgccatccacaagctgttcgcccccgtgagaatcagcatcaccctggtgagcgtgcccctgatcgtgagatacttcagaaaggtgggcttcttcaagccccccgccgccaagccctag

SEQ ID NO: 18240 - DNA, 945 bp, Artificial Sequence
  Description of Artificial Sequence: Synthetic coding sequence
atgtgccccaccctgaacaacatcgtgagcagcctgcagagaaacggcatcttcatcaacagcctgatcgccgccctgaccatcggcggccagcagctgttcagcagcagcaccttcagctgcccctgccaggtgggcaagaacttctactacggcagcgccttcctggtgatccccgccctgatcctgctggtggccggcttcgccctgagaagccagatgtggaccatcaccggcgagtactgctgcagctgcgcccccccctacagaagaatcagccccctggagtgcaagctggcctgcctgagattcttcagcatcaccggcagagccgtgatcgcccccctgacctggctggccgtgaccctgctgaccggcacctactacgagtgcgccgccagcgagttcgccagcgtggaccactaccccatgttcgacaacgtgagcgccagcaagagagaggagatcctggccggcttcccctgctgcagaagcgcccccagcgacgtgatcctggtgagagacgagatcgccctgctgcacagataccagagccagatgctgggctggatcctgatcaccctggccaccatcgccgccctggtgagctgctgcgtggccaagtgctgcagccccctgaccagcctgcagcactgctactggaccagccacctgcagaacgagagagagctgttcgagcaggccgccgagcagcacagcagactgctgatgatgcacagaatcaagaagctgttcggcttcatccccggcagcgaggacgtgaagcacatcagaatccccagctgccaggactggaaggacatcagcgtgcccaccctgctgtgcatgggcgacgacctgcagggccactacagcttcctgggcaacagagtggacgaggacaacgaggaggacagaagcagaggcatcgagctgaagccctag

SEQ ID NO: 18241 - DNA, 387 bp, Artificial Sequence
  Description of Artificial Sequence: Synthetic coding sequence
atgctgggctggatcctgatcaccctggccaccatcgccgccctggtgagctgctgcgtggccaagtgctgcagccccctgaccagcctgcagcactgctactggaccagccacctgcagaacgagagagagctgttcgagcaggccgccgagcagcacagcagactgctgatgatgcacagaatcaagaagctgttcggcttcatccccggcagcgaggacgtgaagcacatcagaatccccagctgccaggactggaaggacatcagcgtgcccaccctgctgtgcatgggcgacgacctgcagggccactacagcttcctgggcaacagagtggacgaggacaacgaggaggacagaagcagaggcatcgagctgaagccctag

SEQ ID NO: 18242 - DNA, 516 bp, Artificial Sequence
  Description of Artificial Sequence: Synthetic coding sequence
atgttcgacaacgtgagcgccagcaagagagaggagatcctggccggcttcccctgctgcagaagcgcccccagcgacgtgatcctggtgagagacgagatcgccctgctgcacagataccagagccagatgctgggctggatcctgatcaccctggccaccatcgccgccctggtgagctgctgcgtggccaagtgctgcagccccctgaccagcctgcagcactgctactggaccagccacctgcagaacgagagagagctgttcgagcaggccgccgagcagcacagcagactgctgatgatgcacagaatcaagaagctgttcggcttcatccccggcagcgaggacgtgaagcacatcagaatccccagctgccaggactggaaggacatcagcgtgcccaccctgctgtgcatgggcgacgacctgcagggccactacagcttcctgggcaacagagtggacgaggacaacgaggaggacagaagcagaggcatcgagctgaagccctag

SEQ ID NO: 18243 - DNA, 513 bp, Artificial Sequence
  Description of Artificial Sequence: Synthetic coding sequence
atggcccccagaagcgccaaggagaccttcagaatcaaccccaacgtggccgccaacctgagcgcccccagcgacgtgatcctggtgagagacgagatcgccctgctgcacagataccagagccagatgctgggctggatcctgatcaccctggccaccatcgccgccctggtgagctgctgcgtggccaagtgctgcagccccctgaccagcctgcagcactgctactggaccagccacctgcagaacgagagagagctgttcgagcaggccgccgagcagcacagcagactgctgatgatgcacagaatcaagaagctgttcggcttcatccccggcagcgaggacgtgaagcacatcagaatccccagctgccaggactggaaggacatcagcgtgcccaccctgctgtgcatgggcgacgacctgcagggccactacagcttcctgggcaacagagtggacgaggacaacgaggaggacagaagcagaggcatcgagctgaagccctag

SEQ ID NO: 18244 - DNA, 372 bp, Artificial Sequence
  Description of Artificial Sequence: Synthetic coding sequence
atgctgggctggatcctgatcaccctggccaccatcgccgccctggtgagctgctgcgtggccaagtgctgcagccccctgaccagcctgcagcactgctactggaccagccacctgcagaacgagagagagctgttcgagcaggccgccgagcagcacagcagactgctgatgatgcacagaatcaagaagctgttcggcttcatccccggcagcgaggacgtgaagcacatcagaatccccagctgccaggactggaaggacatcagcgtgcccaccctgctgtgcatgggcgacgacctgcagggccactacagcttcctgggcaacagagtggacgaggacaacgaggaggacagaagcagaggctag

SEQ ID NO: 18245 - DNA, 930 bp, Artificial Sequence
  Description of Artificial Sequence: Synthetic coding sequence
atggacgccttccagggcatcctgaagttcttcctgaaccagaagaccgtgatcggctacagcttcatggccctgctgaccgtgggcagcgagagactgttcagcgtggtggccttcaagtgcccctgcagcaccgagaacatgacctacggcctggtgttcctgttcgcccccgcctgggtgctgctgatcctgggcttcttcctgaacaacagaagctggagactgttcaccggctgctgcgtgaaccccagaaagatcttccccagaggccacagctgcagattcttctacgtgctgggccagatcaccctgagcagcctggtggcccccgtgatgtggctgagcgtggccctgctgaacggcaccttctacgagtgcgccatgagcggcaccagaagcagcggcctgctggagctgatctgcaagggcaagcccaaggagtgctgggaggagctgcacaaggtgagctgcggcaagaccagcatgctgcccaccgtgaacgaggagctgaagctgagcctgcaggcccagagccagatcctgggctggtgcctgatctgcagcgccagcttcttcagcctgctgaccacctgctacgccagatgcagaagcaaggtgagctacctgcagctgagcttctggaagacctacgcccagaaggagaaggagcagctggagaacaccttcctggactacgccaacaagctgagcgagagaaacctgaagtgcttcttcgagaacaagagacccgaccccttccccatgcccaccttcgccgcctgggaggccgccagcgagctgcacagcttccaccagagccagcagcactacagcaccctgcacagagtggtggacaacggcctgcagctgagccccgaggacgacgagaccaccatggtgctggtgggcaccgcccacaacatgtag

SEQ ID NO: 18246 - DNA, 948 bp, Artificial Sequence
  Description of Artificial Sequence: Synthetic coding sequence
atggagaagttcagagccgtgctggacctgcacgtgaagcaccacagcgccctgggctacggcctggtgaccctgctgaccgccggcggcgagagaatcttcagcgccgtggccttccagtgcccctgcagcgccgcctggaacctgccctacggcctggtgttcctgctggtgcccgccctggccctgttcctgctgggctacgtgctgagcgccagaacctggagactgctgaccggctgctgcagcagcgccagagccagctgcggcagcgccctgagaggcagcctggtgtgcacccagatcagcgccgccgccgccctggcccccctgacctgggtggccgtggccctgctgggcggcgccttctacgagtgcgccgccaccggcagcgccgccttcgcccagagactgtgcctgggcagaaacagaagctgcgccgccgagctgcccctggtgccctgcaaccaggccaaggccagcgacgtgcaggacctgctgaaggacctgaaggcccagagccaggtgctgggctggatcctgatcgccgtggtgatcatcatcctgctgatcttcaccagcgtgaccagatgcctgagccccgtgagcttcctgcagctgaagttctggaagatctacctggagcaggagcagcagatcctgaagagcaaggccaccgagcacgccaccgagctggccaaggagaacatcaagtgcttcttcgagggcagccaccccaaggagtacaacacccccagcatgaaggagtggcagcagatcagcagcctgtacaccttcaaccccaagggccagtactacagcatgctgcacaagtacgtgaacagaaaggagaagacccacagcatcagaagcaccgagggcgacaccgtgatccccgtgctgggcttcgtggacagcagcggcatcaacagcacccccgagctgtag

SEQ ID NO: 18247 - DNA, 204 bp, Artificial Sequence
  Description of Artificial Sequence: Synthetic coding sequence
atgagaaagccccaggccggcaccggcgaggccgccagagaccccagcctgagacccgccagaaccgtgctggtgggcgaccaggacgagtacaccgccgccgagaacaagagccccagaggcaccctgtgccccaccggcgagcagagaatccacgccagagaggacgcctgcatcttcagcagactgttcagcgagaagtag

SEQ ID NO: 18248 - DNA, 393 bp, Artificial Sequence
  Description of Artificial Sequence: Synthetic coding sequence
atggccgccccccccgagcccggcgagcccgaggagagaaaggccagctgcaccagcctgcacctgagctactggaagagcctgaagctgctgggcttcctggacgtggagaacaccccctgcgccagacacagcatcctgtacggcagcctgggcagcgtggtggccggcttcggccacttcctgttcaccagcagaatcagaagaagctgcgacgtgggcgtgggcggcttcatcctggtgaccctgggctgctggttccactgcagatacaactacgccaagcagagaatccaggagagaatcgccagagaggagatcaagaagaagatcctgtacgagggcacccacctggaccccgagagaaagcacaacggcagcagcagcaactag

SEQ ID NO: 18249 - DNA, 357 bp, Artificial Sequence
  Description of Artificial Sequence: Synthetic coding sequence
atggccgccccccccgagcccggcgagcccgaggagagaaagagcctgaagctgctgggcttcctggacgtggagaacaccccctgcgccagacacagcatcctgtacggcagcctgggcagcgtggtggccggcttcggccacttcctgttcaccagcagaatcagaagaagctgcgacgtgggcgtgggcggcttcatcctggtgaccctgggctgctggttccactgcagatacaactacgccaagcagagaatccaggagagaatcgccagagaggagatcaagaagaagatcctgtacgagggcacccacctggaccccgagagaaagcacaacggcagcagcagcaactag

SEQ ID NO: 18250 - DNA, 1680 bp, Artificial Sequence
  Description of Artificial Sequence: Synthetic coding sequence
atggtggagaagatcctgatccacagaatcctgaccctgttccccaacgccatcgccagaaagctgctgctgatgctgaccttcatcctgatcttctggatcatctacctggccagcaaggaccacaccaagttcagcttcaacctggagaaccacatcatcctgaaccagggcaacatcttcaagaagtacagccacagcgagacccccctgtgccccgccgtgagccccaaggagaccgagctgagaatcaaggacatcatggagaagctggaccagcagatcccccccagacccttcacccacgtgaacaccaccaccagcgccacccacagcaccgccaccatcctgaacccccaggacacctactgcagaggcgaccagctggacatcctgctggaggtgagagaccacctgggccacagaaagcagtacggcggcgacttcctgagagccagaatgtacagcaccgccctgatggccggcgccagcggcaaggtgaccgacttcaacaacggcacctacctggtgagcttcaccctgttctgggagggccaggtgagcctgagcctgctgctgatccaccccagcgagggcgtgagcgccctgtggagagccagaaaccagggctgcgacagaatcatcttcaccggcctgttcgccaacagaagcagcaacgtgttcaccgagtgcggcctgaccctgaacaccaacgccgagctgtgccagtacatggacgacagagaccaggaggccttctactgcgtgagaccccagcacatgccctgcgaggccctgacccacatgaccaccagaaccagaaacatcagctacctgagcaaggaggagtggagactgttccacagaagcaacatcggcgtggagatgatgaagaacttcacccccatcgaggtgatcccctgcaacaagagcgagaacatcaagaagaactgccagatcggcatgaagacccccttccccagcggctacaccctgaagaagatgtggatcaccgccttctgcaagcagatcaagttcaacgagaccaagaacatcaacgactgcctggagagaaagctgatctacctgatgggcgacagcaccctgcaccagtggatctactacctgcagaaggccgtgaagaccctgaagtacttcgaccaccacggcgccggcatcttcaagacccacgtgctgctggacgtggagagacacatcctgatccagtggaagaagcacggccaccccttcgtgaccaagaagctgttcagcgtgaaggacgagaactacatccccagagagatcgaccaggtggccggcgacaagaacaccgccatcgtgatcaccctgggccagcacttcagacccttccccatcaacatcttcatcagaagagccatcaacatccagaaggccatcgagagactgttcctgagaagccccgagaccaaggtgatcctgaagaccgagaacaccagagagatcgagcagaacgccgagatgttcagcgacttccacggctacatccagaacctgatcatcagagacatcttcgtggacctgaacgtgggcatcatcgacgcctgggacatgaccatcgcctactgcaccaacaacgcccacccccccgactacgtgatccagaaccagatcggcatgttcctgaactacatctgctag

SEQ ID NO: 18251 - DNA, 1098 bp, Artificial Sequence
  Description of Artificial Sequence: Synthetic coding sequence
atggtggagaagatcctgatccacagaatcctgaccctgttccccaacgccatcgccagaaagctgctgctgatgctgaccttcatcctgatcttctggatcatctacctggccagcaaggaccacaccaagttcagcttcaacctggagaaccacatcatcctgaaccagggcaacatcttcaagaagtacagccacagcgagacccccctgtgccccgccgtgagccccaaggagaccgagctgagaatcaaggacatcatggagaagctggaccagcagatcccccccagacccttcacccacgtgaacaccaccaccagcgccacccacagcaccgccaccatcctgaacccccaggacacctactgcagaggcgaccagctggacatcctgctggaggtgagagaccacctgggccacagaaagcagtacggcggcgacttcctgagagccagaatgtacagcaccgccctgatggccggcgccagcggcaaggtgaccgacttcaacaacggcacctacctggtgagcttcaccctgttctgggagggccaggtgagcctgagcctgctgctgatccaccccagcgagggcgtgagcgccctgtggagagccagaaaccagggctgcgacagaatcatcttcaccggcctgttcgccaacagaagcagcaacgtgttcaccgagtgcggcctgaccctgaacaccaacgccgagctgtgccagtacatggacgacagagaccaggaggccttctactgcgtgagaccccagcacatgccctgcgaggccctgacccacatgaccaccagaaccagaaacatcagctacctgagcaaggaggagtggagactgttccacagaagcaacatcggcgtggagatgatgaagaacttcacccccatcgaggtgatcccctgccccgccctgttctacttcatcttcagagacagcctgaccctgagccccagactggagtgcagcggcatgatcagcgcccactgcaacctgtgcctgcccggcagcagcgacagccccgacagcgccagccacgtggccggcatcaccagcgtgcagagacacacctggctgtag

SEQ ID NO: 18252 - DNA, 726 bp, Artificial Sequence
  Description of Artificial Sequence: Synthetic coding sequence
tgacagaccgccagatgccacagcggcctggtgagcagcgtgcaggccatcatggccagcaccgccggctacatcgtgagcaccagctgcaagcacatcatcgacgaccagcactggctgagcagcgcctacacccagttcgccgtgccctacttcatctacgacatctacgccatgttcctgtgccactggcacaagcaccaggtgaagggccacggcggcgacgacggcgccgccagagcccccggcagcacctgggccatcgccagaggctacctgcacaaggagttcctgatggtgctgcaccacgccgccatggtgctggtgtgcttccccctgagcgtggtgtggagacagggcaagggcgacttcttcctgggctgcatgctgatggccgaggtgagcacccccttcgtgtgcctgggcaagatcctgatccagtacaagcagcagcacaccctgctgcacaaggtgaacggcgccctgatgctgctgagcttcctgtgctgcagagtgctgctgttcccctacctgtactgggcctacggcagacacgccggcctgcccctgctggccgtgcccctggccatccccgcccacgtgaacctgggcgccgccctgctgctggccccccagctgtactggttcttcctgatctgcagaggcgcctgcagactgttctggcccagaagcagacccccccccgcctgccaggcccaggactag

SEQ ID NO: 18253 - DNA, 825 bp, Artificial Sequence
  Description of Artificial Sequence: Synthetic coding sequence
atgctgacccccatggtggccggcggcgtggtgttccccggcctgttcctgctgagcaagaacaccctgcagagactgccccagctgagatgggaggaggccgacgccgtgatcgtgagcgccagactggtgagcagcgtgcaggccatcatggccagcaccgccggctacatcgtgagcaccagctgcaagcacatcatcgacgaccagcactggctgagcagcgcctacacccagttcgccgtgccctacttcatctacgacatctacgccatgttcctgtgccactggcacaagcaccaggtgaagggccacggcggcgacgacggcgccgccagagcccccggcagcacctgggccatcgccagaggctacctgcacaaggagttcctgatggtgctgcaccacgccgccatggtgctggtgtgcttccccctgagcgtggtgtggagacagggcaagggcgacttcttcctgggctgcatgctgatggccgaggtgagcacccccttcgtgtgcctgggcaagatcctgatccagtacaagcagcagcacaccctgctgcacaaggtgaacggcgccctgatgctgctgagcttcctgtgctgcagagtgctgctgttcccctacctgtactgggcctacggcagacacgccggcctgcccctgctggccgtgcccctggccatccccgcccacgtgaacctgggcgccgccctgctgctggccccccagctgtactggttcttcctgatctgcagaggcgcctgcagactgttctggcccagaagcagacccccccccgcctgccaggcccaggactag

SEQ ID NO: 18254 - DNA, 1287 bp, Artificial Sequence
  Description of Artificial Sequence: Synthetic coding sequence
atggccagaagcctgtgccccggcgcctggctgagaaagccctactacctgcaggccagattcagctacgtgagaatgaagtacctgttcttcagctggctggtggtgttcgtgggcagctggatcatctacgtgcagtacagcacctacaccgagctgtgcagaggcaaggactgcaagaagatcatctgcgacaagtacaagaccggcgtgatcgacggccccgcctgcaacagcctgtgcgtgaccgagaccctgtacttcggcaagtgcctgagcaccaagcccaacaaccagatgtacctgggcatctgggacaacctgcccggcgtggtgaagtgccagatggagcaggccctgcacctggacttcggcaccgagctggagcccagaaaggagatcgtgctgttcgacaagcccaccagaggcaccaccgtgcagaagttcaaggagatggtgtacagcctgttcaaggccaagctgggcgaccagggcaacctgagcgagctggtgaacctgatcctgaccgtggccgacggcgacaaggacggccaggtgagcctgggcgaggccaagagcgcctgggccctgctgcagctgaacgagttcctgctgatggtgatcctgcaggacaaggagcacacccccaagctgatgggcttctgcggcgacctgtacgtgatggagagcgtggagtacaccagcctgtacggcatcagcctgccctgggtgatcgagctgttcatccccagcggcttcagaagaagcatggaccagctgttcacccccagctggcccagaaaggccaagatcgccatcggcctgctggagttcgtggaggacgtgttccacggcccctacggcaacttcctgatgtgcgacaccagcgccaagaacctgggctacaacgacaagtacgacctgaagatggtggacatgagaaagatcgtgcccgagaccaacctgaaggagctgatcaaggacagacactgcgagagcgacctggactgcgtgtacggcaccgactgcagaaccagctgcgaccagagcaccatgaagtgcaccagcgaggtgatccagcccaacctggccaaggcctgccagctgctgaaggactacctgctgagaggcgcccccagcgagatcagagaggagctggagaagcagctgtacagctgcatcgccctgaaggtgaccgccaaccagatggagatggagcacagcctgatcctgaacaacctgaagaccctgctgtggaagaagatcagctacaccaacgacagctag

SEQ ID NO: 18255 - DNA, 489 bp, Artificial Sequence
  Description of Artificial Sequence: Synthetic coding sequence
atggccagaagcctgtgccccggcgcctggctgagaaagccctactacctgcaggccagattcagctacgtgagaatgaagtacctgttcttcagctggctggtggtgttcgtgggcagctggatcatctacgtgcagtacagcacctacaccgagctgtgcagaggcaaggactgcaagaagatcatctgcgacaagtacaagaccggcgtgatcgacggccccgcctgcaacagcctgtgcgtgaccgagaccctgtacttcggcaagtgcctgagcaccaagcccaacaaccagatgtacctgggcatctgggacaacctgcccggcgtggtgaagtgccagatggagcaggccctgcacctggacttcggcaccgagctggagcccagaaaggagatcgtgctgttcgacaagcccaccagaggcaccaccgtgcagaagttcaaggagatggtgtacagcctgttcaaggacagacacagatag

SEQ ID NO: 18256 - DNA, 1035 bp, Artificial Sequence
  Description of Artificial Sequence: Synthetic coding sequence
atggtggagtggagaacctgcctgagcgtggcccccggccagcaggtgtacagcggcctgtggagagacaaggacgtgaccatcaagtgcggcatcgaggagaccctggacagcaaggccagaagcgacgccgcccccagaagagagctggtgctgttcgacaagcccaccagaggcaccagcatcaaggagttcagagagatgaccctgagcttcctgaaggccaacctgggcgacctgcccagcctgcccgccctggtgggccaggtgctgctgatggccgacttcaacaaggacaacagagtgagcctggccgaggccaagagcgtgtgggccctgctgcagagaaacgagttcctgctgctgctgagcctgcaggagaaggagcacgccagcagactgctgggctactgcggcgacctgtacctgaccgagggcgtgccccacggcgcctggcacgccgccgccctgccccccctgctgagacccctgctgccccccgccctgcagggcgccctgcagcagtggctgggccccgcctggccctggagagccaagatcgccatcggcctgctggagttcgtggaggagctgttccacggcagctacggcaccttctacatgtgcgagaccaccctggccaacgtgggctacaccgccacctacgacttcaagatggccgacctgcagcaggtggcccccgaggccaccgtgagaagattcctgcagggcagaagatgcgagcacagcaccgactgcacctacggcagagactgcagagccccctgcgacagactgatgagacagtgcaagggcgacctgatccagcccaacctggccaaggtgtgcgccctgctgagaggctacctgctgcccggcgcccccgccgacctgagagaggagctgggcacccagctgagaacctgcaccaccctgagcggcctggccagccaggtggaggcccaccacagcctggtgctgagccacctgaagaccctgctgtggaagaagatcagcaacaccaagtacagctag

SEQ ID NO: 18257 - DNA, 1296 bp, Artificial Sequence
  Description of Artificial Sequence: Synthetic coding sequence
atgagaagactgagaagactggcccacctggtgctgttctgccccttcagcaagagactgcagggcagactgcccggcctgagagtgagatgcatcttcctggcctggctgggcgtgttcgccggcagctggctggtgtacgtgcactacagcagctacagcgagagatgcagaggccacgtgtgccaggtggtgatctgcgaccagtacagaaagggcatcatcagcggcagcgtgtgccaggacctgtgcgagctgcacatggtggagtggagaacctgcctgagcgtggcccccggccagcaggtgtacagcggcctgtggagagacaaggacgtgaccatcaagtgcggcatcgaggagaccctggacagcaaggccagaagcgacgccgcccccagaagagagctggtgctgttcgacaagcccaccagaggcaccagcatcaaggagttcagagagatgaccctgagcttcctgaaggccaacctgggcgacctgcccagcctgcccgccctggtgggccaggtgctgctgatggccgacttcaacaaggacaacagagtgagcctggccgaggccaagagcgtgtgggccctgctgcagagaaacgagttcctgctgctgctgagcctgcaggagaaggagcacgccagcagactgctgggctactgcggcgacctgtacctgaccgagggcgtgccccacggcgcctggcacgccgccgccctgccccccctgctgagacccctgctgccccccgccctgcagggcgccctgcagcagtggctgggccccgcctggccctggagagccaagatcgccatcggcctgctggagttcgtggaggagctgttccacggcagctacggcaccttctacatgtgcgagaccaccctggccaacgtgggctacaccgccacctacgacttcaagatggccgacctgcagcaggtggcccccgaggccaccgtgagaagattcctgcagggcagaagatgcgagcacagcaccgactgcacctacggcagagactgcagagccccctgcgacagactgatgagacagtgcaagggcgacctgatccagcccaacctggccaaggtgtgcgccctgctgagaggctacctgctgcccggcgcccccgccgacctgagagaggagctgggcacccagctgagaacctgcaccaccctgagcggcctggccagccaggtggaggcccaccacagcctggtgctgagccacctgaagaccctgctgtggaagaagatcagcaacaccaagtacagctag

SEQ ID NO: 18258 - DNA, 1260 bp, Artificial Sequence
  Description of Artificial Sequence: Synthetic coding sequence
atggccagagccgccggcgccagaggccccgccggctggtgcagaagaagaggcagatgcggcagaggcaccctgctggccttcgccgcctggaccgccggctgggtgctggccgccgccctgctgctgagagcccaccccggcgtgctgagcgagagatgcaccgacgagaagagcagaagaatcctggccgccctgtgccaggactaccagggcggcaccctggccggcgacctgtgcgaggacctgtgcgtggccggcgagctgctgttccagagatgcctgcactacaacagaggcaagaaggtgctgcaggccgactggagaggcagacccgtggtgctgaagagcaaggaggaggccttcagcagcttcccccccctgagcctgctggaggaggaggccggcgagggcggccaggacatgcccgaggccgagctgctgctgatggtggccggcgaggtgaagagcgccctgggcctggagctgagcaacagcagcctgggcccctggtggcccggcagaagaggccccagatggagaggccagctggccagcctgtgggccctgctgcagcaggaggagtacgtgtacttcagcctgctgcaggacctgagcccccacgtgctgcccgtgctgggcagctgcggccacttctacgccgtggagttcctggccgccggcagcccccaccacagagccctgttccccctggacagagcccccggcgcccccggcggcggccaggccaaggccatcagcgacatcgccctgagcttcctggacatggtgaaccacttcgacagcgacttcagccacagactgcacctgtgcgacatcaagcccgagaacttcgccatcagaagcgacttcaccgtggtggccatcgacgtggacatggccttcttcgagcccaagatgagagagatcctggagcagaactgcaccggcgacgaggactgcaacttcttcgactgcttcagcagatgcgacctgagagtgaacaagtgcggcgcccagagagtgaacaacaacctgcaggtgatctgcgacaagatcttcagacactggttcagcgcccccctgaagagcagcgccgtgagcttccagctgcagctgcagctgcaggaggccgtgcaggagtgcgccgaccccggcgtgcccagcggcaacaccagaagagccgccagcagcgtgttctggaagctgagacagctgctgcaggccaccctgagagagctgcaggaggccgagaagtag

SEQ ID NO: 18259 - DNA, 1050 bp, Artificial Sequence
  Description of Artificial Sequence: Synthetic coding sequence
atgcaccagagcctgacccagcagagaagcagcgacatgagcctgcccgacagcatgggcgccttcaacagaagaaagagaaacagcatctacgtgaccgtgaccctgctgatcgtgagcgtgctgatcctgaccgtgggcctggccgccaccaccagaacccagaacgtgaccgtgggcggctactaccccggcgtgatcctgggcttcggcagcttcctgggcatcatcggcagcaacctgatcgagaacaagagacagatgctggtggccagcatcgtgttcatcagcttcggcgtgatcgccgccttctgctgcgccatcgtggacggcgtgttcgccgccagacacatcgacctgaagcccctgtacgccaacagatgccactacgtgcccaagaccagccagaaggaggccgaggaggtgatcagcagcagcaccaagaacagccccagcaccagagtgatgagaaacctgacccaggccgccagagaggtgaactgcccccacctgagcagagagttctgcacccccagaatcagaggcaacacctgcttctgctgcgacctgtacaactgcggcaacagagtggagatcaccggcggctactacgagtacatcgacgtgagcagctgccaggacatcatccacctgtaccacctgctgtggagcgccaccatcctgaacatcgtgggcctgttcctgggcatcatcaccgccgccgtgctgggcggcttcaaggacatgaaccccaccctgcccgccctgaactgcagcgtggagaacacccaccccaccgtgagctactacgcccacccccaggtggccagctacaacacctactaccacagccccccccacctgcccccctacagcgcctacgacttccagcacagcggcgtgttccccagcagcccccccagcggcctgagcgacgagccccagagcgccagccccagccccagctacatgtggagcagcagcgccccccccagatacagccccccctactacccccccttcgagaagccccccccctacagcccctag

SEQ ID NO: 18260 - DNA, 558 bp, Artificial Sequence
  Description of Artificial Sequence: Synthetic coding sequence
atggtgaactgcccccacctgagcagagagttctgcacccccagaatcagaggcaacacctgcttctgctgcgacctgtacaactgcggcaacagagtggagatcaccggcggctactacgagtacatcgacgtgagcagctgccaggacatcatccacctgtaccacctgctgtggagcgccaccatcctgaacatcgtgggcctgttcctgggcatcatcaccgccgccgtgctgggcggcttcaaggacatgaaccccaccctgcccgccctgaactgcagcgtggagaacacccaccccaccgtgagctactacgcccacccccaggtggccagctacaacacctactaccacagccccccccacctgcccccctacagcgcctacgacttccagcacagcggcgtgttccccagcagcccccccagcggcctgagcgacgagccccagagcgccagccccagccccagctacatgtggagcagcagcgccccccccagatacagccccccctactacccccccttcgagaagccccccccctacagcccctag

SEQ ID NO: 18261 - DNA, 978 bp, Artificial Sequence
  Description of Artificial Sequence: Synthetic coding sequence
atgcaccagagcctgacccagcagagaagcagcgacatgagcctgcccgacagcatgggcgccttcaacagaagaaagagaaacagcatctacgtgaccgtgaccctgctgatcgtgagcgtgctgatcctgaccgtgggcctggccgccaccaccagaacccagaacgtgaccgtgggcggctactaccccggcgtgatcctgggcttcggcagcttcctgggcatcatcggcagcaacctgatcgagaacaagagacagatgctggtggccagcatcgtgttcatcagcttcggcgtgatcgccgccttctgctgcgccatcgtggacggcgtgttcgccgccagacacatcgacctgaagcccctgtacgccaacagatgccactacgtgcccaagaccagccagaaggaggccgaggaggtgaactgcccccacctgagcagagagttctgcacccccagaatcagaggcaacacctgcttctgctgcgacctgtacaactgcggcaacagagtggagatcaccggcggctactacgagtacatcgacgtgagcagctgccaggacatcatccacctgtaccacctgctgtggagcgccaccatcctgaacatcgtgggcctgttcctgggcatcatcaccgccgccgtgctgggcggcttcaaggacatgaaccccaccctgcccgccctgaactgcagcgtggagaacacccaccccaccgtgagctactacgcccacccccaggtggccagctacaacacctactaccacagccccccccacctgcccccctacagcgcctacgacttccagcacagcggcgtgttccccagcagcccccccagcggcctgagcgacgagccccagagcgccagccccagccccagctacatgtggagcagcagcgccccccccagatacagccccccctactacccccccttcgagaagccccccccctacagcccctag

SEQ ID NO: 18262 - DNA, 726 bp, Artificial Sequence
  Description of Artificial Sequence: Synthetic coding sequence
atgcaccagagcctgacccagcagagaagcagcgacatgagcctgcccgacagcatgggcgccttcaacagaagaaagagaaacagcatctacgtgaccgtgaccctgctgatcgtgagcgtgctgatcctgaccgtgggcctggccgccaccaccagaacccagaacgtgaccgtgggcggctactaccccggcgtgatcctgggcttcggcagcttcctgggcatcatcggcagcaacctgatcgagaacaagagacagatgctggtggccagcatcgtgttcatcagcttcggcgtgatcgccgccttctgctgcgccatcgtggacggcgtgttcgccgccagacacatcgacctgaagcccctgtacgccaacagatgccactacgtgcccaagaccagccagaaggaggccgaggagaaccccaccctgcccgccctgaactgcagcgtggagaacacccaccccaccgtgagctactacgcccacccccaggtggccagctacaacacctactaccacagccccccccacctgcccccctacagcgcctacgacttccagcacagcggcgtgttccccagcagcccccccagcggcctgagcgacgagccccagagcgccagccccagccccagctacatgtggagcagcagcgccccccccagatacagccccccctactacccccccttcgagaagccccccccctacagcccctag

SEQ ID NO: 18263 - DNA, 981 bp, Artificial Sequence
  Description of Artificial Sequence: Synthetic coding sequence
atgcagccccccgtgcccggccccctgggcctgctggaccccgccgagggcctgagcagaagaaagaagaccagcctgtggttcgtgggcagcctgctgctggtgagcgtgctgatcgtgaccgtgggcctggccgccaccaccagaaccgagaacgtgaccgtgggcggctactaccccggcatcatcctgggcttcggcagcttcctgggcatcatcggcatcaacctggtggagaacagaagacagatgctggtggccgccatcgtgttcatcagcttcggcgtggtggccgccttctgctgcgccatcgtggacggcgtgttcgccgcccagcacatcgagcccagacccctgaccaccggcagatgccagttctacagcagcggcgtgggctacctgtacgacgtgtaccagaccgaggtgacctgccacagcctggacggcaagtgccagctgaaggtgagaagcaacacctgctactgctgcgacctgtacgcctgcggcagcgccgagcccagccccgcctactacgagttcatcggcgtgagcggctgccaggacgtgctgcacctgtacagactgctgtgggccagcgccgtgctgaacgtgctgggcctgttcctgggcatcatcaccgccgccgtgctgggcgccttcaaggacatggtgcccctgagccagctggcctacggccccgccgtgcccccccagaccctgtacaaccccgcccagcagatcctggcctacgccggcttcagactgacccccgagcccgtgcccacctgcagcagctaccccctgcccctgcagccctgcagcagattccccgtggcccccagcagcgccctggccagcagcgaggacctgcagccccccagccccagcagcagcggcagcggcctgcccggccaggcccccccctgctacgcccccacctacttcccccccggcgagaagccccccccctacgccccctag

SEQ ID NO: 18264 - DNA, 1899 bp, Artificial Sequence
  Description of Artificial Sequence: Synthetic coding sequence
atgagcgactgctgcagcgcccccggcatcagctgggaggccggcgtgggcagacccgccgtgcccggcctggagctgcagatcagaagaggcgccatgagcgaggagaccgtgagcgagagccagttcagcctgaagaccgccgccctgagagtgttcgacctgcccctgacctggtactacagcctgagccagatcaagttcagccccgtggccaagaagctgttcgtggtgaccgccgtgagcgccatcagcgtgatcttcctggcccaccacttcaagagaaagagaggcaagaagaagggcaagatcctgccctgggagcccgagcacctgatcctggagtacaccaagagagccgccagcgacaagggcagcagctgcagcagcagcagacagaacctgaccctgagcctgagcagcaccaaggacaagggcagccaggtgtgcaactacgccaacggcggcctgttcagcaagtacagcggcagcgcccagagcctggccagcgtgcagagcgtgaacagctgccacagctgcgcctgcggcaacagcaacagctgggacaaggccgacgaggacgacatcaagctggtgaacatccccgtgaccacccccgagaacctgtacctgatgggcatggagctgttcgaggaggccctgagaagatgggagcaggccctgaccttcagaaacagacaggccgaggacgaggcctgcggcagcatcaagctgggcgccggcgacgccatcgccgaggagaacgtggacgacatcatcagcaccgagttcatccacaagctggaggccctgctgcagagagcctacagactgcaggaggagttcgaggccaccctgggcgccagcgaccccaacagcctggccgacgacatcgacaaggacaccgacatcaccatgaagggcaacgtggaggacttcggcctgagagacaccctgagcatcgccagcaccgacagcttcgccagcgccgccgagctggccgagcacagagaggtgagacacacctacagcctggagagcctgtgccactgccccttctacgaggaggccatgcacctggtggaggagggcaagatctacagcagagtgctgagaaccgagatgctggagtgcctgggcgacagcgacttcctggccaagctgcactgcatcagacaggccttccaggtgatcctgagcgagagcgccaacagaatcttcctggccgagagcggcagaaagatcctgagcgccctgatcgtgaaggccagaaagaaccccaagaagttcgaggacgtgttcgacgagatgatctacttcctggagcagaccgaccactggggcagcaccgagatggagctggccgccagaggcgtgaagaacctgaacttctacgacgtggtgctggacttcatcctgatggacagcttcgaggacctggagaacccccccaccagcatccagaacgtggtgaacaacagatggctgaacagcagcttcaaggagaccgccgtggccagcagctgctggagcgtgctgaagcagaagagacagcagatgaagatccccgacggcttcttcgcccacttctacgccatctgcgagcacatcagccccgtgctggcctggggcttcctgggccccagaaacagcctgtacgacctgtgctgcttcttcaagaaccaggtgctgctgttcctgaaggacatcttcgacttcgagaaggtgagatacagcagcaccgagaccctggccgaggacctgatgcagctgctgatcagaagaaccgagctgctgatggcctacctggaggccgacgccctgagacacaccagcagctgcctgagcagccacggccacgtgatgagcaccggcctgctggaggccaaggtgcagtag

SEQ ID NO: 18265 - DNA, 1788 bp, Artificial Sequence
  Description of Artificial Sequence: Synthetic coding sequence
atgagcgactgctgcagcgcccccggcatcagctgggaggccggcgtgggcagacccgccgtgcccggcctggagctgcagatcaagttcagccccgtggccaagaagctgttcgtggtgaccgccgtgagcgccatcagcgtgatcttcctggcccaccacttcaagagaaagagaggcaagaagaagggcaagatcctgccctgggagcccgagcacctgatcctggagtacaccaagagagccgccagcgacaagggcagcagctgcagcagcagcagacagaacctgaccctgagcctgagcagcaccaaggacaagggcagccaggtgtgcaactacgccaacggcggcctgttcagcaagtacagcggcagcgcccagagcctggccagcgtgcagagcgtgaacagctgccacagctgcgcctgcggcaacagcaacagctgggacaaggccgacgaggacgacatcaagctggtgaacatccccgtgaccacccccgagaacctgtacctgatgggcatggagctgttcgaggaggccctgagaagatgggagcaggccctgaccttcagaaacagacaggccgaggacgaggcctgcggcagcatcaagctgggcgccggcgacgccatcgccgaggagaacgtggacgacatcatcagcaccgagttcatccacaagctggaggccctgctgcagagagcctacagactgcaggaggagttcgaggccaccctgggcgccagcgaccccaacagcctggccgacgacatcgacaaggacaccgacatcaccatgaagggcaacgtggaggacttcggcctgagagacaccctgagcatcgccagcaccgacagcttcgccagcgccgccgagctggccgagcacagagaggtgagacacacctacagcctggagagcctgtgccactgccccttctacgaggaggccatgcacctggtggaggagggcaagatctacagcagagtgctgagaaccgagatgctggagtgcctgggcgacagcgacttcctggccaagctgcactgcatcagacaggccttccaggtgatcctgagcgagagcgccaacagaatcttcctggccgagagcggcagaaagatcctgagcgccctgatcgtgaaggccagaaagaaccccaagaagttcgaggacgtgttcgacgagatgatctacttcctggagcagaccgaccactggggcagcaccgagatggagctggccgccagaggcgtgaagaacctgaacttctacgacgtggtgctggacttcatcctgatggacagcttcgaggacctggagaacccccccaccagcatccagaacgtggtgaacaacagatggctgaacagcagcttcaaggagaccgccgtggccagcagctgctggagcgtgctgaagcagaagagacagcagatgaagcagatccccgacggcttcttcgcccacttctacgccatctgcgagcacatcagccccgtgctggcctggggcttcctgggccccagaaacagcctgtacgacctgtgctgcttcttcaagaaccaggtgctgctgttcctgaaggacatcttcgacttcgagaaggtgagatacagcagcaccgagaccctggccgaggacctgatgcagctgctgatcagaagaaccgagctgctgatggcctacctggaggccgacgccctgagacacaccagcagctgcctgagcagccacggccacgtgatgagcaccggcctgctggaggccaaggtgcagtag

SEQ ID NO: 18266 - DNA, 972 bp, Artificial Sequence
  Description of Artificial Sequence: Synthetic coding sequence
atggccttcagaagagccgagggcaccagcatgatccaggccctggccatgaccgtggccgagatccccgtgttcctgtacaccaccttcggccagagcgccttcagccagctgagactgacccccggcctgagaaaggtgctgttcgccaccgccctgggcaccgtggccctggccctggccgcccaccagctgaagagaagaagaagaagaaagaagcaggtgggccccgagatgggcggcgagcagctgggcaccgtgcccctgcccatcctgctggccagaaaggtgcccagcgtgaagaagggctacagcagcagaagagtgcagagccccagcagcaagagcaacgacaccctgagcggcatcagcagcatcgagcccagcaagcacagcggcagcagccacagcgtggccagcatgatggccgtgaacagcagcagccccaccgccgcctgcagcggcctgtgggacgccagaggcatggaggagagcctgaccaccagcgacggcaacgccgagagcctgtacatgcagggcatggagctgttcgaggaggccctgcagaagtgggagcaggccctgagcgtgggccagagaggcgacagcggcagcacccccatgcccagagacggcctgagaaaccccgagaccgccagcgagcccctgagcgagaccgagagccacagcgtggccagactggagtgcagcggcgccatcagcgcccagtgcaacctgagattcctgggcagcagagacagccccgccagcgccagccaggtggccggcatcaccgccagagtgaccgccgagggcgtgtgcagagaggccggcgtgcccgccgccccctgcctgccccccgccggcggcgtgagactgcacctgcccagaagacagcacgccgccagacccagagaggacccccacgccgcccccgacagaggcctggccgccgccgccggcggcagatag

SEQ ID NO: 18267 - DNA, 1782 bp, Artificial Sequence
  Description of Artificial Sequence: Synthetic coding sequence
atggccttcagaagagccgagggcaccagcatgatccaggccctggccatgaccgtggccgagatccccgtgttcctgtacaccaccttcggccagagcgccttcagccagctgagactgacccccggcctgagaaaggtgctgttcgccaccgccctgggcaccgtggccctggccctggccgcccaccagctgaagagaagaagaagaagaaagaagcaggtgggccccgagatgggcggcgagcagctgggcaccgtgcccctgcccatcctgctggccagaaaggtgcccagcgtgaagaagggctacagcagcagaagagtgcagagccccagcagcaagagcaacgacaccctgagcggcatcagcagcatcgagcccagcaagcacagcggcagcagccacagcgtggccagcatgatggccgtgaacagcagcagccccaccgccgcctgcagcggcctgtgggacgccagaggcatggaggagagcctgaccaccagcgacggcaacgccgagagcctgtacatgcagggcatggagctgttcgaggaggccctgcagaagtgggagcaggccctgagcgtgggccagagaggcgacagcggcagcacccccatgcccagagacggcctgagaaaccccgagaccgccagcgagcccctgagcgagcccgagagccagagaaaggagttcgccgagaagctggagagcctgctgcacagagcctaccacctgcaggaggagttcggcagcaccttccccgccgacagcatgctgctggacctggagagaaccctgatgctgcccctgaccgagggcagcctgagactgagagccgacgacgaggacagcctgaccagcgaggacagcttcttcagcgccaccgagctgttcgagagcctgcagaccggcgactaccccatccccctgagcagacccgccgccgcctacgaggaggccctgcagctggtgaaggagggcagagtgccctgcagaaccctgagaaccgagctgctgggctgctacagcgaccaggacttcctggccaagctgcactgcgtgagacaggccttcgagggcctgctggaggacaagagcaaccagctgttcttcggcaaggtgggcagacagatggtgaccggcctgatgaccaaggccgagaagagccccaagggcttcctggagagctacgaggagatgctgagctacgccctgagacccgagacctgggccaccaccagactggagctggagggcagaggcgtggtgtgcatgagcttcttcgacatcgtgctggacttcatcctgatggacgccttcgaggacctggagaacccccccgccagcgtgctggccgtgctgagaaacagatggctgagcgacagcttcaaggagaccgccctggccaccgcctgctggagcgtgctgaaggccaagagaagactgctgatggtgcccgacggcttcatcagccacttctacagcgtgagcgagcacgtgagccccgtgctggccttcggcttcctgggccccaagccccagctggccgaggtgtgcgccttcttcaagcaccagatcgtgcagtacctgagagacatgttcgacctggacaacgtgagatacaccagcctgcccgccctggccgacgacatcctgcagctgagcagaagaagaagcgagatcctgctgggctacctgggcgtgcccgccgccagcagcgccggcgtgaacggcgccctgcccagagagaacggccccctgggcgagctgcagtag

SEQ ID NO: 18268 - DNA, 1050 bp, Artificial Sequence
  Description of Artificial Sequence: Synthetic coding sequence
atggccttcagaagagccgagggcaccagcatgatccaggccctggccatgaccgtggccgagatccccgtgttcctgtacaccaccttcggccagagcgccttcagccagctgagactgacccccggcctgagaaaggtgctgttcgccaccgccctgggcaccgtggccctggccctggccgcccaccagctgaagagaagaagaagaagaaagaagcaggtgggccccgagatgggcggcgagcagctgggcaccgtgcccctgcccatcctgctggccagaaaggtgcccagcgtgaagaagggctacagcagcagaagagtgcagagccccagcagcaagagcaacgacaccctgagcggcatcagcagcatcgagcccagcaagcacagcggcagcagccacagcgtggccagcatgatggccgtgaacagcagcagccccaccgccgcctgcagcggcctgtgggacgccagaggcatggaggagagcctgaccaccagcgacggcaacgccgagagcctgtacatgcagggcatggagctgttcgaggaggccctgcagaagtgggagcaggccctgagcgtgggccagagaggcgacagcggcagcacccccatgcccagagacggcctgagaaaccccgagaccgccagcgagcccctgagcgagcccgagagccagagaaaggagttcgccgagaagctggagagcctgctgcacagagcctaccacctgcaggaggagttcggcagcaccttccccgccgacagcatgctgctggacctggagagaaccctgatgctgcccctgaccgagggcagcctgagactgagagccgacgacgaggacagcctgaccagcgaggacagcttcttcagcgccaccgagctgttcgagagcctgcagaccggcgactaccccatccccctgagcagacccgccgccgcctacgaggaggccctgcagctggtgaaggagggcagagtgccctgcagaaccctgagagcccccaaggccagctggagagccaccagaagatgctag

SEQ ID NO: 18269 - DNA, 303 bp, Artificial Sequence
  Description of Artificial Sequence: Synthetic coding sequence
atggccttcagaagagccgagggcaccagcatgatccaggccctggccatgaccgtggccgagatccccgtgttcctgtacaccaccttcggccagagcgccttcagccagctgagactgacccccggcctgagaaaggtgctgttcgccaccgccctgggcaccgtggccctggccctggccgcccaccagctgaagagaagaagaagaagaaagaagcaggtgggccccgagatgggcggcgagcagctgggcaccgtgcccctgcccatcctgctggccagaaaggtgcccagcgtgtag

SEQ ID NO: 18270 - DNA, 384 bp, Artificial Sequence
  Description of Artificial Sequence: Synthetic coding sequence
atgtggagagagctgagaggctgccccggcggcgacgtggagaccgcccagagactgagccagagaagaagaggcaagagcagcgaggccgtgcccgagaagacctggagagcccagagaatgagccagagaagaagaggcgagagcagcgaggccgtgcccgagaagacctggaaggagctgagaaacagcgagaccgtgcccgagaagacctggaagcagctgagaagatgcctgcaggaggacgtggagagagtgcagagactgagcctgctgctgcacctggccgtgttcctgtggatcatcatcgccatcaacttcagcaacagcggcgtgaagagccagagcagcacctacctgcccagcggcaagatcctgaagtag

SEQ ID NO: 18271 - DNA, 384 bp, Artificial Sequence; identical to SEQ ID NO: 18270
  Description of Artificial Sequence: Synthetic coding sequence

SEQ ID NO: 18272 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttcagatgcgacgacccccccagccccagccccggcaagagaaagtgccccgtgggcagaagaagaagacccagaggcagaatgaagaaccacagcctgagagccggcagagagtgccccagaggcctgcaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcccccccccccccaagggcttcaccgccccccccctgagagacagcaccctgatcacccccagccactgcgacagcgtggccctgcccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctaccagatggaggccggcagcctgttcctgctgagcagcgacggccagaacgccgtgggcatccaggtgaccgagaccgccaaggtgaacatctgggaggagaaggagaacgtgggcagcttcaccgacagaatgacccccgagaagcacctgaacagcctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagccccccagccacctgggccccgagtgccagcccttcatcagcagcaccccccagttcagacccacccccatggcccaggccgaggcccaggcccacctgcagagcagcttccccgtgctgagccccgccttccccagcctgatcaagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagagcgagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacggccccctgaagcccccccccgccggccaggagggcagatggcccagcaagcccctgacctacagcctgaccggcagcacccagcagagcagaagcctgggcgcccagagcagcaaggccggcgagaccagagaggccgtgccccagtgcagagtgcccctggagacctgcatgctggccaacctgcaggccaccagcgaggacatgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccgccggcaacatgagagccagccaggagctgcacgacctgatggccgccagaagaagcaagctggtgcacgaggagcccagaaaccccaactgccagggcagctgcaagaaccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccacttcggcggcaacatcaagcagttcttccagtggatcttcagcaagaagaagagcaagcccgcccccgtgaccgccgagagccagaagaccgtgaagaacagaagctgcgtgtacagcagcagcgccgaggcccagggcctgatgaccgccgtgggccagatgctggacgagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccctgcagcactggcccaagaccagcggcgccagcagccaccaccaccactgccccagacactgcctgctgtgggagggcatctag

SEQ ID NO: 18273 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttcagatgcgacgacccccccagccccagccccggcaagagaaagtgccccgtgggcagaagaagaagacccagaggcagaatgaagaaccacagcctgagagccggcagagagtgcagaagaggcctgcaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcccccccccccccaagggcttcaccgccccccccctgagagacagcaccctgatcacccccagccactgcgacagcgtggccctgcccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctaccagatggaggccggcagcctgttcctgctgagcagcgacggccagaacgccgtgggcatccaggtgaccgagaccgccaaggtgaacatctgggaggagaaggagaacgtgggcagcttcaccgacagaatgacccccgagaagcacctgaacagcctgagaaacctggccaagagcctggacgccgagcaggacaccaccaaccccaagcccttctggaacatgggcgagaacagcaagcagctgcccggcccccagaagttcagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagccccccagccacctgggccccgagtgccagcccttcatcagcagcaccccccagttcagacccacccccatggcccaggccgaggcccaggcccacctgcagagcagcttccccgtgctgagccccgccttccccagcctgatcaagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagagcgagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacggccccctgaagcccccccccgccggccaggagggcagatggcccagcaagcccctgacctacagcctgaccggcagcacccagcagagcagaagcctgggcgcccagagcagcaaggccggcgagaccagagaggccgtgccccagtgcagagtgcccctggagacctgcatgctggccaacctgcaggccaccagcgaggacatgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccacttcggcggcaacatcaagcagttcttccagtggatcttcagcaagaagaagagcaagcccgcccccgtgaccgccgagagccagaagaccgtgaagaacagaagctgcgtgtacagcagcagcgccgaggcccagggcctgatgaccgccgtgggccagatgctggacgagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccctgcagcactggcccaagaccagcggcgccagcagccaccaccaccactgccccagacactgcctgctgtgggagggcatctag

SEQ ID NO: 18274 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttcagatgcgacgacccccccagccccagccccggcaagagaaagtgccccgtgggcagaagaagaagacccagaggcagaatgaagaaccacagcctgagagccggcagagagtgcagaagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagcctgctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcctgcccccccccaagggcttcaccgccccccccctgagagacagcaccctgatcacccccagccactgcgacagcgtggccctgcccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaacagaatgacccccgagaagcacctgaacagcctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacctgggccccgagtgccagcccttcatcagcagcaccccccagttcagacccacccccatggcccaggccgaggcccaggcccacctgcagagcagcttccccgtgctgagccccgccttccccagcctgatccagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgcaggacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagctggagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacgagcccctgaagcccccccccgccggccaggagggcagatggcccagcaagcccctgacctacagcctgaccggcagcacccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgagcgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaagcccaactgccagggcagctgcaagagccagagacccatgttcccccccatccacaagagcgagaagttcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccccttcggcgagaacatcaagcagatcttccagtggatcttcagcaagaagaagagcaagcccgcccccgtgaccgccgagagccagaagaccgtgaagaacagaagctgcgtgtacagcagcagcgccgaggcccagggcctgatgaccgccgtgggccagatgctggacgagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18275 - DNA, 4074 bp, Artificial Sequence
  Description of Artificial Sequence: Synthetic coding sequence
tgactgctggagagcaacgcccccatccacatggagaacctgcccttccccctgaagctgctgagcgccagcagcctgaacgcccccagcagcaccccctgggtgctggacatcttcctgaccctggtgttcgccctgggcttcttcttcgtgctgctgccctacctgagctacttcagatgcgacgacccccccagccccagccccggcaagagaaagtgccccgtgggcagaagaagaagacccagaggcagaatgaagaaccacagcctgagagccggcagagagtgcagaagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcctgcccccccccaagggcttcaccgccccccccctgagagacagcaccctgatcacccccagccactgcgacagcgtggccttccccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaacagaatgacccccgagaagcacctgaacagcctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacctgggccccgagtgccagcccttcatcagcagcaccccccagttcagacccacccccatggcccaggccgaggcccaggcccacctgcagagcagcttccccgtgctgagccccgccttccccagcctgatccagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagctggagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacgagcccctgaagcccccccccgccggccaggagggcagatggcccagcaagcccctgacctacagcctgaccggcagcatccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccccttcggcgagaacatcaagcagatcttccagtggatcttcagcaagaagaagagcaagcccgcccccgtgaccgccgagagccagaagaccgtgaagaacagaagcagagtgtacagcagcagcgccgaggcccagggcctgatgaccgccgtgggccagatgctggacaagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18276 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcgtgctgctgccctacctgagctacttcagatgcgacgacccccccagccccagccccggcaagagaaagtgccccgtgggcagaagaagaagacccagaggcagaatgaagaaccacagcctgagagccggcagagagtgcagaagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcctgcccccccccaagggcttcaccgccccccccctgagagacagcaccctgatcacccccagccactgcgacagcgtggccttccccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaacagaatgacccccgagaagcacctgaacagcctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacctgggccccgagtgccagcccttcatcagcagcaccccccagttcagacccacccccatggcccaggccgaggcccaggcccacctgcagagcagcttccccgtgctgagccccgccttccccagcctgatccagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagctggagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacgagcccctgaagcccccccccgccggccaggagggcagatggcccagcaagcccctgacctacagcctgaccggcagcatccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccccttcggcgagaacatcaagcagatcttccagtggatcttcagcaagaagaagagcaagcccgcccccgtgaccgccgagagccagaagaccgtgaagaacagaagcagagtgtacagcagcagcgccgaggcccagggcctgatgaccgccgtgggccagatgctggacaagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18277 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttcagatgcgacgacccccccagccccagccccggcaagagaaagtgccccgtgggcagaagaagaagacccagaggcagaatgaagaaccacagcctgagagccggcagagagtgcagaagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcctgcccccccccaagggcttcaccgccccccccctgagagacagcaccctgatcacccccagccactgcgacagcgtggccttccccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaacagaatgacccccgagaagcacctgaacagcctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacctgggccccgagtgccagcccttcatcagcagcaccccccagttcagacccacccccatggcccaggccgaggcccaggcccacctgcagagcagcttccccgtgctgagccccgccttccccagcctgatccagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagggcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagctggagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgtgcgtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacgagcccctgaagcccccccccgccggccaggagggcagatggcccagcaagcccctgacctacagcctgaccggcagcatccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccccttcggcgagaacatcaagcagatcttccagtggatcttcagcaagaagaagagcaagcccgcccccgtgaccgccgagagccagaagaccgtgaagaacagaagcagagtgtacagcagcagcgccgaggcccagggcctgatgaccgccgtgggccagatgctggacgagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18278 - DNA, 4032 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttccactgcgacgacccccccagccccagccccggcaagagaaagtgccccgtgggcagaagaagaagacccagaggcagaatgaagaaccacagcctgagagccggcagagagtgccccagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcccccccccccccaagggcttcaccgccccccccctgagagacagcaccctgatcacccccagccactgcgacagcgtggccctgcccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccccctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaaccagatgacccccgagaagcacctgaacagcctgggcaacctggccaagagcctggacgccgagcaggacaccaccaaccccaagcccttctggaacatgggcgagaacagcaagcagctgcccggcccccagaagtgcagcgaccccagactgctgcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacagacagcccttcatcagcagcaccccccagttcctgcccacccccatggcccaggccgaggcccaggcccacctgcagagcagcttccccgtgctgagccccgccttccccagcctgatcaagaacaccggcgtggcctgccccgccagccagaacaaggtgcaggccctgagcctgcccgagacccagcaccccgagtggcccctgctgagaaagcagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcaccagcaccggcgagagcagcaaggaggcccagaaggtgaagttccagctggagagagacctgtgcccccacctgggccagatcctgggcgagaccccccagaacctgagcagagacatgaagagcttccccagaaaggtgctgggcgtgaccagcgaggagagcgagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgagagtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacggccccctgaagcccccccccgccggccaggagggcagatggcccagcaagcccctgacctacagcctgaccggcagcacccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgagcgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcaggaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccacttcggcgagaacatcaagcagttcttccagtggatcttcagcaagaagaagagcaagcccgcccccgtgaccgccgagagccagaagaccgtgaagaacagaagctgcgtgtacagcagcagcgccgaggcccagggcctgatgaccgccgtgggccagatgctggacaagaagatgagcctgtgccacgcccaccacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18279 - DNA, 4044 bp, Artificial Sequence
  Description of Artificial Sequence: Synthetic coding sequence
atggagaacctgcccttccccctgaagctgctgagcgccagcagcctgaacgcccccagcagcaccccctgggtgctggacatcttcctgaccctggtgttcgccctgggcttcttcttcctgctgctgccctacctgagctacttcagatgcgacgacccccccagccccagccccggcaagagaaagtgccccgtgggcagaagaagaagacccagaggcagaatgaagaaccacagcctgagagccggcagagagtgccccagaggcctggaggagaccagcgacctgctgagccagctgcagagcctgctgggcccccacctggacaagggcgacttcggccagctgagcggccccgacccccccggcgaggtgggcgagagagcccccgacggcgccagccagagcagccacgagcccatggaggacgccgcccccatcctgagccccctggccagccccgacccccaggccaagcacccccaggacctggccagcacccccagccccggccccatgaccaccagcgtgagcagcctgagcgccagccagccccccgagcccagcctgcccctggagcaccccagccccgagccccccgccctgttcccccaccccccccacacccccgaccccctggcctgcagcctgcccccccccaagggcttcaccgccccccccctgagagacagcaccctgatcacccccagccactgcgacagcgtggccttccccctgggcaccgtgccccagagcctgagcccccacgaggacctggtggccagcgtgcccgccatcagcggcctgggcggcagcaacagccacgtgagcgccagcagcagatggcaggagaccgccagaaccagctgcgccttcaacagcagcgtgcagcaggaccacctgagcagacacccccccgagacctgccagatggaggccggcagcctgttcctgctgagcagcgacggccagaacgtggtgggcatccaggtgaccgagaccgccaaggtgaacatctgggaggagaaggagaacgtgggcagcttcaccaacagaatgacccccgagaagcacctgaactacctgagaaacctggccaagagcctggacgccgagcaggacaccaccaaccccaagcccttctggaacatgggcgagaacagcaagcagctgcccggcccccagaagctgagcgaccccagactgtggcaggagagcttctggaagaactacagccagctgttctggggcctgcccagcctgcacagcgagagcctggtggccaacgcctgggtgaccgacagaagctacaccctgcagagcccccccttcctgttcaacgagatgagcaacgtgtgccccatccagagagagaccaccatgagccccctgctgttccaggcccagcccctgagccacctgggccccgagtgccagcccttcatcagcagcaccccccagttcagacccacccccatggcccaggccgaggcccaggcccacctgcagagcagcttccccgtgctgagccccgccttccccagcctgatccagaacaccggcgtggcctgccccgccagccagaacaaggtgcaggccctgagcctgcccgagacccagcaccccgagtggcccctgctgagaagacagctggagggcagactggccctgcccagcagagtgcagaagagccaggacgtgttcagcgtgagcacccccaacctgccccaggagagcctgaccagcatcctgcccgagaacttccccgtgagccccgagctgagaagacagctggagcagcacatcaagaagtggatcatccagcactggggcaacctgggcagaatccaggagagcctggacctgatgcagctgagagacgagagccccggcaccagccaggccaagggcaagcccagcccctggcagagcagcatgagcaccggcgagagcagcaaggaggcccagaaggtgaagttccagctggagagagacccctgcccccacctgggccagatcctgggcgagaccccccagaacctgagcagagacatgaagagcttccccagaaaggtgctgggcgtgaccagcgaggagctggagagaaacctgagaaagcccctgagaagcgacagcggcagcgacctgctgagatgcaccgagagaacccacatcgagaacatcctgaaggcccacatgggcagaaacctgggccagaccaacgagggcctgatccccgtgtgcgtgagaagaagctggctggccgtgaaccaggccctgcccgtgagcaacacccacgtgaagaccagcaacctggccgcccccaagagcggcaaggcctgcgtgaacaccgcccaggtgctgagcttcctggagccctgcacccagcagggcctgggcgcccacatcgtgagattctgggccaagcacagatggggcctgcccctgagagtgctgaagcccatccagtgcttcaagctggagaaggtgagcagcctgagcctgacccagctggccggccccagcagcgccacctgcgagagcggcgccggcagcgaggtggaggtggacatgttcctgagaaagccccccatggccagcctgagaaagcaggtgctgaccaaggccagcgaccacatgcccgagagcctgctggccagcagccccgcctggaagcagttccagagagcccccagaggcatccccagctggaacgaccacgagcccctgaagcccccccccgccggccaggagggcagatggcccagcaagcccctgacctacagcctgaccggcagcatccagcagagcagaagcctgggcgcccagagcagcaaggccggcgagaccagagaggccgtgccccagtgcagagtgcccctggagacctgcatgctggccaacctgcaggccaccagcgaggacgtgcacggcttcgaggcccccggcaccagcaagagcagcctgcaccccagagtgagcgtgagccaggaccccagaaagctgtgcctgatggaggaggtggtgaacgagttcgagcccggcatggccaccaagagcgagacccagccccaggtgtgcgccgccgtggtgctgctgcccgacggccaggccagcgtggtgccccacgccagcgagaacctggtgagccaggtgccccagggccacctgcagagcatgcccaccggcaacatgagagccagccaggagctgcacgacctgatggccgccagaagaagcaagctggtgcacgaggagcccagaaaccccaactgccagggcagctgcaagagccagagacccatgttcccccccatccacaagagcgagaagagcagaaagcccaacctggagaagcacgaggagagactggagggcctgagaaccccccagctgacccccgtgagaaagaccgaggacacccaccaggacgagggcgtgcagctgctgcccagcaagaagcagccccccagcgtgagccccttcggcgagaacatcaagcagatcttccagtggatcttcagcaagaagaagagcaagcccgcccccgtgaccgccgagagccagaagaccgtgaagaacagaagcagagtgtacagcagcagcgccgaggcccagggcctgatgaccgccgtgggccagatgctggacgagaagatgagcctgtgccacgccagacacgccagcaaggtgaaccagcacaagcagaagttccaggcccccgtgtgcggcttcccctgcaaccacagacacctgttctacagcgagcacggcagaatcctgagctacgccgccagcagccagcaggccaccctgaagagccagggctgccccaacagagacagacagatcagaaaccagcagcccctgaagagcgtgagatgcaacaacgagcagtggggcctgagacacccccagatcctgcaccccaagaaggccgtgagccccgtgagccccccccagcactggcccaagaccagcggcgccagcagccaccaccaccactgccccagacactgcctgctgtgggagggcatctag

SEQ ID NO: 18280 - DNA, 4731 bp, Artificial Sequence
  Description of Artificial Sequence: Synthetic coding sequence
atggagaacatcctgtgcttcctgaacagctacaccgagaccggcctgagccccgacagccactggctggacatcgaccccaacttcatctgcctgagcggcctgggcctgttcatcctgtacctgttctacgtggtgctgaccctgtacagcagccccaccgagaagaacaacgacatccagaagcaccagggcagagccaagagaagaagaaagggcggcaccttcaagggcttccccgactggaagagcttccagagagaggaggaggaggagagaaagctgctgagcctgctgaagagcttcggcccccccgtgagctgcagccccagaggccagcaccacgacaccaaccacttcagaagactgctgtgccccgaccccgtgtgcagagtgtgcaagagagccaccgccgacatccagcagctgctgagctgggagagcctgaaggacgccgcccccagcgtgagccccctggccagcagcgccagcgccaccgagagcagcttcaccctggccagcacccccagcgccaccccccccgaggacctgatcctgagccccagacccaaggccagcccccccccccccctgatcctgagccccgacctgatcaccaccctggccgacctgttcagccccagccccctgagagaccccctgcccccccagcccgtgagccccctggacagcaagttccccatcgaccacagccccccccagcagctgcccttccccctgctgcccccccaccacatcgagagagtggagagcagcctgcagcccgaggccagcctgagcctgaacaccatcttcagcttcggcagcaccctgtgccaggacatcagccaggccatgaaccccatcgacagctgcgccagacaccacggcccccccatccccagcgccctgccccccgaggactgcaccgtgacccagagcaagagcagcctgaccatcctgaagaccttccccgagatgctgagcctgggcggcagcggcggcagcagcaccagcgcccccaccatcaagggcatcgaccacagccacctggccagcagcgagttcacctggtggcagccccacgccaaggacagcttcagcagcaacttcgtgcccagcgacttcatggaggagctgctgaccctgcacagcagcgaggccttcctgggcggccacagcgtggccaacctgatcgagcccgtgaacatcagcttcctgagccacgacatcctggccctgctggagagacaggtgaagaagagaggcgacttcctgatgtggaaggagaacggcaagaagcccggcagcttccccaagcagctgagacccaactaccagctgaacagcagcagaaacatgctgaccagcatcgccgtgaagcacgacctggccgagagcttccccttctgggccagcaagggcaagctggagtggcagcacatccaccagcagcccccccacagcaagtgcttcgaggaccacctggagcagaagtacgtgcagctgttctggggcctgcccagcctgcacagcgagagcctgcaccccaccgtgctggtgcagagaggccacagcagcatgttcgtgttcttcaacggcatcaccaacaccagcatcagccacgagagccccgtgctgccccccccccagcccctgagcctgcccagcacccagcccctgcccctgccccagaccctgccccagggccagagcccccacctgacccaggtgaagagcctggcccagccccagagccccttcagagccctgctgcccagccccctgttcctgatcagaatctgcggcgtgtgcttccacagaccccagaacgaggccagaagcctgctgcccagcgagatcaaccacctggagtggaacgtgctgcagaaggtgcaggagagcctgtggggcctgcccagcgtggtgcagaagagccaggaggacttctgcccccccgcccccaaccccgagctggtgagaaagagcttcaaggtgcacgtgcccatcagcatcatccccggcgacttccccctgagcagcgaggtgagaaagaagctggagcagcacatcagaagaagactgatccagagaagatggggcctgcccagaagaatccacgagagcctgagcctgctgagaccccagagcaagatcagcgagctgagcgtgagcgagagaatccacggccccctgaacatcagcctggtggagggccagagatgcaacgtgctgaagaagagcgccagcagcttccccagaagcttccacgagagaagcagcaacatgctgagcatggagaacgtgggcaactaccagggctacagccaggagaccgtgcccaaggaccacctgctgcacggccccgagaccagcagcgacaaggacctgagaagcaacagcgagagagacctggagacccacatgatgcacctgagcggcaacgacagcggcgtgagactgggccagaagcagctggagaacgccctgaccgtgagactgagcaagaagttcgaggagatcaacgagggcagaatgcccggcaccgtgcacagcagctggcacagcgtgaagcagaccatgagcctgcccgagaagagccacagccagatcaagcacagaaacctggtgaccctggtgagcgaggaccactgcgtggacaccagccaggagatcagcttcctgagcagcaacaagcagaagatgctggaggcccacatcaagaccttcagaatgagaatgctgtggggcctgcccctgaaggtgctggagagcatcgagatcttcaagagcaaggccgacctgagcaccagcttcagccacttcgacctgcccagcagcgccaccttcatcagccagggcgacagcaaggacggcgtgagcaagagcagaagcagaagcaccttccagggcgagaagctgggcaccaccagcagcgtgcccatcctggacagaccccaccccgtgagcagccccgtggtgcaggagggccagggcaccctgagaagacagttcagcgacaccgaccacgacctgatcgagaccgacagcaaggacggcgccagcaccagcctgagaagaggcaccaccgacttccagagcgagaagctggacagcaccagcagcttccccatcctgggccacagctacctggtgaccagccccgtgaaccaggagaagcagggcaccctgagaagagagttcagcgacaccgacaacgacctgaccgagagcgtgagaaccaccgaggacggcagacagaccttcctgccccccccccacagcatcgtggacgaggtgagccagaagcagaccgtgctggccagcagatgcagcgccgagctgcccatcatgcaggccggcgccggctgcgagagctgggacaagagaaagagcagcttccacaacgtggacagactgcagggcagcagaaagaccttccccgtgaccaacgccctgcagagccagaccagaaacaacctgaccaccagcaagagcggcagctgcagcctgaccaacgtgaaggccagcaccagcaacgagaccgagatcttcccccccagaatcagcgtgccccaggaccccaagagcagctacctgaagaaccagatgctgagccagctgaagctggtgcagagaaagcacagccagccccagagccacttcaccgacatgagcttcgccctggacaacctgagcagcaaggacctgctgaccaacagccagggcatcagcagcggcgacatgggcaccagccaggtggtgcacgtgcacctggaggacagcggcatcagagtggcccagaagcaggagcccagagtgcccacctgcgtgctgcagaagtgccaggtgaccaacttcccccccgccgtgaacagagtgagccccgtgagacccaagggcggcgagctggacggcggcgacgccggcctgggcaccagccagagaagaagaaagagcctgcccgtgcacaacaagaccagcggcgaggtgctgggcagcaagagcagccccaccctgaagacccagcccccccccgagaacctgttcagaaagtggatgaagaccagcctgcagtggttcaacaagcccagcatcagctacgaggagcaggagagcagctgggagaagggcagcagcctgagcagctgcgtgcagaacatcggcagagtgatcagagccgccttcaccggcaccaccgaggcccagaagatcagaaaggacaccagagagttcctggaggagaagctgggccacagacacggcatcgacatcacctgcccccaggagcccctgagcttccccgtgggcctgggcaaggcccagcacaaccccgaggtgcacgtgagagccgagcccgtgcagggctgcccctgcaactacagagcccccagctgcaaggtgaccagaaccaagagctgcagccagcaggccatcttcgtgggccagaactaccccaccagaatcagacagatcatcgacaaggacagacagccccagaaggtggaggccttcaagggcaagatcctgtgccagagccacccccagagcatgccccacagaaagcccgtgccccaccccaaccccacctgcagaagacaggtgagcctggtgtgccccgccgtgcccaccagcgccaagagccccgtgttcagcgacgtgcccttcctgaccggccagaagatgctgcccaagcacctgcagggcggcaagttcccccccaccaagtag

SEQ ID NO: 18281 - DNA, 1242 bp, Artificial Sequence
  Description of Artificial Sequence: Synthetic coding sequence
atggccgagggccccgaggaggccagaggccacccccccggccaggacgacggcggcggcgaccacgagcccgtgcccagcctgagaggcccccccaccaccgccgtgccctgccccagagacgacccccaggccgagccccaggcccccggcagacccaccgcccccggcctggccgccgccgccgccgccgacaagctggagccccccagagagctgagaaagagaggcgaggccgccagcggcagcggcgccgagctgcaggagcaggccggctgcgaggcccccgaggccgccgcccccagagagagacccgccagactgagcgccagagagtacagcagacaggtgcacgagtggctgtggcagagctactgcggctacctgacctggcacagcggcctggccgccttccccgcctactgcagcccccagcccagcccccagagcttccccagcggcggcgccgccgtgccccaggccgccgcccccccccccccccagctgggctactacaaccccttctacttcctgagccccggcgccgccggccccgaccccagaaccgccgccggcatcagcacccccgcccccgtggccggcctgggccccagagccccccacgtgcaggccagcgtgagagccacccccgtgaccagagtgggcagcgccgcccccagcagaagccccagcgagaccggcagacaggccggcagagagtacgtgatccccagcctggcccacagattcatggccgagatggtggacttcttcatcctgttcttcatcaaggccaccatcgtgctgagcatcatgcacctgagcggcatcaaggacatcagcaagttcgccatgcactacatcatcgaggagatcgacgaggacaccagcatggaggacctgcagaagatgatggtggtggccctgatctacagactgctggtgtgcttctacgagatcatctgcatctggggcgccggcggcgccacccccggcaagttcctgctgggcctgagagtggtgacctgcgacaccagcgtgctgatcgcccccagcagagtgctggtgatccccagcagcaacgtgagcatcaccaccagcaccatcagagccctgatcaagaacttcagcatcgccagcttcttccccgccttcatcaccctgctgttcttccagcacaacagaaccgcctacgacatcgtggccggcaccatcgtggtgaagagaaacggcgtgagatag

SEQ ID NO: 18282 - DNA, 492 bp, Artificial Sequence
  Description of Artificial Sequence: Synthetic coding sequence
atggccgagatggtggacttcttcatcctgttcttcatcaaggccaccatcgtgctgagcatcatgcacctgagcggcatcaaggacatcagcaagttcgccatgcactacatcatcgaggagatcgacgaggacaccagcatggaggacctgcagaagatgatggtggtggccctgatctacagactgctggtgtgcttctacgagatcatctgcatctggggcgccggcggcgccacccccggcaagttcctgctgggcctgagagtggtgacctgcgacaccagcgtgctgatcgcccccagcagagtgctggtgatccccagcagcaacgtgagcatcaccaccagcaccatcagagccctgatcaagaacttcagcatcgccagcttcttccccgccttcatcaccctgctgttcttccagcacaacagaaccgcctacgacatcgtggccggcaccatcgtggtgaagagaaacggcgtgagatag

SEQ ID NO: 18283 - DNA, 915 bp, Artificial Sequence
  Description of Artificial Sequence: Synthetic coding sequence
atgaacatcgtgttcagcagagacagccaggtgagagtgatggagaacaccgtggccaacaccgagaagtacttcggccagttctgcagcctgctggccgcctacaccagaaagaccgccagactgagagacaaggccgaccagctggtgaagcagctgatcgacttcgccaacagcgagaaccccgagctgagagccaccatgagaggcttcgccgaggacctggccaaggtgcaggactacagacaggcccaggtggagagactggagaccaaggtggtgaaccccctgaagctgtacggcgcccagatcaagcagaccagagccgagatcaagaagttcaagcacgtgcagaaccacgagatcaagcagctggagaagctggagaagctgagacagaagagccccagcgaccagcagatgatcggccaggccgagaccagagtgcagagagccgccgtggacagcagcagaaccaccctgcagctggaggagaccgtggacggcttccagagacagaagctgaaggacctgcagaagttcttctgcgacttcgtgaccatcgagatggtgttccacgccaaggccgtggaggtgtacagcagcgccttccagaccctggagaagtacgacctggagagagacctgctggacttcagagccaagatgcagggcgtgtacggccactacgacaccagactgctggccaacaccagccccccccccagcgtgctgcagagcctggccagccagggcaccctgcaggtgcagctgagcagagccaacgaggaccccgagcacccccacgccaaccacggcagattcagcctgtgcgagtgggtggtgaagggccagcccgcccactgcgtgtgcggccagggcggccacctgatgctgcccggccacagcctgtag

SEQ ID NO: 18284 - DNA, 915 bp, Artificial Sequence
  Description of Artificial Sequence: Synthetic coding sequence
atgaacatcgtgttcagcagagacagccaggtgagagtgatggagaacaccgtggccaacaccgagaagtacttcggccagttctgcagcctgctggccgcctacaccagaaagaccgccagactgagagacaaggccgaccagctggtgaagcagctgatcgacttcgccaacagcgagaaccccgagctgagagccaccatgagaggcttcgccgaggacctggccaaggtgcaggactacagacaggcccaggtggagagactggagaccaaggtggtgaaccccctgaagctgtacggcgcccagatcaagcagaccagagccgagatcaagaagttcaagcacgtgcagaaccacgagatcaagcagctggagaagctggagaagctgagacagaagagccccagcgaccagcagatgatcagccaggccgagaccagagtgcagagagccgccgtggacagcagcagaaccaccctgcagctggaggagaccgtggacggcttccagagacagaagctgaaggacctgcagaagttcttctgcgacttcgtgaccatcgagatggtgttccacgccaaggccgtggaggtgtacagcagcgccttccagaccctggagaagtacgacctggagagagacctgctggacttcagagccaagatgcagggcgtgtacggccactacgacaccagactgctggccaacaccagccccccccccagcgtgctgcagagcctggccagccagggcaccctgcaggtgcagctgagcagagccaacgaggaccccgagcacccccacgccaaccacggcagattcagcctgtgcgagtgggtggtgaagggccagcccgcccactgcgtgtgcggccagggcggccacctgatgctgcccggccacagcctgtag

SEQ ID NO: 18285 - DNA, 3402 bp, Artificial Sequence
  Description of Artificial Sequence: Synthetic coding sequence
atggcccccaagaccaagaagggctgcaaggtgaccctgcccgagaagcccgtgaagctggccagccacaccagagacaccaccggcgtgagccagatgttccccagcagcaaggccagaaccaagagcctgctgggcgacgacgtgttcagcaccatggccggcctggaggaggccgacgccgaggtgagcggcatcagcgaggccgacccccaggccctgctgcaggccatgaaggacctggacggcatggacgccgacatcctgggcctgaagaagagcaacagcgcccccagcaagaaggccgccaaggaccccggcaagggcgagctgcccaaccaccccaagcccgccggcggcgccatccccaccaagaagagcctgcccagccccagcagcagcggccaccagaacagaagattcagcagcgaggacctggaggaccccctgagaggcctgctgagctacgacgagggcggcatcaccaagcagccccccgtgacccagagcaagaccgccagcgacaagagccccagcaccgtgagagaccagggccccagcatccccctgacccccggcgacacccccatcagaaagaaggaggagctgctgttcgacgacggcgacgacatcatggccaccctgggcttcggcgacagccccaaggccgagaagagacagatcggcgaccaggagggccccagacccgccagaagcaccctggacgagctgctgggcagaggcatggccaccaagctgctggccagacccggcaccggcgagcacagagagttcaagctggacaagaagtaccagagaccccaggacagcgaggacatgtggggcgacgaggacttcaccttcggcgcctaccagcccaccgtggtgagcagcgagggcagacagagcagaagacagagcgtgagattcttcgccgacagcggcgccgaccccaagggcgagcccggcagcaagcagagcccccccatggccagcagccccatccagcccagaaagggcggcgccgactggctgggcctgaaggacgaggacctggacctgttccccgccagccccaccagagaggcccacagagagagcagcgtgcccgtgacccccagcgtgcccccccccgccagccagcacagcacccccgccggcctgccccccagcagagccaagccccccaccgagggcgccggcagccccgccaaggccagccaggccagcaagctgagagccagcaaggaggagaaggaggactggctgagccacgccctgagcagaaagaagagccagggcctggccagagagcagcacgccggcaccagcgagggcctgcacctggccggcaccgccggccacccccccagcggcagccagcccctgaccagcacccagggcctggagcacgccgccgccggcggcagcagcggcaccaccgccagagagagaccctgcgtgagacccggcgtgagcggcagccccgtgacccagaaccacgccgccagcgccctgcccaccggcagccccaagagaggcaccgcccccggcgacctgagcgccaccgagcccgccacctgcttccccagcacccagaagcccaccgagcccagcgtgcccgtgcagcccctgctgcccgagagcctggccagaagcctgctgcccagcaccgagtaccagaagcagctgctggccgcccaggtgcagctgcagtgcagccccgccgagctgcaggccgagctgctgcacagccaggccagactggccgagctggaggcccaggtgagaaagctggagctggagagagcccagcacgagctgctgctgggcagcctgcagcagcagcaccaggccgacctggagctgatcgagagcgcccacagaagcagaatcaaggtgctggagaccagctaccagcagagagaggagagactgagaagagagaacgaggagctgagcgccagatacctgagccagtgccaggaggccgagcaggccagagccgagctgaccgcccagcaccagagaagactggccgccatcgcccaggagaaggaccaggagatggagagactgagagagctgcagagagccagcatcctggacatgagaagagaccacgaggagcagctgcagagactgaagctgctgaaggacagagaggtggacgccgccaccagcgccaccagccacaccagaagcctgaacagcatcatccaccagatggagaagttcagcagcagcctgcacgagctgagcagcagagtggaggccagccacctgaccaccagccaggagagagagctgggcatcagacagagagacgagcagctgagagccctgcaggagagactgggccagcagcagagagacatggaggaggagagaagcagacagcaggaggtgatcggcaagatggaggccagactgaacgagcagagcagactgctggagcaggagagatggagagtgaccgccgagcagagcaaggccgagagcatgcagagagccctggaggagcagagaaaggtgaccgcccagcagatggccatggagagagccgagctggagagagccaagagcgccctgctggaggagcagaagagcgtgatgctgaagtgcggcgaggagagaagaagactggccgccgagtgggccgagttcagcgcccagcagaagctgagcaaggagagagccgagagagaggccgagagagccctgcaggtggacacccagagagagggcaccctgatcagcctggccaaggagcaggccgagctgaagatcagagccagcgagctgagagccgaggagaagcagctggccgccgagagagccgccctggagcaggagagacaggagctgagactggagaaggagagaatcaacgccaccgccctgagagtgaagctgagagccgaggaggtggagagcatgagcaaggtggccagcgagaagtacgaggagggcgagagagccctgagagaggcccagcaggtgcaggccgagcagcaggccagactgcaggccgtgcagcagcagcaggagagactgagaaagcaggagcagcacatgcaccaggagcacctgagcctggcccagcagagactgcagctggacagagccagacaggacctgcccagcagcctggtgggcctgttccccagagcccagggccccgccgccagcagccagagcgccctgatgccccccgcccccaccaccagatggtgcagccagccccccaccggcctggaccccagccccctgcacctgcacgccagactggccctgctgagacacatggccgagcaggacagagacttcctggagaacgagcagttcttcctggagaccctgaagaagggcagctacaacctgaccagccacagcgcctag

SEQ ID NO: 18286 - DNA, 2493 bp, Artificial Sequence
  Description of Artificial Sequence: Synthetic coding sequence
atggcccccaagaccaagaagggctgcaaggtgaccctgcccgagaagcccgtgaagctggccagccacaccagagacaccaccggcgtgagccagatgttccccagcagcaaggccagaaccaagagcctgctgggcgacgacgtgttcagcaccatggccggcctggaggaggccgacgccgaggtgagcggcatcagcgaggccgacccccaggccctgctgcaggccatgaaggacctggacggcatggacgccgacatcctgggcctgaagaagagcaacagcgcccccagcaagaaggccgccaaggaccccggcaagggcgagctgcccaaccaccccaagcccgccggcggcgccatccccaccaagaagagcctgcccagccccagcagcagcggccaccagaacagaagattcagcagcgaggacctggaggaccccctgagaggcctgctgagctacgacgagggcggcatcaccaagcagccccccgtgacccagagcaagaccgccagcgacaagagccccagcaccgtgagagaccagggccccagcatccccctgacccccggcgacacccccatcagaaagaaggaggagctgctgttcgacgacggcgacgacatcatggccaccctgggcttcggcgacagccccaaggccgagaagagacagatcggcgaccaggagggccccagacccgccagaagcaccctggacgagctgctgggcagaggcatggccaccaagctgctggccagacccggcaccggcgagcacagagagttcaagctggacaagaagtaccagagaccccaggacagcgaggacatgtggggcgacgaggacttcaccttcggcgcctaccagcccaccgtggtgagcagcgagggcagacagagcagaagacagagcgtgagcagattcttcgccgacagcggcgccgaccccaagggcgagcccggcagcaagcagagcccccccatggccagcagccccatccagcccagaaagggcggcgccgactggctgggcctgaaggacgaggacctggacctgttccccgccagccccaccagagaggcccacagagagagcagcgtgcccgtgacccccagcgtgcccccccccgccagccagcacagcacccccgccggcctgccccccagcagagccaagccccccaccgagggcgccggcagccccgccaaggccagccaggccagcaagctgagagccagcaaggaggagaaggaggactggctgagccacgccctgagcagaaagaagagccagggcctggccagagagcagcacgccggcaccagcgagggcctgcacctggccggcaccgccggccacccccccagcggcagccagcccctgaccagcacccagggcctggagcacgccgccgccggcggcagcagcggcaccaccgccagagagagaccctgcgtgagacccggcgtgagcggcagccccgtgacccagaaccacgccgccagcgccctgcccaccggcagccccaagagaggcaccgcccccggcgacctgagcgccaccgagcccgccacctgcttccccagcacccagaagcccaccgagcccagcgtgcccgtgcagcccctgctgcccgagagcctggccagaagcctgctgcccagcaccgagtaccagaagcagctgctggccgcccaggtgcagctgcagtgcagccccgccgagctgcaggccgagctgctgcacagccaggccagactggccgagctggaggcccaggtgagaaagctggagctggagagagcccagcacgagctgctgctgggcagcctgcagcagcagcaccaggccgacctggagctgatcgagagcgcccacagaagcagaatcaaggtgctggagaccagctaccagcagagagaggagagactgagaagagagaacgaggagctgagcgccagatacctgagccagtgccaggaggccgagcaggccagagccgagctgaccgcccagcaccagagaagactggccgccatcgcccaggagaaggaccaggagatggagagactgagagagctgcagagagccagcatcctggacatgagaagagaccacgaggagcagctgcagagactgaagctgctgaaggacagagaggtggacgccgccaccagcgccaccagccacaccagaagcctgaacagcatcatccaccagatggagaagttcagcagcagcctgcacgagctgagcagcagagtggaggccagccacctgaccaccagccaggagagagagctgggcatcagacagagagacgagcagctgagagccctgcaggagagactgggccagcagcagagagacatgggcagagacgaggagggcagcctgtgcgccgcccacctgcccaaggcccagctgagcggctacgccgtggaggccaccagaaaccagagccagctgcagagattcctgtag

SEQ ID NO: 18287 - DNA, 3405 bp, Artificial Sequence
  Description of Artificial Sequence: Synthetic coding sequence
atggcccccaagaccaagaagggctgcaaggtgaccctgcccgagaagcccgtgaagctggccagccacaccagagacaccaccggcgtgagccagatgttccccagcagcaaggccagaaccaagagcctgctgggcgacgacgtgttcagcaccatggccggcctggaggaggccgacgccgaggtgagcggcatcagcgaggccgacccccaggccctgctgcaggccatgaaggacctggacggcatggacgccgacatcctgggcctgaagaagagcaacagcgcccccagcaagaaggccgccaaggaccccggcaagggcgagctgcccaaccaccccaagcccgccggcggcgccatccccaccaagaagagcctgcccagccccagcagcagcggccaccagaacagaagattcagcagcgaggacctggaggaccccctgagaggcctgctgagctacgacgagggcggcatcaccaagcagccccccgtgacccagagcaagaccgccagcgacaagagccccagcaccgtgagagaccagggccccagcatccccctgacccccggcgacacccccatcagaaagaaggaggagctgctgttcgacgacggcgacgacatcatggccaccctgggcttcggcgacagccccaaggccgagaagagacagatcggcgaccaggagggccccagacccgccagaagcaccctggacgagctgctgggcagaggcatggccaccaagctgctggccagacccggcaccggcgagcacagagagttcaagctggacaagaagtaccagagaccccaggacagcgaggacatgtggggcgacgaggacttcaccttcggcgcctaccagcccaccgtggtgagcagcgagggcagacagagcagaagacagagcgtgagcagattcttcgccgacagcggcgccgaccccaagggcgagcccggcagcaagcagagcccccccatggccagcagccccatccagcccagaaagggcggcgccgactggctgggcctgaaggacgaggacctggacctgttccccgccagccccaccagagaggcccacagagagagcagcgtgcccgtgacccccagcgtgcccccccccgccagccagcacagcacccccgccggcctgccccccagcagagccaagccccccaccgagggcgccggcagccccgccaaggccagccaggccagcaagctgagagccagcaaggaggagaaggaggactggctgagccacgccctgagcagaaagaagagccagggcctggccagagagcagcacgccggcaccagcgagggcctgcacctggccggcaccgccggccacccccccagcggcagccagcccctgaccagcacccagggcctggagcacgccgccgccggcggcagcagcggcaccaccgccagagagagaccctgcgtgagacccggcgtgagcggcagccccgtgacccagaaccacgccgccagcgccctgcccaccggcagccccaagagaggcaccgcccccggcgacctgagcgccaccgagcccgccacctgcttccccagcacccagaagcccaccgagcccagcgtgcccgtgcagcccctgctgcccgagagcctggccagaagcctgctgcccagcaccgagtaccagaagcagctgctggccgcccaggtgcagctgcagtgcagccccgccgagctgcaggccgagctgctgcacagccaggccagactggccgagctggaggcccaggtgagaaagctggagctggagagagcccagcacgagctgctgctgggcagcctgcagcagcagcaccaggccgacctggagctgatcgagagcgcccacagaagcagaatcaaggtgctggagaccagctaccagcagagagaggagagactgagaagagagaacgaggagctgagcgccagatacctgagccagtgccaggaggccgagcaggccagagccgagctgaccgcccagcaccagagaagactggccgccatcgcccaggagaaggaccaggagatggagagactgagagagctgcagagagccagcatcctggacatgagaagagaccacgaggagcagctgcagagactgaagctgctgaaggacagagaggtggacgccgccaccagcgccaccagccacaccagaagcctgaacagcatcatccaccagatggagaagttcagcagcagcctgcacgagctgagcagcagagtggaggccagccacctgaccaccagccaggagagagagctgggcatcagacagagagacgagcagctgagagccctgcaggagagactgggccagcagcagagagacatggaggaggagagaagcagacagcaggaggtgatcggcaagatggaggccagactgaacgagcagagcagactgctggagcaggagagatggagagtgaccgccgagcagagcaaggccgagagcatgcagagagccctggaggagcagagaaaggtgaccgcccagcagatggccatggagagagccgagctggagagagccaagagcgccctgctggaggagcagaagagcgtgatgctgaagtgcggcgaggagagaagaagactggccgccgagtgggccgagttcagcgcccagcagaagctgagcaaggagagagccgagagagaggccgagagagccctgcaggtggacacccagagagagggcaccctgatcagcctggccaaggagcaggccgagctgaagatcagagccagcgagctgagagccgaggagaagcagctggccgccgagagagccgccctggagcaggagagacaggagctgagactggagaaggagagaatcaacgccaccgccctgagagtgaagctgagagccgaggaggtggagagcatgagcaaggtggccagcgagaagtacgaggagggcgagagagccctgagagaggcccagcaggtgcaggccgagcagcaggccagactgcaggccgtgcagcagcagcaggagagactgagaaagcaggagcagcacatgcaccaggagcacctgagcctggcccagcagagactgcagctggacagagccagacaggacctgcccagcagcctggtgggcctgttccccagagcccagggccccgccgccagcagccagagcgccctgatgccccccgcccccaccaccagatggtgcagccagccccccaccggcctggaccccagccccctgcacctgcacgccagactggccctgctgagacacatggccgagcaggacagagacttcctggagaacgagcagttcttcctggagaccctgaagaagggcagctacaacctgaccagccacagcgcctag

SEQ ID NO: 18288 - DNA, 3444 bp, Artificial Sequence
  Description of Artificial Sequence: Synthetic coding sequence
gcccccaagaccaagaagggctgcaagggcagcatcgacgacttcctgggcgacctgctgggcgacgacatgaccctgcccgagaagcccgtgaagctggccagccacaccagagacaccaccggcgtgagccagatgttccccagcagcaaggccagaaccaagagcctgctgggcgacgacgtgttcagcaccatggccggcctggaggaggccgacgccgaggtgagcggcatcagcgaggccgacccccaggccctgctgcaggccatgaaggacctggacggcatggacgccgacatcctgggcctgaagaagagcaacagcgcccccagcaagaaggccgccaaggaccccggcaagggcgagctgcccaaccaccccaagcccgccggcggcgccatccccaccaagaagagcctgcccagccccagcagcagcggccaccagaacagaagattcagcagcgaggacctggaggaccccctgagaggcctgctgagctacgacgagggcggcatcaccaagcagccccccgtgacccagagcaagaccgccagcgacaagagccccagcaccgtgagagaccagggccccagcatccccctgacccccggcgacacccccatcagaaagaaggaggagctgctgttcgacgacggcgacgacatcatggccaccctgggcttcggcgacagccccaaggccgagaagagacagatcggcgaccaggagggccccagacccgccagaagcaccctggacgagctgctgggcagaggcatggccaccaagctgctggccagacccggcaccggcgagcacagagagttcaagctggacaagaagtaccagagaccccaggacagcgaggacatgtggggcgacgaggacttcaccttcggcgcctaccagcccaccgtggtgagcagcgagggcagacagagcagaagacagagcgtgagcagattcttcgccgacagcggcgccgaccccaagggcgagcccggcagcaagcagagcccccccatggccagcagccccatccagcccagaaagggcggcgccgactggctgggcctgaaggacgaggacctggacctgttccccgccagccccaccagagaggcccacagagagagcagcgtgcccgtgacccccagcgtgcccccccccgccagccagcacagcacccccgccggcctgccccccagcagagccaagccccccaccgagggcgccggcagccccgccaaggccagccaggccagcaagctgagagccagcaaggaggagaaggaggactggctgagccacgccctgagcagaaagaagagccagggcctggccagagagcagcacgccggcaccagcgagggcctgcacctggccggcaccgccggccacccccccagcggcagccagcccctgaccagcacccagggcctggagcacgccgccgccggcggcagcagcggcaccaccgccagagagagaccctgcgtgagacccggcgtgagcggcagccccgtgacccagaaccacgccgccagcgccctgcccaccggcagccccaagagaggcaccgcccccggcgacctgagcgccaccgagcccgccacctgcttccccagcacccagaagcccaccgagcccagcgtgcccgtgcagcccctgctgcccgagagcctggccagaagcctgctgcccagcaccgagtaccagaagcagctgctggccgcccaggtgcagctgcagtgcagccccgccgagctgcaggccgagctgctgcacagccaggccagactggccgagctggaggcccaggtgagaaagctggagctggagagagcccagcacgagctgctgctgggcagcctgcagcagcagcaccaggccgacctggagctgatcgagagcgcccacagaagcagaatcaaggtgctggagaccagctaccagcagagagaggagagactgagaagagagaacgaggagctgagcgccagatacctgagccagtgccaggaggccgagcaggccagagccgagctgaccgcccagcaccagagaagactggccgccatcgcccaggagaaggaccaggagatggagagactgagagagctgcagagagccagcatcctggacatgagaagagaccacgaggagcagctgcagagactgaagctgctgaaggacagagaggtggacgccgccaccagcgccaccagccacaccagaagcctgaacagcatcatccaccagatggagaagttcagcagcagcctgcacgagctgagcagcagagtggaggccagccacctgaccaccagccaggagagagagctgggcatcagacagagagacgagcagctgagagccctgcaggagagactgggccagcagcagagagacatggaggaggagagaagcagacagcaggaggtgatcggcaagatggaggccagactgaacgagcagagcagactgctggagcaggagagatggagagtgaccgccgagcagagcaaggccgagagcatgcagagagccctggaggagcagagaaaggtgaccgcccagcagatggccatggagagagccgagctggagagagccaagagcgccctgctggaggagcagaagagcgtgatgctgaagtgcggcgaggagagaagaagactggccgccgagtgggccgagttcagcgcccagcagaagctgagcaaggagagagccgagagagaggccgagagagccctgcaggtggacacccagagagagggcaccctgatcagcctggccaaggagcaggccgagctgaagatcagagccagcgagctgagagccgaggagaagcagctggccgccgagagagccgccctggagcaggagagacaggagctgagactggagaaggagagaatcaacgccaccgccctgagagtgaagctgagagccgaggaggtggagagcatgagcaaggtggccagcgagaagtacgaggagggcgagagagccctgagagaggcccagcaggtgcaggccgagcagcaggccagactgcaggccgtgcagcagcagcaggagagactgagaaagcaggagcagcacatgcaccaggagcacctgagcctggcccagcagagactgcagctggacagagccagacaggacctgcccagcagcctggtgggcctgttccccagagcccagggccccgccgccagcagccagagcgccctgatgccccccgcccccaccaccagatggtgcagccagccccccaccggcctggaccccagccccctgcacctgcacgccagactggccctgctgagacacatggccgagcaggacagagacttcctggagaacgagcagttcttcctggagaccctgaagaagggcagctacaacctgaccagccacagcgcctag

SEQ ID NO: 18289 - DNA, 831 bp, Artificial Sequence
  Description of Artificial Sequence: Synthetic coding sequence
atgaagaagacccccgtgttcctggagagcctggtgaccaacatgctgagactgagagccatctgccccttcagctggagagtgttccagttcagacccatcagctgcgagcccctgatcatccagatgaacaagtgcaccgacgaggagcagatgttcggcttcatcgagagaaacaaggccatcctgagcgagaagcaggtgggctgcgccttcgacatgctgtggaagctgcagaagcagaagaccagcctgctgaagaacgccgagtacgtgagagaccacccccagttcctgaccctgcacaacctggccaccaacaagttcaagctgatgaacgacgacaccctggtgaacgtgctgtacgtgacccagcagttcgccggcgaggcccacgaccccctggtggaggccctggtgaccgaggcctggagaagactggagagattcgacatcaagctgctgagcgagttcagcagctgcctggccgaccagcacctgtacttcagccccctgatgggcaagatcgccgacatcgtgcacagaaacctggagaccacccaggacctgagcagcctgagcgtgctgatggtgaacatcagcagcctgatcagcagacacttccagcagcagctggtgaacaagaccgagctgctgttcgacaccatcgacagcagcgaggtgaacgtggccaagagcatcgccaagttcctgagaaacgtgagatacagataccagcccctgctggagagatgcaacaacgtgttcctgagcaacgtggaccacctggacctggacagcatcagcaagatcctgagcgtgtacaagtag

SEQ ID NO: 18290 - DNA, 2544 bp, Artificial Sequence
  Description of Artificial Sequence: Synthetic coding sequence
atgaagaagacccccgtgttcctggagagcctggtgaccaacatgctgagactgagagccatctgccccttcagctggagagtgttccagttcagacccatcagctgcgagcccctgatcatccagatgaacaagtgcaccgacgaggagcagatgttcggcttcatcgagagaaacaaggccatcctgagcgagaagcaggtgggctgcgccttcgacatgctgtggaagctgcagaagcagaagaccagcctgctgaagaacgccgagtacgtgagagaccacccccagttcctgaccctgcacaacctggccaccaacaagttcaagctgatgaacgacgacaccctggtgaacgtgctgtacgtgacccagcagttcgccggcgaggcccacgaccccctggtggaggccctggtgaccgaggcctggagaagactggagagattcgacatcaagctgctgagcgagttcagcagctgcctggccgaccagcacctgtacttcagccccctgatgggcaagatcgccgacatcgtgcacagaaacctggagaccacccaggacctgagcagcctgagcgtgctgatggtgaacatcagcagcctgatcagcagacacttccagcagcagctggtgaacaagaccgagctgctgttcgacaccatcgacagcagcgaggtgaacgtggccaagagcatcgccaagttcctgagaaacgtgagatacagataccagcccctgctggagagatgcaacaacgtgttcctgagcaacgtggaccacctggacctggacagcatcagcaagatcctgagcgtgtacaagttcctgcagttcaacagcttcgagttcatcatcatggccaagaagaagctgaccgagatgatccccctgtgcaaccaccccgccagcttcgtgaagctgttcgtggccctgggccccatcgccggccccgaggagaagaagcagctgaagagcaccatgctgctgatgagcgaggacctgaccggcgagcaggccctggccgtgctgggcgccatgggcgacatggagagcagaaacagctgcctgatcaagagagtgaccagcgtgctgcacaagcacctggacggctacaagcccctggagctgctgaagatcacccaggagctgaccttcctgcacttccagagaaaggagttcttcgccaagctgagagagctgctgctgagctacctgaagaacagcttcatccccaccgaggtgagcgtgctggtgagagccatcagcctgctgcccagcccccacctggacgaggtgggcatcagcagaatcgaggccgtgctgccccagtgcgacctgaacaacctgagcagcttcgccaccagcgtgctgagatggatccagcacgaccacatgtacctggacaacatgaccgccaagcagctgaagctgctgcagaagctggaccactacggcagacagagactgcagcacagcaacagcctggacctgctgagaaaggagctgaagagcctgaagggcaacaccttccccgagagcctgctggaggagatgatcgccaccctgcagcacttcatggacgacatcaactacatcaacgtgggcgagatcgccagcttcatcagcagcaccgactacctgagcaccctgctgctggacagaatcgccagcgtggccgtgcagcagatcgagaagatccaccccttcaccatccccgccatcatcagacccttcagcgtgctgaactacgaccccccccagagagacgagttcctgggcacctgcgtgcagcacctgaacagctacctgggcatcctggaccccttcatcctggtgttcctgggcttcagcctggccaccctggagtacttccccgaggacctgctgaaggccatcttcaacatcaagttcctggccagactggacagccagctggagatcctgagccccagcagaagcgccagagtgcagttccacctgatggagctgaacagaagcgtgtgcctggagtgccccgagttccagatcccctggttccacgacagattctgccagcagtacaacaagggcatcggcggcatggacggcacccagcagcagatcttcaagatgctggccgaggtgctgggcggcatcaactgcgtgaaggccagcgtgctgaccccctactaccacaaggtggacttcgagtgcatcctggacaagagaaagaagcccctgccctacggcagccacaacatcgccctgggccagctgcccgagatgccctgggagagcaacatcgagatcgtgggcagcagactgccccccggcgccgagagaatcgccctggagttcctggacagcaaggccctgtgcagaaacatcccccacatgaagggcaagagcgccatgaagaagagacacctggagatcctgggctacagagtgatccagatcagccagttcgagtggaacagcatggccctgagcaccaaggacgccagaatggactacctgagagagtgcatcttcggcgaggtgaagagctgcctgtag

SEQ ID NO: 18291 - DNA, 2415 bp, Artificial Sequence
  Description of Artificial Sequence: Synthetic coding sequence
atgaagaagacccccgtgttcctggagagcctggtgaccaacatgctgagactgagagccatctgccccttcagctggagagtgttccagttcagacccatcagctgcgagcccctgatcatccagatgaacaagtgcaccgacgaggagcagatgttcggcttcatcgagagaaacaaggccatcctgagcgagaagcaggtgggctgcgccttcgacatgctgtggaagctgcagaagcagaagaccagcctgctgaagaacgccgagtacgtgagagaccacccccagttcctgaccctgcacaacctggccaccaacaagttcaagctgatgaacgacgacaccctggtgaacgtgctgtacgtgacccagcagttcgccggcgaggcccacgaccccctggtggaggccctggtgaccgaggcctggagaagactggagagattcgacatcaagctgctgagcgagttcagcagctgcctggccgaccagcacctgtacttcagccccctgatgggcaagatcgccgacatcgtgcacagaaacctggagaccacccaggacctgagcagcctgagcgtgctgatggtgaacatcagcagcctgatcagcagacacttccagcagcagctggtgaacaagaccgagctgctgttcgacaccatcgacagcagcgaggtgaacgtggccaagagcatcgccaagttcctgagaaacgtgagatacagataccagcccctgctggagagatgcaacaacgtgttcctgagcaacgtggaccacctggacctggacagcatcagcaagatcctgagcgtgtacaagttcctgcagttcaacagcttcgagttcatcatcatggccaagaagaagctgaccgagatgatccccctgtgcaaccaccccgccagcttcgtgaagctgttcgtggccctgggccccatcgccggccccgaggagaagaagcagctgaagagcaccatgctgctgatgagcgaggacctgaccggcgagcaggccctggccgtgctgggcgccatgggcgacatggagagcagaaacagctgcctgatcaagagagtgaccagcgtgctgcacaagcacctggacggctacaagcccctggagctgctgaagatcacccaggagctgaccttcctgcacttccagagaaaggagttcttcgccaagctgagagagctgctgctgagctacctgaagaacagcttcatccccaccgaggtgagcgtgctggtgagagccatcagcctgctgcccagcccccacctggacgaggtgggcatcagcagaatcgaggccgtgctgccccagtgcgacctgaacaacctgagcagcttcgccaccagcgtgctgagatggatccagcacgaccacatgtacctggacaacatgaccgccaagcagctgaagctgctgcagaagctggaccactacggcagacagagactgcagcacagcaacagcctggacctgctgagaaaggagctgaagagcctgaagggcaacaccttccccgagagcctgctggaggagatgatcgccaccctgcagcacttcatggacgacatcaactacatcaacgtgggcgagatcgccagcttcatcagcagcaccgactacctgagcaccctgctgctggacagaatcgccagcgtggccgtgcagcagatcgagaagatccaccccttcaccatccccgccatcatcagacccttcagcgtgctgaactacgaccccccccagagagacgagttcctgggcacctgcgtgcagcacctgaacagctacctgggcatcctggaccccttcatcctggtgttcctgggcttcagcctggccaccctggagtacttccccgaggacctgctgaaggccatcttcaacatcaagttcctggccagactggacagccagctggagagcatcggcggcatggacggcacccagcagcagatcttcaagatgctggccgaggtgctgggcggcatcaactgcgtgaaggccagcgtgctgaccccctactaccacaaggtggacttcgagtgcatcctggacaagagaaagaagcccctgccctacggcagccacaacatcgccctgggccagctgcccgagatgccctgggagagcaacatcgagatcgtgggcagcagactgccccccggcgccgagagaatcgccctggagttcctggacagcaaggccctgtgcagaaacatcccccacatgaagggcaagagcgccatgaagaagagacacctggagatcctgggctacagagtgatccagatcagccagttcgagtggaacagcatggccctgagcaccaaggacgccagaatggactacctgagagagtgcatcttcggcgaggtgaagagctgcctgtag

SEQ ID NO: 18292 - DNA, 1989 bp, Artificial Sequence
  Description of Artificial Sequence: Synthetic coding sequence
atggccctgatcaccctgagaaagaacctgtacagactgagcgacttccagatgcacagagccctggccgccctgaagaacaagcccctgaaccacgtgcacaaggtggtgaaggagagactgtgcccctggctgtgcagcagacagcccgagcccttcggcgtgaagttccaccacgcccactgcaagaagttccacagcaagaacggcaacgacctgcaccccctgggcggccccgtgttcagccaggtgagcgactgcgacagactggagcagaacgtgaagaacgaggagagccagatgttctacagaagactgagcaacctgaccagcagcgaggaggtgctgagcttcatcagcaccatggagaccctgcccgacaccatggccgccggcgccctgcagagaatctgcgaggtggagaagaaggacggcgaccagggcctgcccaaggagatcctggagaacagcatcttccaggccctgtgcttccagttcgagaaggagcccagccagctgagcaacaccagcctggtgaccgccctgcaggccctgatcctgctgcacgtggacccccagagcagcctgctgctgaacctggtggccgagtgccagaacagactgagaaagggcggcatggaggtgagaaacctgtgcatcctgggcgagagcctgatcaccctgcacagcagcggctgcgtgaccctggagctgatcatcaaccagctgcagggcgagaagctggagaccttcacccccgaggacatcgtggccctgtacagaatcctgcaggcctgcaccgagaaggtggacgagcaccagaccttcctgaacaagatcaacaacttcagcctgagcatcgtgagcaacctgagccccaagctgatcagccagatgctgaccgccctggtggtgctggaccagagccaggccttccccctgatcatcaagctgggcaagtacgtggtgagacacgtgccccacttcaccaacgaggagctgagaagagtgctggaggccttcatctacttcggccaccacgacaccttcttcaccaaggccctggagcacagagtggccgccgtgtgcctgaccctggaccccgaggtggtgtgcagagtgatggagtactgcagcagagagctgatcctgagcaagcccatcctgaacgccgtggccgagaccttcgtgtgccagaccgagaagttcagccccagacagatcagcgccctgatggagcccttcggcaagctgaactacctgccccccaacgccagcgccctgttcagaaagctggagaacgtgctgttcacccacttcaactacttcccccccaagagcctgctgaagctgctgcacagctgcagcctgaacgagtgccaccccgtgaacttcctggccaagatcttcaagcccctgttcctgcagagactgcagggcaaggagagccacctggacaccctgagcagagcccagctgacccagctgttcctggccagcgtgctggagtgccccttctacaagggccccaagctgctgcccaagtaccaggtgaagagcttcctgaccccctgctgcagcctggagacccccgtggacagccagctgtacagatacgtgaagatcggcctgaccaacctgctgggcgccagactgtacttcgcccccaaggtgctgaccccctactgctacaccatcgacgtggagatcaagctggacgaggagggcttcgtgctgcccagcaccgccaacgaggacatccacaagagaatcgccctgtgcatcgacggccccaagagattctgcagcaacagcaagcacctgctgggcaaggaggccatcaagcagagacacctgcagctgctgggctaccaggtggtgcagatcccctaccacgagatcggcatgctgaagagcagaagagagctggtggagtacctgcagagaaagctgttcagccagaacaccgtgcactggctgcaggagtag

SEQ ID NO: 18293 - DNA, 738 bp, Artificial Sequence
  Description of Artificial Sequence: Synthetic coding sequence
atggccctgatcaccctgagaaagaacctgtacagactgagcgacttccagatgcacagagccctggccgccctgaagaacaagcccctgaaccacgtgcacaaggtggtgaaggagagactgtgcccctggctgtgcagcagacagcccgagcccttcggcgtgaagttccaccacgcccactgcaagaagttccacagcaagaacggcaacgacctgcaccccctgggcggccccgtgttcagccaggtgagcgactgcgacagactggagcagaacgtgaagaacgaggagagccagatgttctacagaagactgagcaacctgaccagcagcgaggaggtgctgagcttcatcagcaccatggagaccctgcccgacaccatggccgccggcgccctgcagagaatctgcgaggtggagaagaaggacggcgaccagggcctgcccaaggagatcctggagaacagcatcttccaggccctgtgcttccagttcgagaaggagcccagccagctgagcaacaccagcctggtgaccgccctgcaggccctgatcctgctgcacgtggacccccagagcagcctgctgctgaacctggtggccgagtgccagaacagactgagaaagggcggcatggaggtgagaaacctgtgcatcctgggcgagagcctgatcaccctgcacagcagcggctgcgtgaccctggagctgatcatcaaccagctgcagggctag

SEQ ID NO: 18294 - DNA, 879 bp, Artificial Sequence
  Description of Artificial Sequence: Synthetic coding sequence
atggagagaggccccgtggtgggcgccggcctgggcgccggcgccagaatccaggccctgctgggctgcctgctgaaggtgctgctgtgggtggccagcgccctgctgtacttcggcagcgagcaggccgccagactgctgggcagcccctgcctgagaagactgtaccacgcctggctggccgccgtggtgatcttcggccccctgctgcagttccacgtgaaccccagaaccatcttcgccagccacggcaacttcttcaacatcaagttcgtgaacagcgcctggggctggacctgcaccttcctgggcggcttcgtgctgctggtggtgttcctggccaccagaagagtggccgtgaccgccagacacctgagcagactggtggtgggcgccgccgtgtggagaggcgccggcagagccttcctgctgatcgaggacctgaccggcagctgcttcgagcccctgccccagggcctgctgctgcacgagctgcccgacagaagaagctgcctggccgccggccaccagtggagaggctacaccgtgagcagccacaccttcctgctgaccttctgctgcctgctgatggccgaggaggccgccgtgttcgccaagtacctggcccacggcctgcccgccggcgcccccctgagactggtgttcctgctgaacgtgctgctgctgggcctgtggaacttcctgctgctgtgcaccgtgatctacttccaccagtacacccacaaggtggtgggcgccgccgtgggcaccttcgcctggtacctgacctacggcagctggtaccaccagccctggagccccggcagccccggccacggcctgttccccagaccccacagcagcagaaagcacaactag

SEQ ID NO: 18295 - DNA, 789 bp, Artificial Sequence
  Description of Artificial Sequence: Synthetic coding sequence
atggagcacctggagagatgcgagtggctgctgagaggcaccctggtgagagccgccgtgagaagatacctgccctgggccctggtggccagcatgctggccggcagcctgctgaaggagctgagccccctgcccgagagctacctgagcaacaagagaaacgtgctgaacgtgtacttcgtgaaggtggcctgggcctggaccttctgcctgctgctgcccttcatcgccctgaccaactaccacctgaccggcaaggccggcctggtgctgagaagactgagcaccctgctggtgggcaccgccatctggtacatctgcaccagcatcttcagcaacatcgagcactacaccggcagctgctaccagagccccgccctggagggcgtgagaaaggagcaccagagcaagcagcagtgccaccaggagggcggcttctggcacggcttcgacatcagcggccacagcttcctgctgaccttctgcgccctgatgatcgtggaggagatgagcgtgctgcacgaggtgaagaccgacagaagccactgcctgcacaccgccatcaccaccctggtggtggccctgggcatcctgaccttcatctgggtgctgatgttcctgtgcaccgccgtgtacttccacaacctgagccagaaggtgttcggcaccctgttcggcctgctgagctggtacggcacctacggcttctggtaccccaaggccttcagccccggcctgcccccccagagctgcagcctgaacctgaagcaggacagctacaagaagtag

SEQ ID NO: 18296 - DNA, 1053 bp, Artificial Sequence
  Description of Artificial Sequence: Synthetic coding sequence
atggagcccaccgagcccatggagcccaccgagcccatggagcccgccagaagcgcccacagaggcggcgaggccctgctgagagagctggaggtgctggtgcaggacgtggtgagaaccagcagctggtgggagagacacggcgtggactgcgccatcctggccctgagcctgttcgccctgcccgccggcttcctgtgcctgagatgggagaacgccctggtgttcgccagcggcatcaccatcctgggcgtgtgccactacaccctgaccgtgaagggcagccacctggccacccacggcgccctgaccgagagcaagagatggagcaagatctggctgctgttcttcgtggaggtgtgcaccgccttcaccgccgagcacgccacccacggccacgtgaagatgcaccacgcctacaccaacgtggtgggcctgggcgacagcagcacctggagactgccctgcctgaacagatacgtgtacatgttcctggcccccttcctgctgcccatcgccacccccctggtggccgtggagagactgagaaaggtggagctgggcaccgccctgagaaccctggccctgatcagcctgggcctgtacagccactactggctgctgctgaacgtgagcggcttcaagaaccccagcagcgccctgggctgcatgttcctgaccagaagcctgctggcccacccctacctgcacgtgaacatcttccagcacatcggcctgcccatgttcagcagagacaacaagcccagaagaatccacatgatgagcctgggcgtgctgaacctggccagactgcccgtgctggactgggccttcggccacagcatcatcagctgccacgtggagcaccacctgttccccagactgagcgacaacatgtgcctgaaggtgaagcccgtggtgagccagttcctgagagagaagcagctgccctacaacgaggacagctacctggccagattccagctgttcctgagaagatacgaggagttcatggtgcaggccccccccatcaccgagctggtgggcctgtag

SEQ ID NO: 18297 - DNA, 615 bp, Artificial Sequence
  Description of Artificial Sequence: Synthetic coding sequence
atgcagggcctgagaagatggggctgcagccccggcagccagagaagctgcatcgcccagctgtgcctgaccggcacccccgtgagcttcctggtgcccagcagcagatgcgcccagcccagcctgcagagcacccccagaatgggcaccagcagatgcaccatgcccacccccacctggtgggcctggggcacccccgccagaggcggctgcctggccagcaccgccatgagcacctgcagcctgctgctgagcagcagccccagccccctgcactggtggctgagccacatcggcctgcccatgttcagcagagacaacaagcccagaagaatccacatgatgagcctgggcgtgctgaacctggccagactgcccgtgctggactgggccttcggccacagcatcatcagctgccacgtggagcaccacctgttccccagactgagcgacaacatgtgcctgaaggtgaagcccgtggtgagccagttcctgagagagaagcagctgccctacaacgaggacagctacctggccagattccagctgttcctgagaagatacgaggagttcatggtgcaggccccccccatcaccgagctggtgggcctgtag

SEQ ID NO: 18298 - DNA, 1548 bp, Artificial Sequence
  Description of Artificial Sequence: Synthetic coding sequence
atggtgagcatccccgagtactacgagggcaagaacgtgctgctgaccggcgccaccggcttcctgggcaaggtgctgctggagaagctgctgagaagctgccccaaggtgaacagcgtgtacgtgctggtgagacagaaggccggccagaccccccaggagagagtggaggaggtgctgagcggcaagctgttcgacagactgagagacgagaaccccgacttcagagagaagatcatcgccatcaacagcgagctgacccagcccaagctggccctgagcgaggaggacaaggaggtgatcatcgacagcaccaacatcatcttccactgcgccgccaccgtgagattcaacgagaacctgagagacgccgtgcagctgaacgtgatcgccaccagacagctgatcctgctggcccagcagatgaagaacctggaggtgttcatgcacgtgagcaccgcctacgcctactgcaacagaaagcacatcgacgaggtggtgtaccccccccccgtggaccccaagaagctgatcgacagcctggagtggatggacgacggcctggtgaacgacatcacccccaagctgatcggcgacagacccaacacctacatctacaccaaggccctggccgagtacgtggtgcagcaggagggcgccaagctgaacgtggccatcgtgagacccagcatcgtgggcgccagctggaaggagcccttccccggctggatcgacaacttcaacggccccagcggcctgttcatcgccgccggcaagggcatcctgagaaccatcagagccagcaacaacgccctggccgacctggtgcccgtggacgtggtggtgaacatgagcctggccgccgcctggtacagcggcgtgaacagacccagaaacatcatggtgtacaactgcaccaccggcagcaccaaccccttccactggggcgaggtggagtaccacgtgatcagcaccttcaagagaaaccccctggagcaggccttcagaagacccaacgtgaacctgaccagcaaccacctgctgtaccactactggatcgccgtgagccacaaggcccccgccttcctgtacgacatctacctgagaatgaccggcagaagccccagaatgatgaagaccatcaccagactgcacaaggccatggtgttcctggagtacttcaccagcaacagctgggtgtggaacaccgagaacgtgaacatgctgatgaaccagctgaaccccgaggacaagaagaccttcaacatcgacgtgagacagctgcactgggccgagtacatcgagaactactgcctgggcaccaagaagtacgtgctgaacgaggagatgagcggcctgcccgccgccagaaagcacctgaacaagctgagaaacatcagatacggcttcaacaccatcctggtgatcctgatctggagaatcttcatcgccagaagccagatggccagaaacatctggtacttcgtggtgagcctgtgctacaagttcctgagctacttcagagccagcagcaccatgagatactag

SEQ ID NO: 18299 - DNA, 1029 bp, Artificial Sequence
  Description of Artificial Sequence: Synthetic coding sequence
atggtgagcatccccgagtactacgagggcaagaacgtgctgctgaccggcgccaccggcttcctgggcaaggtgctgctggagaagctgctgagaagctgccccaaggtgaacagcgtgtacgtgctggtgagacagaaggccggccagaccccccaggagagagtggaggaggtgctgagcggcaagctgttcgacagactgagagacgagaaccccgacttcagagagaagatcatcgccatcaacagcgagctgacccagcccaagctggccctgagcgaggaggacaaggaggtgatcatcgacagcaccaacatcatcttccactgcgccgccaccgtgagattcaacgagaacctgagagacgccgtgcagctgaacgtgatcgccaccagacagctgatcctgctggcccagcagatgaagaacctggaggtgttcatgcacgtgagcaccgcctacgcctactgcaacagaaagcacatcgacgaggtggtgtaccccccccccgtggaccccaagaagctgatcgacagcctggagtggatggacgacggcctggtgaacgacatcacccccaagctgatcggcgacagacccaacacctacatctacaccaaggccctggccgagtacgtggtgcagcaggagggcgccaagctgaacgtggccatcgtgagacccagcatcgtgggcgccagctggaaggagcccttccccggctggatcgacaacttcaacggccccagcggcctgttcatcgccgccggcaagggcatcctgagaaccatcagagccagcaacaacgccctggccgacctggtgcccgtggacgtggtggtgaacatgagcctggccgccgcctggtacagcggcgtgaacagacccagaaacatcatggtgtacaactgcaccaccggcagcaccaaccccttccactggggcgaggtgggcatgatcctgcccgtgttcctgaacgtgagaatcaacctgaaggagcccagaaagaagaagaagaagaagtag

SEQ ID NO: 18300 - DNA, 1548 bp, Artificial Sequence
  Description of Artificial Sequence: Synthetic coding sequence
atgagcaccatcgccgccttctacggcggcaagagcatcctgatcaccggcgccaccggcttcctgggcaaggtgctgatggagaagctgttcagaaccagccccgacctgaaggtgatctacatcctggtgagacccaaggccggccagaccctgcagcagagagtgttccagatcctggacagcaagctgttcgagaaggtgaaggaggtgtgccccaacgtgcacgagaagatcagagccatctacgccgacctgaaccagaacgacttcgccatcagcaaggaggacatgcaggagctgctgagctgcaccaacatcatcttccactgcgccgccaccgtgagattcgacgacaccctgagacacgccgtgcagctgaacgtgaccgccaccagacagctgctgctgatggccagccagatgcccaagctggaggccttcatccacatcagcaccgcctacagcaactgcaacctgaagcacatcgacgaggtgatctacccctgccccgtggagcccaagaagatcatcgacagcctggagtggctggacgacgccatcatcgacgagatcacccccaagctgatcagagactggcccaacatctacacctacaccaaggccctgggcgagatggtggtgcagcaggagagcagaaacctgaacatcgccatcatcagacccagcatcgtgggcgccacctggcaggagcccttccccggctgggtggacaacatcaacggccccaacggcatcatcatcgccaccggcaagggcttcctgagagccatcaaggccacccccatggccgtggccgacgtgatccccgtggacaccgtggtgaacctgatgctggccgtgggctggtacaccgccgtgcacagacccaagagcaccctggtgtaccacatcaccagcggcaacatgaacccctgcaactggcacaagatgggcgtgcaggtgctggccaccttcgagaagatccccttcgagagacccttcagaagacccaacgccaacttcaccagcaacagcttcaccagccagtactggaacgccgtgagccacagagcccccgccatcatctacgactgctacctgagactgaccggcagaaagcccagaatgaccaagctgatgaacagactgctgagaaccgtgagcatgctggagtacttcatcaacagaagctgggagtggagcacctacaacaccgagatgctgatgagcgagctgagccccgaggaccagagagtgttcaacttcgacgtgagacagctgaactggctggagtacatcgagaactacgtgctgggcgtgaagaagtacctgctgaaggaggacatggccggcatccccaaggccaagcagagactgaagagactgagaaacatccactacctgttcaacaccgccctgttcctgatcgcctggagactgctgatcgccagaagccagatggccagaaacgtgtggttcttcatcgtgagcttctgctacaagttcctgagctacttcagagccagcagcaccctgaaggtgtag

SEQ ID NO: 18301 - DNA, 1548 bp, Artificial Sequence; identical to SEQ ID NO: 18300
  Description of Artificial Sequence: Synthetic coding sequence

SEQ ID NO: 18302 - DNA, 609 bp, Artificial Sequence
  Description of Artificial Sequence: Synthetic coding sequence
atgctgctgtggagcctgctggtgatcttcgagagagtgagagagaacctggacagcctgaccctggtggcccccagcagcgtgttcgagggcgacagcatcgtgctgaagtgccagggcgagcagaactggaagatccagaagatggcctaccacaaggacaacaaggagctgagcgtgttcaagaagttcagcgacttcctgatccagagcgccgtgctgagcgacagcggcaactacttctgcagcaccaagggccagctgttcctgtgggacaagaccagcaacatcgtgaagatcaaggtgcagggccccgacggctacagaagagacctgatgaccgccggcgtgctgtggggcctgttcggcgtgctgggcttcaccggcgtggccctgctgctgtacgccctgttccacaagatcagcggcgagagcagcgccaccaacgagcccagaggcgccagcagacccaacccccaggagttcacctacagcagccccacccccgacatggaggagctgcagcccgtgtacgtgaacgccaacatcagaaccctgctggagaacaaggacagccaggtgatctacagcagcgtgaagaagagctag

SEQ ID NO: 18303 - DNA, 1527 bp, Artificial Sequence
  Description of Artificial Sequence: Synthetic coding sequence
atgctgctgtggagcctgctggtgatcttcgacgccgtgaccgagcaggccgacagcctgaccctggtggcccccagcagcgtgttcgagggcgacagcatcgtgctgaagtgccagggcgagcagaactggaagatccagaagatggcctaccacaaggacaacaaggagctgagcgtgttcaagaagttcagcgacttcctgatccagagcgccgtgctgagcgacagcggcaactacttctgcagcaccaagggccagctgttcctgtgggacaagaccagcaacatcgtgaagatcaaggtgcaggagctgttccagagacccgtgctgaccgccagcagcttccagcccatcgagggcggccccgtgagcctgaagtgcgagaccagactgagcccccagagactggacgtgcagctgcagttctgcttcttcagagagaaccaggtgctgggcagcggctggagcagcagccccgagctgcagatcagcgccgtgtggagcgaggacaccggcagctactggtgcaaggccgagaccgtgacccacagaatcagaaagcagagcctgcagagccagatccacgtgcagagaatccccatcagcaacgtgagcctggagatcagagcccccggcggccaggtgaccgagggccagaagctgatcctgctgtgcagcgtggccggcggcaccggcaacgtgaccttcagctggtacagagaggccaccggcaccagcatgggcaagaagacccagagaagcctgagcgccgagctggagatccccgccgtgaaggagagcgacgccggcaagtactactgcagagccgacaacggccacgtgcccatccagagcaaggtggtgaacatccccgtgagaatccccgtgagcagacccgtgctgaccctgagaagccccggcgcccaggccgccgtgggcgacctgctggagctgcactgcgaggccctgagaggcagcccccccatcctgtaccagttctaccacgaggacgtgaccctgggcaacagcagcgcccccagcggcggcggcgccagcttcaacctgagcctgaccgccgagcacagcggcaactacagctgcgaggccaacaacggcctgggcgcccagtgcagcgaggccgtgcccgtgagcatcagcggccccgacggctacagaagagacctgatgaccgccggcgtgctgtggggcctgttcggcgtgctgggcttcaccggcgtggccctgctgctgtacgccctgttccacaagatcagcggcgagagcagcgccaccaacgagcccagaggcgccagcagacccaacccccaggagttcacctacagcagccccacccccgacatggaggagctgcagcccgtgtacgtgaacgtgggcagcgtggacgtggacgtggtgtacagccaggtgtggagcatgcagcagcccgagagcagcgccaacatcagaaccctgctggagaacaaggacagccaggtgatctacagcagcgtgaagaagagctag

SEQ ID NO: 18304 - DNA, 609 bp, Artificial Sequence
  Description of Artificial Sequence: Synthetic coding sequence
atgctgctgtggagcctgctggtgatcttcgacgccgtgaccgagcaggccgacagcctgaccctggtggcccccagcagcgtgttcgagggcgacagcatcgtgctgaagtgccagggcgagcagaactggaagatccagaagatggcctaccacaaggacaacaaggagctgagcgtgttcaagaagttcagcgacttcctgatccagagcgccgtgctgagcgacagcggcaactacttctgcagcaccaagggccagctgttcctgtgggacaagaccagcaacatcgtgaagatcaaggtgcagggccccgacggctacagaagagacctgatgaccgccggcgtgctgtggggcctgttcggcgtgctgggcttcaccggcgtggccctgctgctgtacgccctgttccacaagatcagcggcgagagcagcgccaccaacgagcccagaggcgccagcagacccaacccccaggagttcacctacagcagccccacccccgacatggaggagctgcagcccgtgtacgtgaacgccaacatcagaaccctgctggagaacaaggacagccaggtgatctacagcagcgtgaagaagagctag

SEQ ID NO: 18305 - DNA, 1335 bp, Artificial Sequence
  Description of Artificial Sequence: Synthetic coding sequence
atgctgctgtggagcctgctggtgatcttcgacgccgtgaccgagcaggccgacagcctgaccctggtggcccccagcagcgtgttcgagggcgacagcatcgtgctgaagtgccagggcgagcagaactggaagatccagaagatggcctaccacaaggacaacaaggagctgagcgtgttcaagaagttcagcgacttcctgatccagagcgccgtgctgagcgacagcggcaactacttctgcagcaccaagggccagctgttcctgtgggacaagaccagcaacatcgtgaagatcaaggtgcaggagctgttccagagacccgtgctgaccgccagcagcttccagcccatcgagggcggccccgtgagcctgaagtgcgagaccagactgagcccccagagactggacgtgcagctgcagttctgcttcttcagagagaaccaggtgctgggcagcggctggagcagcagccccgagctgcagatcagcgccgtgtggagcgaggacaccggcagctactggtgcaaggccgagaccgtgacccacagaatcagaaagcagagcctgcagagccagatccacgtgcagagaatccccatcagcaacgtgagcctggagatcagagcccccggcggccaggtgaccgagggccagaagctgatcctgctgtgcagcgtggccggcggcaccggcaacgtgaccttcagctggtacagagaggccaccggcaccagcatgggcaagaagacccagagaagcctgagcgccgagctggagatccccgccgtgaaggagagcgacgccggcaagtactactgcagagccgacaacggccacgtgcccatccagagcaaggtggtgaacatccccgtgagaatccccgtgagcagacccgtgctgaccctgagaagccccggcgcccaggccgccgtgggcgacctgctggagctgcactgcgaggccctgagaggcagcccccccatcctgtaccagttctaccacgaggacgtgaccctgggcaacagcagcgcccccagcggcggcggcgccagcttcaacctgagcctgaccgccgagcacagcggcaactacagctgcgaggccaacaacggcctgggcgcccagtgcagcgaggccgtgcccgtgagcatcagcggccccgacggctacagaagagacctgatgaccgccggcgtgctgtggggcctgttcggcgtgctgggcttcaccggcgtggccctgctgctgtacgccctgttccacaagatcagcggcgagagcagcgccaccaacgagcccagaacccccaagagcagcaccctgctgtag

SEQ ID NO: 18306 - DNA, 579 bp, Artificial Sequence
  Description of Artificial Sequence: Synthetic coding sequence
atgtgggagtggaagatctgcaacagccacggcgccagacccttcgccgagcccgccggctgggagttcgtgaacctgctgagacaccacaagagcttcctgatcgcccccctgtgcctgagcgtgcccgtgagcagacccgtgctgaccctgagaagccccggcgcccaggccgccgtgggcgacctgctggagctgcactgcgaggccctgagaggcagcccccccatcctgtaccagttctaccacgaggacgtgaccctgggcaacagcagcgcccccagcggcggcggcgccagcttcaacctgagcctgaccgccgagcacagcggcaactacagctgcgaggccaacaacggcctgggcgcccagtgcagcgaggccgtgcccgtgagcatcagcggccccgacggctacagaagagacctgatgaccgccggcgtgctgtggggcctgttcggcgtgctgggcttcaccggcgtggccctgctgctgtacgccctgttccacaagatcagcggctgcatctaccacctggacagcccctacttcgccatgaccttccccctgctgatctag

SEQ ID NO: 18307 - DNA, 2124 bp, Artificial Sequence
  Description of Artificial Sequence: Synthetic coding sequence
atgctgctgtggctgctgctgctgatcctgacccccggcagagagcagagcggcgtggcccccaaggccgtgctgctgctgaaccccccctggagcaccgccttcaagggcgagaaggtggccctgatctgcagcagcatcagccacagcctggcccagggcgacacctactggtaccacgacgagaagctgctgaagatcaagcacgacaagatccagatcaccgagcccggcaactaccagtgcaagaccagaggcagcagcctgagcgacgccgtgcacgtggagttcagccccgactggctgatcctgcaggccctgcaccccgtgttcgagggcgacaacgtgatcctgagatgccagggcaaggacaacaagaacacccaccagaaggtgtactacaaggacggcaagcagctgcccaacagctacaacctggagaagatcaccgtgaacagcgtgagcagagacaacagcaagtaccactgcaccgcctacagaaagttctacatcctggacatcgaggtgaccagcaagcccctgaacatccaggtgcaggagctgttcctgcaccccgtgctgagagccagcagcagcacccccatcgagggcagccccatgaccctgacctgcgagacccagctgagcccccagagacccgacgtgcagctgcagttcagcctgttcagagacagccagaccctgggcctgggctggagcagaagccccagactgcagatccccgccatgtggaccgaggacagcggcagctactggtgcgaggtggagaccgtgacccacagcatcaagaagagaagcctgagaagccagatcagagtgcagagagtgcccgtgagcaacgtgaacctggagatcagacccaccggcggccagctgatcgagggcgagaacatggtgctgatctgcagcgtggcccagggcagcggcaccgtgaccttcagctggcacaaggagggcagagtgagaagcctgggcagaaagacccagagaagcctgctggccgagctgcacgtgctgaccgtgaaggagagcgacgccggcagatactactgcgccgccgacaacgtgcacagccccatcctgagcacctggatcagagtgaccgtgagaatccccgtgagccaccccgtgctgaccttcagagcccccagagcccacaccgtggtgggcgacctgctggagctgcactgcgagagcctgagaggcagcccccccatcctgtacagattctaccacgaggacgtgaccctgggcaacagcagcgcccccagcggcggcggcgccagcttcaacctgagcctgaccgccgagcacagcggcaactacagctgcgacgccgacaacggcctgggcgcccagcacagccacggcgtgagcctgagagtgaccgtgcccgtgagcagacccgtgctgaccctgagagcccccggcgcccaggccgtggtgggcgacctgctggagctgcactgcgagagcctgagaggcagcttccccatcctgtactggttctaccacgaggacgacaccctgggcaacatcagcgcccacagcggcggcggcgccagcttcaacctgagcctgaccaccgagcacagcggcaactacagctgcgaggccgacaacggcctgggcgcccagcacagcaaggtggtgaccctgaacgtgaccggcaccagcagaaacagaaccggcctgaccgccgccggcatcaccggcctggtgctgagcatcctggtgctggccgccgccgccgccctgctgcactacgccagagccagaagaaagcccggcggcctgagcgccaccggcaccagcagccacagccccagcgagtgccaggagcccagcagcagcagacccagcagaatcgacccccaggagcccacccacagcaagcccctggcccccatggagctggagcccatgtacagcaacgtgaaccccggcgacagcaaccccatctacagccagatctggagcatccagcacaccaaggagaacagcgccaactgccccatgatgcaccaggagcacgaggagctgaccgtgctgtacagcgagctgaagaaggagcagagcagcagattcagcatgagcctgtag

SEQ ID NO: 18308 - DNA, 2205 bp, Artificial Sequence
  Description of Artificial Sequence: Synthetic coding sequence
atgctgctgtggctgctgctgctgatcctgacccccggcagagagcagagcggcgtggcccccaaggccgtgctgctgctgaaccccccctggagcaccgccttcaagggcgagaaggtggccctgatctgcagcagcatcagccacagcctggcccagggcgacacctactggtaccacgacgagaagctgctgaagatcaagcacgacaagatccagatcaccgagcccggcaactaccagtgcaagaccagaggcagcagcctgagcgacgccgtgcacgtggagttcagccccgactggctgatcctgcaggccctgcaccccgtgttcgagggcgacaacgtgatcctgagatgccagggcaaggacaacaagaacacccaccagaaggtgtactacaaggacggcaagcagctgcccaacagctacaacctggagaagatcaccgtgaacagcgtgagcagagacaacagcaagtaccactgcaccgcctacagaaagttctacatcctggacatcgaggtgaccagcaagcccctgaacatccaggtgcaggagctgttcctgcaccccgtgctgagagccagcagcagcacccccatcgagggcagccccatgaccctgacctgcgagacccagctgagcccccagagacccgacgtgcagctgcagttcagcctgttcagagacagccagaccctgggcctgggctggagcagaagccccagactgcagatccccgccatgtggaccgaggacagcggcagctactggtgcgaggtggagaccgtgacccacagcatcaagaagagaagcctgagaagccagatcagagtgcagagagtgcccgtgagcaacgtgaacctggagatcagacccaccggcggccagctgatcgagggcgagaacatggtgctgatctgcagcgtggcccagggcagcggcaccgtgaccttcagctggcacaaggagggcagagtgagaagcctgggcagaaagacccagagaagcctgctggccgagctgcacgtgctgaccgtgaaggagagcgacgccggcagatactactgcgccgccgacaacgtgcacagccccatcctgagcacctggatcagagtgaccgtgagaatccccgtgagccaccccgtgctgaccttcagagcccccagagcccacaccgtggtgggcgacctgctggagctgcactgcgagagcctgagaggcagcccccccatcctgtacagattctaccacgaggacgtgaccctgggcaacagcagcgcccccagcggcggcggcgccagcttcaacctgagcctgaccgccgagcacagcggcaactacagctgcgacgccgacaacggcctgggcgcccagcacagccacggcgtgagcctgagagtgaccgtgcccgtgagcagacccgtgctgaccctgagagcccccggcgcccaggccgtggtgggcgacctgctggagctgcactgcgagagcctgagaggcagcttccccatcctgtactggttctaccacgaggacgacaccctgggcaacatcagcgcccacagcggcggcggcgccagcttcaacctgagcctgaccaccgagcacagcggcaactacagctgcgaggccgacaacggcctgggcgcccagcacagcaaggtggtgaccctgaacgtgaccggcaccagcagaaacagaaccggcctgaccgccgccggcatcaccggcctggtgctgagcatcctggtgctggccgccgccgccgccctgctgcactacgccagagccagaagaaagcccggcggcctgagcgccaccggcaccagcagccacagccccagcgagtgccaggagcccagcagcagcagacccagcagaatcgacccccaggagcccacccacagcaagcccctggcccccatggagctggagcccatgtacagcaacgtgaaccccggcgacagcaaccccatctacagccagatctggagcatccagcacaccaaggagaacagcgccaactgccccatgatgcaccaggagcacgaggagctgaccgtgctgtacagcgagctgaagaagacccaccccgacgacagcgccggcgaggccagcagcagaggcagagcccacgaggaggacgacgaggagaactacgagaacgtgcccagagtgctgctggccagcgaccactag

SEQ ID NO: 18309 - DNA, 2229 bp, Artificial Sequence
  Description of Artificial Sequence: Synthetic coding sequence
atgctgctgtggctgctgctgctgatcctgacccccggcagagagcagagcggcgtggcccccaaggccgtgctgctgctgaaccccccctggagcaccgccttcaagggcgagaaggtggccctgatctgcagcagcatcagccacagcctggcccagggcgacacctactggtaccacgacgagaagctgctgaagatcaagcacgacaagatccagatcaccgagcccggcaactaccagtgcaagaccagaggcagcagcctgagcgacgccgtgcacgtggagttcagccccgactggctgatcctgcaggccctgcaccccgtgttcgagggcgacaacgtgatcctgagatgccagggcaaggacaacaagaacacccaccagaaggtgtactacaaggacggcaagcagctgcccaacagctacaacctggagaagatcaccgtgaacagcgtgagcagagacaacagcaagtaccactgcaccgcctacagaaagttctacatcctggacatcgaggtgaccagcaagcccctgaacatccaggtgcaggagctgttcctgcaccccgtgctgagagccagcagcagcacccccatcgagggcagccccatgaccctgacctgcgagacccagctgagcccccagagacccgacgtgcagctgcagttcagcctgttcagagacagccagaccctgggcctgggctggagcagaagccccagactgcagatccccgccatgtggaccgaggacagcggcagctactggtgcgaggtggagaccgtgacccacagcatcaagaagagaagcctgagaagccagatcagagtgcagagagtgcccgtgagcaacgtgaacctggagatcagacccaccggcggccagctgatcgagggcgagaacatggtgctgatctgcagcgtggcccagggcagcggcaccgtgaccttcagctggcacaaggagggcagagtgagaagcctgggcagaaagacccagagaagcctgctggccgagctgcacgtgctgaccgtgaaggagagcgacgccggcagatactactgcgccgccgacaacgtgcacagccccatcctgagcacctggatcagagtgaccgtgagaatccccgtgagccaccccgtgctgaccttcagagcccccagagcccacaccgtggtgggcgacctgctggagctgcactgcgagagcctgagaggcagcccccccatcctgtacagattctaccacgaggacgtgaccctgggcaacagcagcgcccccagcggcggcggcgccagcttcaacctgagcctgaccgccgagcacagcggcaactacagctgcgacgccgacaacggcctgggcgcccagcacagccacggcgtgagcctgagagtgaccgtgcccgtgagcagacccgtgctgaccctgagagcccccggcgcccaggccgtggtgggcgacctgctggagctgcactgcgagagcctgagaggcagcttccccatcctgtactggttctaccacgaggacgacaccctgggcaacatcagcgcccacagcggcggcggcgccagcttcaacctgagcctgaccaccgagcacagcggcaactacagctgcgaggccgacaacggcctgggcgcccagcacagcaaggtggtgaccctgaacgtgaccggcaccagcagaaacagaaccggcctgaccgccgccggcatcaccggcctggtgctgagcatcctggtgctggccgccgccgccgccctgctgcactacgccagagccagaagaaagcccggcggcctgagcgccaccggcaccagcagccacagccccagcgagtgccaggagcccagcagcagcagacccagcagaatcgacccccaggagcccacccacagcaagcccctggcccccatggagctggagcccatgtacagcaacgtgaaccccggcgacagcaaccccatctacagccagatctggagcatccagcacaccaaggagaacagcgccaactgccccatgatgcaccaggagcacgaggagctgaccgtgctgtacagcgagctgaagaagacccaccccgacgacagcgccggcgaggccagcagcagaggcagagcccacgaggaggacgacgaggagaactacgagaacatcctgaaccccagaaagaacaaggtgcaggacttcccctgcctgtgcaacacctag

SEQ ID NO: 18310 - DNA, 2205 bp, Artificial Sequence; identical to SEQ ID NO: 18308
  Description of Artificial Sequence: Synthetic coding sequence

SEQ ID NO: 18311 - DNA, 1548 bp, Artificial Sequence
  Description of Artificial Sequence: Synthetic coding sequence
atgctgctgtgggccagcctgctggccttcgcccccgtgtgcggccagagcgccgccgcccacaagcccgtgatcagcgtgcaccccccctggaccaccttcttcaagggcgagagagtgaccctgacctgcaacggcttccagttctacgccaccgagaagaccacctggtaccacagacactactggggcgagaagctgaccctgacccccggcaacaccctggaggtgagagagagcggcctgtacagatgccaggccagaggcagccccagaagcaaccccgtgagactgctgttcagcagcgacagcctgatcctgcaggccccctacagcgtgttcgagggcgacaccctggtgctgagatgccacagaagaagaaaggagaagctgaccgccgtgaagtacacctggaacggcaacatcctgagcatcagcaacaagagctgggacctgctgatcccccaggccagcagcaacaacaacggcaactacagatgcatcggctacggcgacgagaacgacgtgttcagaagcaacttcaagatcatcaagatccaggagctgttcccccaccccgagctgaaggccaccgacagccagcccaccgagggcaacagcgtgaacctgagctgcgagacccagctgccccccgagagaagcgacacccccctgcacttcaacttcttcagagacggcgaggtgatcctgagcgactggagcacctaccccgagctgcagctgcccaccgtgtggagagagaacagcggcagctactggtgcggcgccgagaccgtgagaggcaacatccacaagcacagccccagcctgcagatccacgtgcagagaatccccgtgagcggcgtgctgctggagacccagcccagcggcggccaggccgtggagggcgagatgctggtgctggtgtgcagcgtggccgagggcaccggcgacaccaccttcagctggcacagagaggacatgcaggagagcctgggcagaaagacccagagaagcctgagagccgagctggagctgcccgccatcagacagagccacgccggcggctactactgcaccgccgacaacagctacggccccgtgcagagcatggtgctgaacgtgaccgtgagagagacccccggcaacagagacggcctggtggccgccggcgccaccggcggcctgctgagcgccctgctgctggccgtggccctgctgttccactgctggagaagaagaaagagcggcgtgggcttcctgggcgacgagaccagactgccccccgcccccggccccggcgagagcagccacagcatctgccccgcccaggtggagctgcagagcctgtacgtggacgtgcaccccaagaagggcgacctggtgtacagcgagatccagaccacccagctgggcgaggaggaggaggccaacaccagcagaaccctgctggaggacaaggacgtgagcgtggtgtacagcgaggtgaagacccagcaccccgacaacagcgccggcaagatcagcagcaaggacgaggagagctag

SEQ ID NO: 18312 - DNA, 2934 bp, Artificial Sequence
  Description of Artificial Sequence: Synthetic coding sequence
atgctgctgtgggtgatcctgctggtgctggtgcccagccccggccagttccccagaacccccagacccatcatcttcctgcagcccccctggaccaccgtgttccagggcgagagagtgaccctgacctgcaagggcttcagattctacagcccccagaagaccaagtggtaccacagatacctgggcaaggagatcctgagagagacccccgacaacatcctggaggtgcaggagagcggcgagtacagatgccaggcccagggcagccccctgagcagccccgtgcacctggacttcagcagcgccagcctgatcctgcaggcccccctgagcgtgttcgagggcgacagcgtggtgctgagatgcagagccaaggccgaggtgaccctgaacaacaccatctacaagaacgacaacgtgctggccttcctgaacaagagaaccgacttccacatcccccacgcctgcctgaaggacaacggcgcctacagatgcaccggctacaaggagagctgctgccccgtgagcagcaacaccgtgaagatccaggtgcaggagcccttcaccagacccgtgctgagagccagcagcttccagcccatcagcggcaaccccgtgaccctgacctgcgagacccagctgagcctggagagaagcgacgtgcccctgagattcagattcttcagagacgaccagaccctgggcctgggctggagcctgagccccaacttccagatcaccgccatgtggagcaaggacagcggcttctactggtgcaaggccgccaccatgccctacagcgtgatcagcgacagccccagaagctggatccaggtgcagatccccgccagccaccccgtgctgaccctgagccccgagaaggccctgaacttcgagggcaccaaggtgaccctgcactgcgagacccaggaggacagcctgagaaccctgtacagattctaccacgagggcgtgcccctgagacacaagagcgtgagatgcgagagaggcgccagcatcagcttcagcctgaccaccgagaacagcggcaactactactgcaccgccgacaacggcctgggcgccaagcccagcaaggccgtgagcctgagcgtgaccgtgcccgtgagccaccccgtgctgaacctgagcagccccgaggacctgatcttcgagggcgccaaggtgaccctgcactgcgaggcccagagaggcagcctgcccatcctgtaccagttccaccacgagggcgccgccctggagagaagaagcgccaacagcgccggcggcgtggccatcagcttcagcctgaccgccgagcacagcggcaactactactgcaccgccgacaacggcttcggcccccagagaagcaaggccgtgagcctgagcgtgaccgtgcccgtgagccaccccgtgctgaccctgagcagcgccgaggccctgaccttcgagggcgccaccgtgaccctgcactgcgaggtgcagagaggcagcccccagatcctgtaccagttctaccacgaggacatgcccctgtggagcagcagcacccccagcgtgggcagagtgagcttcagcttcagcctgaccgagggccacagcggcaactactactgcaccgccgacaacggcttcggcccccagagaagcgaggtggtgagcctgttcgtgaccgtgcccgtgagcagacccatcctgaccctgagagtgcccagagcccaggccgtggtgggcgacctgctggagctgcactgcgaggcccccagaggcagcccccccatcctgtactggttctaccacgaggacgtgaccctgggcagcagcagcgcccccagcggcggcgaggccagcttcaacctgagcctgaccgccgagcacagcggcaactacagctgcgaggccaacaacggcctggtggcccagcacagcgacaccatcagcctgagcgtgatcgtgcccgtgagcagacccatcctgaccttcagagcccccagagcccaggccgtggtgggcgacctgctggagctgcactgcgaggccctgagaggcagcagccccatcctgtactggttctaccacgaggacgtgaccctgggcaagatcagcgcccccagcggcggcggcgccagcttcaacctgagcctgaccaccgagcacagcggcatctacagctgcgaggccgacaacggcctggaggcccagagaagcgagatggtgaccctgaaggtggccgtgcccgtgagcagacccgtgctgaccctgagagcccccggcacccacgccgccgtgggcgacctgctggagctgcactgcgaggccctgagaggcagccccctgatcctgtacagattcttccacgaggacgtgaccctgggcaacagaagcagccccagcggcggcgccagcctgaacctgagcctgaccgccgagcacagcggcaactacagctgcgaggccgacaacggcctgggcgcccagagaagcgagaccgtgaccctgtacatcaccggcctgaccgccaacagaagcggccccttcgccaccggcgtggccggcggcctgctgagcatcgccggcctggccgccggcgccctgctgctgtactgctggctgagcagaaaggccggcagaaagcccgccagcgaccccgccagaagccccagcgacagcgacagccaggagcccacctaccacaacgtgcccgcctgggaggagctgcagcccgtgtacaccaacgccaaccccagaggcgagaacgtggtgtacagcgaggtgagaatcatccaggagaagaagaagcacgccgtggccagcgaccccagacacctgagaaacaagggcagccccatcatctacagcgaggtgaaggtggccagcacccccgtgagcggcagcctgttcctggccagcagcgccccccacagatag

SEQ ID NO: 18313 - DNA, 2934 bp, Artificial Sequence
  Description of Artificial Sequence: Synthetic coding sequence
atgctgctgtgggtgatcctgctggtgctggcccccgtgagcggccagttcgccagaacccccagacccatcatcttcctgcagcccccctggaccaccgtgttccagggcgagagagtgaccctgacctgcaagggcttcagattctacagcccccagaagaccaagtggtaccacagatacctgggcaaggagatcctgagagagacccccgacaacatcctggaggtgcaggagagcggcgagtacagatgccaggcccagggcagccccctgagcagccccgtgcacctggacttcagcagcgccagcctgatcctgcaggcccccctgagcgtgttcgagggcgacagcgtggtgctgagatgcagagccaaggccgaggtgaccctgaacaacaccatctacaagaacgacaacgtgctggccttcctgaacaagagaaccgacttccacatcccccacgcctgcctgaaggacaacggcgcctacagatgcaccggctacaaggagagctgctgccccgtgagcagcaacaccgtgaagatccaggtgcaggagcccttcaccagacccgtgctgagagccagcagcttccagcccatcagcggcaaccccgtgaccctgacctgcgagacccagctgagcctggagagaagcgacgtgcccctgagattcagattcttcagagacgaccagaccctgggcctgggctggagcctgagccccaacttccagatcaccgccatgtggagcaaggacagcggcttctactggtgcaaggccgccaccatgccctacagcgtgatcagcgacagccccagaagctggatccaggtgcagatccccgccagccaccccgtgctgaccctgagccccgagaaggccctgaacttcgagggcaccaaggtgaccctgcactgcgagacccaggaggacagcctgagaaccctgtacagattctaccacgagggcgtgcccctgagacacaagagcgtgagatgcgagagaggcgccagcatcagcttcagcctgaccaccgagaacagcggcaactactactgcaccgccgacaacggcctgggcgccaagcccagcaaggccgtgagcctgagcgtgaccgtgcccgtgagccaccccgtgctgaacctgagcagccccgaggacctgatcttcgagggcgccaaggtgaccctgcactgcgaggcccagagaggcagcctgcccatcctgtaccagttccaccacgagggcgccgccctggagagaagaagcgccaacagcgccggcggcgtggccatcagcttcagcctgaccgccgagcacagcggcaactactactgcaccgccgacaacggcttcggcccccagagaagcaaggccgtgagcctgagcgtgaccgtgcccgtgagccaccccgtgctgaccctgagcagcgccgaggccctgaccttcgagggcgccaccgtgaccctgcactgcgaggtgcagagaggcagcccccagatcctgtaccagttctaccacgaggacatgcccctgtggagcagcagcacccccagcgtgggcagagtgagcttcagcttcagcctgaccgagggccacagcggcaactactactgcaccgccgacaacggcttcggcccccagagaagcgaggtggtgagcctgttcgtgaccgtgcccgtgagcagacccatcctgaccctgagagtgcccagagcccaggccgtggtgggcgacctgctggagctgcactgcgaggcccccagaggcagcccccccatcctgtactggttctaccacgaggacgtgaccctgggcagcagcagcgcccccagcggcggcgaggccagcttcaacctgagcctgaccgccgagcacagcggcaactacagctgcgaggccaacaacggcctggtggcccagcacagcgacaccatcagcctgagcgtgatcgtgcccgtgagcagacccatcctgaccttcagagcccccagagcccaggccgtggtgggcgacctgctggagctgcactgcgaggccctgagaggcagcagccccatcctgtactggttctaccacgaggacgtgaccctgggcaagatcagcgcccccagcggcggcggcgccagcttcaacctgagcctgaccaccgagcacagcggcatctacagctgcgaggccgacaacggcctggaggcccagagaagcgagatggtgaccctgaaggtggccgtgcccgtgagcagacccgtgctgaccctgagagcccccggcacccacgccgccgtgggcgacctgctggagctgcactgcgaggccctgagaggcagccccctgatcctgtacagattcttccacgaggacgtgaccctgggcaacagaagcagccccagcggcggcgccagcctgaacctgagcctgaccgccgagcacagcggcaactacagctgcgaggccgacaacggcctgggcgcccagagaagcgagaccgtgaccctgtacatcaccggcctgaccgccaacagaagcggccccttcgccaccggcgtggccggcggcctgctgagcatcgccggcctggccgccggcgccctgctgctgtactgctggctgagcagaaaggccggcagaaagcccgccagcgaccccgccagaagccccagcgacagcgacagccaggagcccacctaccacaacgtgcccgcctgggaggagctgcagcccgtgtacaccaacgccaaccccagaggcgagaacgtggtgtacagcgaggtgagaatcatccaggagaagaagaagcacgccgtggccagcgaccccagacacctgagaaacaagggcagccccatcatctacagcgaggtgaaggtggccagcacccccgtgagcggcagcctgttcctggccagcagcgccccccacagatag

SEQ ID NO: 18314 - DNA, 375 bp, Artificial Sequence
  Description of Artificial Sequence: Synthetic coding sequence
atgctgctgtgggtgatcctgctggtgctggcccccgtgagcggccagttcgccagaacccccagacccatcatcttcctgcagcccccctggaccaccgtgttccagggcgagagagtgaccctgacctgcaagggcttcagattctacagcccccagaagaccaagtggtaccacagatacctgggcaaggagatcctgagagagacccccgacaacatcctggaggtgcaggagagcggcgagtacagatgccaggcccagggcagccccctgagcagccccgtgcacctggacttcagcagcgagatgggcttcccccacgccgcccaggccaacgtggagctgctgggcagcagcgacctgctgacctag

SEQ ID NO: 18315 - DNA, 1779 bp, Artificial Sequence
  Description of Artificial Sequence: Synthetic coding sequence
atgctgctgtgggtgatcctgctggtgctggcccccgtgagcggccagttcgccagaacccccagacccatcatcttcctgcagcccccctggaccaccgtgttccagggcgagagagtgaccctgacctgcaagggcttcagattctacagcccccagaagaccaagtggtaccacagatacctgggcaaggagatcctgagagagacccccgacaacatcctggaggtgcaggagagcggcgagtacagatgccaggcccagggcagccccctgagcagccccgtgcacctggacttcagcagcgccagcctgatcctgcaggcccccctgagcgtgttcgagggcgacagcgtggtgctgagatgcagagccaaggccgaggtgaccctgaacaacaccatctacaagaacgacaacgtgctggccttcctgaacaagagaaccgacttccacatcccccacgcctgcctgaaggacaacggcgcctacagatgcaccggctacaaggagagctgctgccccgtgagcagcaacaccgtgaagatccaggtgcaggagcccttcaccagacccgtgctgagagccagcagcttccagcccatcagcggcaaccccgtgaccctgacctgcgagacccagctgagcctggagagaagcgacgtgcccctgagattcagattcttcagagacgaccagaccctgggcctgggctggagcctgagccccaacttccagatcaccgccatgtggagcaaggacagcggcttctactggtgcaaggccgccaccatgccctacagcgtgatcagcgacagccccagaagctggatccaggtgcagatccccgccagccaccccgtgctgaccctgagccccgagaaggccctgaacttcgagggcaccaaggtgaccctgcactgcgagacccaggaggacagcctgagaaccctgtacagattctaccacgagggcgtgcccctgagacacaagagcgtgagatgcgagagaggcgccagcatcagcttcagcctgaccaccgagaacagcggcaactactactgcaccgccgacaacggcctgggcgccaagcccagcaaggccgtgagcctgagcgtgaccgtgcccgtgagccaccccgtgctgaacctgagcagccccgaggacctgatcttcgagggcgccaaggtgaccctgcactgcgaggcccagagaggcagcctgcccatcctgtaccagttccaccacgagggcgccgccctggagagaagaagcgccaacagcgccggcggcgtggccatcagcttcagcctgaccgccgagcacagcggcaactactactgcaccgccgacaacggcttcggcccccagagaagcaaggccgtgagcctgagcgtgaccgtgcccgtgagccaccccgtgctgaccctgagcagcgccgaggccctgaccttcgagggcgccaccgtgaccctgcactgcgaggtgcagagaggcagcccccagatcctgtaccagttctaccacgaggacatgcccctgtggagcagcagcacccccagcgtgggcagagtgagcttcagcttcagcctgaccgagggccacagcggcaactactactgcaccgccgacaacggcttcggcccccagagaagcgaggtggtgagcctgttcgtgaccggcaagtgctgggtgctggccagccacccccccctggccgagttcagcctgacccacagcttcaagaacctgttcgccctgagcagcttcctgccctag

SEQ ID NO: 18316 - DNA, 2280 bp, Artificial Sequence
  Description of Artificial Sequence: Synthetic coding sequence
atgctgctgtgggtgatcctgctggtgctggcccccgtgagcggccagttcgccagaacccccagacccatcatcttcctgcagcccccctggaccaccgtgttccagggcgagagagtgaccctgacctgcaagggcttcagattctacagcccccagaagaccaagtggtaccacagatacctgggcaaggagatcctgagagagacccccgacaacatcctggaggtgcaggagagcggcgagtacagatgccaggcccagggcagccccctgagcagccccgtgcacctggacttcagcagcgccagcctgatcctgcaggcccccctgagcgtgttcgagggcgacagcgtggtgctgagatgcagagccaaggccgaggtgaccctgaacaacaccatctacaagaacgacaacgtgctggccttcctgaacaagagaaccgacttccacatcccccacgcctgcctgaaggacaacggcgcctacagatgcaccggctacaaggagagctgctgccccgtgagcagcaacaccgtgaagatccaggtgcaggagcccttcaccagacccgtgctgagagccagcagcttccagcccatcagcggcaaccccgtgaccctgacctgcgagacccagctgagcctggagagaagcgacgtgcccctgagattcagattcttcagagacgaccagaccctgggcctgggctggagcctgagccccaacttccagatcaccgccatgtggagcaaggacagcggcttctactggtgcaaggccgccaccatgccctacagcgtgatcagcgacagccccagaagctggatccaggtgcagatccccgccagccaccccgtgctgaccctgagccccgagaaggccctgaacttcgagggcaccaaggtgaccctgcactgcgagacccaggaggacagcctgagaaccctgtacagattctaccacgagggcgtgcccctgagacacaagagcgtgagatgcgagagaggcgccagcatcagcttcagcctgaccaccgagaacagcggcaactactactgcaccgccgacaacggcctgggcgccaagcccagcaaggccgtgagcctgagcgtgaccgtgcccgtgagccaccccgtgctgaacctgagcagccccgaggacctgatcttcgagggcgccaaggtgaccctgcactgcgaggcccagagaggcagcctgcccatcctgtaccagttccaccacgagggcgccgccctggagagaagaagcgccaacagcgccggcggcgtggccatcagcttcagcctgaccgccgagcacagcggcaactactactgcaccgccgacaacggcttcggcccccagagaagcaaggccgtgagcctgagcgtgaccgtgcccgtgagccaccccgtgctgaccctgagcagcgccgaggccctgaccttcgagggcgccaccgtgaccctgcactgcgaggtgcagagaggcagcccccagatcctgtaccagttctaccacgaggacatgcccctgtggagcagcagcacccccagcgtgggcagagtgagcttcagcttcagcctgaccgagggccacagcggcaactactactgcaccgccgacaacggcttcggcccccagagaagcgaggtggtgagcctgttcgtgaccgtgcccgtgagcagacccatcctgaccctgagagtgcccagagcccaggccgtggtgggcgacctgctggagctgcactgcgaggcccccagaggcagcccccccatcctgtactggttctaccacgaggacgtgaccctgggcagcagcagcgcccccagcggcggcgaggccagcttcaacctgagcctgaccgccgagcacagcggcaactacagctgcgaggccaacaacggcctggtggcccagcacagcgacaccatcagcctgagcgtgatcgtgcccgtgagcagacccatcctgaccttcagagcccccagagcccaggccgtggtgggcgacctgctggagctgcactgcgaggccctgagaggcagcagccccatcctgtactggttctaccacgaggacgtgaccctgggcaagatcagcgcccccagcggcggcggcgccagcttcaacctgagcctgaccaccgagcacagcggcatctacagctgcgaggccgacaacggcctggaggcccagagaagcgagatggtgaccctgaaggtggccggcgagtgggccctgcccaccagcagcaccagcgagaactag

SEQ ID NO: 18317 - DNA, 2025 bp, Artificial Sequence
  Description of Artificial Sequence: Synthetic coding sequence
atgctgctgtgggtgatcctgctggtgctggcccccgtgagcggccagttcgccagcctgatcctgcaggcccccctgagcgtgttcgagggcgacagcgtggtgctgagatgcagagccaaggccgaggtgaccctgaacaacaccatctacaagaacgacaacgtgctggccttcctgaacaagagaaccgacttccacatcccccacgcctgcctgaaggacaacggcgcctacagatgcaccggctacaaggagagctgctgccccgtgagcagcaacaccgtgaagatccaggtgcaggagcccttcaccagacccgtgctgagagccagcagcttccagcccatcagcggcaaccccgtgaccctgacctgcgagacccagctgagcctggagagaagcgacgtgcccctgagattcagattcttcagagacgaccagaccctgggcctgggctggagcctgagccccaacttccagatcaccgccatgtggagcaaggacagcggcttctactggtgcaaggccgccaccatgccctacagcgtgatcagcgacagccccagaagctggatccaggtgcagatccccgccagccaccccgtgctgaccctgagccccgagaaggccctgaacttcgagggcaccaaggtgaccctgcactgcgagacccaggaggacagcctgagaaccctgtacagattctaccacgagggcgtgcccctgagacacaagagcgtgagatgcgagagaggcgccagcatcagcttcagcctgaccaccgagaacagcggcaactactactgcaccgccgacaacggcctgggcgccaagcccagcaaggccgtgagcctgagcgtgaccgtgcccgtgagccaccccgtgctgaacctgagcagccccgaggacctgatcttcgagggcgccaaggtgaccctgcactgcgaggcccagagaggcagcctgcccatcctgtaccagttccaccacgagggcgccgccctggagagaagaagcgccaacagcgccggcggcgtggccatcagcttcagcctgaccgccgagcacagcggcaactactactgcaccgccgacaacggcttcggcccccagagaagcaaggccgtgagcctgagcgtgaccgtgcccgtgagccaccccgtgctgaccctgagcagcgccgaggccctgaccttcgagggcgccaccgtgaccctgcactgcgaggtgcagagaggcagcccccagatcctgtaccagttctaccacgaggacatgcccctgtggagcagcagcacccccagcgtgggcagagtgagcttcagcttcagcctgaccgagggccacagcggcaactactactgcaccgccgacaacggcttcggcccccagagaagcgaggtggtgagcctgttcgtgaccgtgcccgtgagcagacccatcctgaccctgagagtgcccagagcccaggccgtggtgggcgacctgctggagctgcactgcgaggcccccagaggcagcccccccatcctgtactggttctaccacgaggacgtgaccctgggcagcagcagcgcccccagcggcggcgaggccagcttcaacctgagcctgaccgccgagcacagcggcaactacagctgcgaggccaacaacggcctggtggcccagcacagcgacaccatcagcctgagcgtgatcgtgcccgtgagcagacccatcctgaccttcagagcccccagagcccaggccgtggtgggcgacctgctggagctgcactgcgaggccctgagaggcagcagccccatcctgtactggttctaccacgaggacgtgaccctgggcaagatcagcgcccccagcggcggcggcgccagcttcaacctgagcctgaccaccgagcacagcggcatctacagctgcgaggccgacaacggcctggaggcccagagaagcgagatggtgaccctgaaggtggccggcgagtgggccctgcccaccagcagcaccagcgagaactag

SEQ ID NO: 18318 - DNA, 1194 bp, Artificial Sequence
  Description of Artificial Sequence: Synthetic coding sequence
atgctgctgtggaccgccgtgctgctgttcgtgccctgcgtgggcaagaccgtgtggctgtacctgcaggcctggcccaaccccgtgttcgagggcgacgccctgaccctgagatgccagggctggaagaacacccccctgagccaggtgaagttctacagagacggcaagttcctgcacttcagcaaggagaaccagaccctgagcatgggcgccgccaccgtgcagagcagaggccagtacagctgcagcggccaggtgatgtacatcccccagaccttcacccagaccagcgagaccgccatggtgcaggtgcaggagctgttccccccccccgtgctgagcgccatccccagccccgagcccagagagggcagcctggtgaccctgagatgccagaccaagctgcaccccctgagaagcgccctgagactgctgttcagcttccacaaggacggccacaccctgcaggacagaggcccccaccccgagctgtgcatccccggcgccaaggagggcgacagcggcctgtactggtgcgaggtggcccccgagggcggccaggtgcagaagcagagcccccagctggaggtgagagtgcaggcccccgtgagcagacccgtgctgaccctgcaccacggccccgccgaccccgccgtgggcgacatggtgcagctgctgtgcgaggcccagagaggcagcccccccatcctgtacagcttctacctggacgagaagatcgtgggcaaccacagcgccccctgcggcggcaccaccagcctgctgttccccgtgaagagcgagcaggacgccggcaactacagctgcgaggccgagaacagcgtgagcagagagagaagcgagcccaagaagctgagcctgaagggcagccaggtgctgttcacccccgccagcaactggctggtgccctggctgcccgccagcctgctgggcctgatggtgatcgccgccgccctgctggtgtacgtgagaagctggagaaaggccggccccctgcccagccagatcccccccaccgcccccggcggcgagcagtgccccctgtacgccaacgtgcaccaccagaagggcaaggacgagggcgtggtgtacagcgtggtgcacagaaccagcaagagaagcgagggccagttctaccacctgtgcggcggcgagatgcccgccgcccagtag

SEQ ID NO: 18319 - DNA, 1305 bp, Artificial Sequence
  Description of Artificial Sequence: Synthetic coding sequence
atgctgctgtggaccgccgtgctgctgttcgtgccctgcgtgggcaagaccgtgtggctgtacctgcaggcctggcccaaccccgtgttcgagggcgacgccctgaccctgagatgccagggctggaagaacacccccctgagccaggtgaagttctacagagacggcaagttcctgcacttcagcaaggagaaccagaccctgagcatgggcgccgccaccgtgcagagcagaggccagtacagctgcagcggccaggtgatgtacatcccccagaccttcacccagaccagcgagaccgccatggtgcaggtgcaggagctgttccccccccccgtgctgagcgccatccccagccccgagcccagagagggcagcctggtgaccctgagatgccagaccaagctgcaccccctgagaagcgccctgagactgctgttcagcttccacaaggacggccacaccctgcaggacagaggcccccaccccgagctgtgcatccccggcgccaaggagggcgacagcggcctgtactggtgcgaggtggcccccgagggcggccaggtgcagaagcagagcccccagctggaggtgagagtgcaggcccccgtgagcagacccgtgctgaccctgcaccacggccccgccgaccccgccgtgggcgacatggtgcagctgctgtgcgaggcccagagaggcagcccccccatcctgtacagcttctacctggacgagaagatcgtgggcaaccacagcgccccctgcggcggcaccaccagcctgctgttccccgtgaagagcgagcaggacgccggcaactacagctgcgaggccgagaacagcgtgagcagagagagaagcgagcccaagaagctgagcctgaagggcagccaggtgctgttcacccccgccagcaactggctggtgccctggctgcccgccagcctgctgggcctgatggtgatcgccgccgccctgctggtgtacgtgagaagctggagaaaggccggccccctgcccagccagatcccccccaccgcccccggcggcgagcagtgccccctgtacgccaacgtgcaccaccagaagggcaaggacgagggcgtggtgtacagcgtggtgcacagaaccagcaagagaagcgaggccagaagcgccgagttcaccgtgggcagaaaggacagcagcatcatctgcgccgaggtgagatgcctgcagcccagcgaggtgagcagcaccgaggtgaacatgagaagcagaaccctgcaggagcccctgagcgactgcgaggaggtgctgtgctag

SEQ ID NO: 18320 - DNA, 936 bp, Artificial Sequence
  Description of Artificial Sequence: Synthetic coding sequence
atgctgctgtggaccgccgtgctgctgttcgtgccctgcgtgggcaagaccgtgtggctgtacctgcaggcctggcccaaccccgtgttcgagggcgacgccctgaccctgagatgccagggctggaagaacacccccctgagccaggtgaagttctacagagacggcaagttcctgcacttcagcaaggagaaccagaccctgagcatgggcgccgccaccgtgcagagcagaggccagtacagctgcagcggccaggtgatgtacatcccccagaccttcacccagaccagcgagaccgccatggtgcaggtgcaggcccccgtgagcagacccgtgctgaccctgcaccacggccccgccgaccccgccgtgggcgacatggtgcagctgctgtgcgaggcccagagaggcagcccccccatcctgtacagcttctacctggacgagaagatcgtgggcaaccacagcgccccctgcggcggcaccaccagcctgctgttccccgtgaagagcgagcaggacgccggcaactacagctgcgaggccgagaacagcgtgagcagagagagaagcgagcccaagaagctgagcctgaagggcagccaggtgctgttcacccccgccagcaactggctggtgccctggctgcccgccagcctgctgggcctgatggtgatcgccgccgccctgctggtgtacgtgagaagctggagaaaggccggccccctgcccagccagatcccccccaccgcccccggcggcgagcagtgccccctgtacgccaacgtgcaccaccagaagggcaaggacgagggcgtggtgtacagcgtggtgcacagaaccagcaagagaagcgaggccagaagcgccgagttcaccgtgggcagaaagttctaccacctgtgcggcggcgagatgcccgccgcccagtag

SEQ ID NO: 18321 - DNA, 1581 bp, Artificial Sequence
  Description of Artificial Sequence: Synthetic coding sequence
atggtgaacgagggccccaaccaggaggagagcgacgacacccccgtgcccgagagcgccctgcaggccgaccccagcgtgagcgtgcaccccagcgtgagcgtgcaccccagcgtgagcatcaaccccagcgtgagcgtgcaccccagcagcagcgcccaccccagcgccctggcccagcccagcggcctggcccaccccagcagcagcggccccgaggacctgagcgtgatcaaggtgagcagaagaagatgggccgtggtgctggtgttcagctgctacagcatgtgcaacagcttccagtggatccagtacggcagcatcaacaacatcttcatgcacttctacggcgtgagcgccttcgccatcgactggctgagcatgtgctacatgctgacctacatccccctgctgctgcccgtggcctggctgctggagaagttcggcctgagaaccatcgccctgaccggcagcgccctgaactgcctgggcgcctgggtgaagctgggcagcctgaagccccacctgttccccgtgaccgtggtgggccagctgatctgcagcgtggcccaggtgttcatcctgggcatgcccagcagaatcgccagcgtgtggttcggcgccaacgaggtgagcaccgcctgcagcgtggccgtgttcggcaaccagctgggcatcgccatcggcttcctggtgccccccgtgctggtgcccaacatcgaggacagagacgagctggcctaccacatcagcatcatgttctacatcatcggcggcgtggccaccctgctgctgatcctggtgatcatcgtgttcaaggagaagcccaagtacccccccagcagagcccagagcctgagctacgccctgaccagccccgacgccagctacctgggcagcatcgccagactgttcaagaacctgaacttcgtgctgctggtgatcacctacggcctgaacgccggcgccttctacgccctgagcaccctgctgaacagaatggtgatctggcactaccccggcgaggaggtgaacgccggcagaatcggcctgaccatcgtgatcgccggcatgctgggcgccgtgatcagcggcatctggctggacagaagcaagacctacaaggagaccaccctggtggtgtacatcatgaccctggtgggcatggtggtgtacaccttcaccctgaacctgggccacctgtgggtggtgttcatcaccgccggcaccatgggcttcttcatgaccggctacctgcccctgggcttcgagttcgccgtggagctgacctaccccgagagcgagggcatcagcagcggcctgctgaacatcagcgcccaggtgttcggcatcatcttcaccatcagccagggccagatcatcgacaactacggcaccaagcccggcaacatcttcctgtgcgtgttcctgaccctgggcgccgccctgaccgccttcatcaaggccgacctgagaagacagaaggccaacaaggagaccctggagaacaagctgcaggaggaggaggaggagagcaacaccagcaaggtgcccaccgccgtgagcgaggaccacctgtag

SEQ ID NO: 18322 - DNA, 966 bp, Artificial Sequence
  Description of Artificial Sequence: Synthetic coding sequence
atgagcgccgacaacagcagcaccatctgcgtgtgcagaagcgtgagacaggagctgggcatcgccatcggcttcctggtgccccccgtgctggtgcccaacatcgaggacagagacgagctggcctaccacatcagcatcatgttctacatcatcggcggcgtggccaccctgctgctgatcctggtgatcatcgtgttcaaggagaagcccaagtacccccccagcagagcccagagcctgagctacgccctgaccagccccgacgccagctacctgggcagcatcgccagactgttcaagaacctgaacttcgtgctgctggtgatcacctacggcctgaacgccggcgccttctacgccctgagcaccctgctgaacagaatggtgatctggcactaccccggcgaggaggtgaacgccggcagaatcggcctgaccatcgtgatcgccggcatgctgggcgccgtgatcagcggcatctggctggacagaagcaagacctacaaggagaccaccctggtggtgtacatcatgaccctggtgggcatggtggtgtacaccttcaccctgaacctgggccacctgtgggtggtgttcatcaccgccggcaccatgggcttcttcatgaccggctacctgcccctgggcttcgagttcgccgtggagctgacctaccccgagagcgagggcatcagcagcggcctgctgaacatcagcgcccaggtgttcggcatcatcttcaccatcagccagggccagatcatcgacaactacggcaccaagcccggcaacatcttcctgtgcgtgttcctgaccctgggcgccgccctgaccgccttcatcaaggccgacctgagaagacagaaggccaacaaggagaccctggagaacaagctgcaggaggaggaggaggagagcaacaccagcaaggtgcccaccgccgtgagcgaggaccacctgtag

SEQ ID NO: 18323 - DNA, 5574 bp, Artificial Sequence
  Description of Artificial Sequence: Synthetic coding sequence
atgttcggcctgaaggtgaagaagaagagaaacaaggccgagaagggcctgatcctggccaacaaggccgccaaggacagccagggcgacaccgaggccctgcaggaggagcccagccaccaggagggccccagaggcgacctggtgcacgacgacgccagcatcttccccgtgcccagcgccagccccaagagaagaagcaagctgctgaccaagatccacgacggcgaggtgagaagccagaactaccagatcgccatcaccatcaccgaggccagacagctggtgggcgagaacatcgaccccgtggtgaccatcgagatcggcgacgagaagaagcagagcaccgtgaaggagggcaccaacagccccttctacaacgagtacttcgtgttcgacttcatcggcccccaggtgcacctgttcgacaagatcatcaagatcagcgtgttccaccacaagctgatcggcagcgtgctgatcggcagcttcaaggtggacctgggcaccgtgtacaaccagcccggccaccagttctgcaacaagtgggccctgctgaccgaccccggcgacatcagaaccggcaccaagggctacctgaagtgcgacatcagcgtgatgggcaagggcgacgtgctgaagaccagccccaagaccagcgacaccgaggagcccatcgagaagaacctgctgatccccaacggcttccccctggagagaccctgggccagattctacgtgagactgtacaaggccgagggcctgcccaagatgaacagcagcatcatggccaacgtgaccaaggccttcgtgggcgacagcaaggacctggtggaccccttcgtggaggtgagcttcgccggccagatgggcagaaccaccgtgcagaagaactgcgccgaccccgtgtggcacgagcaggtgatcttcaaggagatgttcccccccctgtgcagaagagtgaagatccaggtgtgggacgagggcagcatgaacgacgtggccctggccacccacttcatcgacctgaagaagatcagcaacgagcaggacggcgacaagggcttcctgcccaccttcggccccgcctggatcaacctgtacggcagccccagaaaccacagcctgatggacgactaccaggagatgaacgagggcttcggcgagggcgtgagcttcagaggcagaatcctggtggagatcgccgtggagatcctgagcggcagagcccaggagagcaagttcagcaaggccctgaaggagctgaagctgcccagcaaggacaaggacagcaagagcagcaagggcaaggacaaggccgacaagaccgaggacggcaagagccagcaggccagcaacaagaccaacagcaccgaggtggaggtggagagcttcgacgtgccccccgagatcgtgcccgagaagaacgaggagttcctgctgttcggcgccttcttcgaggccaccatgatcgacagaaagatcggcgacaagcccatcagcttcgaggtgagcatcggcaacttcggcaacctgatcgacggcggcagccaccacggcagcaagaagagcgccgagagcgccgaggaggacctgctgcccctgctgcacgagggccagggcgacgtggcccacgacgtgcccatccccatggccagcaccacccaccccgagaagcccctggtgaccgagggcaacagaaactacaactacctgcccttcgaggccaagaagccctgcgtgtacttcatcagcagctggggcgaccagaccttcagactgcactggagcaacatgctggagaagatggccgacttcctggaggagagcatcgaggaggtgagagagctgatcaagatcagccaggaggcccccgaggagaagatgaagaccgtgctgagcgacttcatcagcagaagcagcgccttcatcagcgaggccgagaagaagcccaagatgctgaaccagaccaccctggacaagaagagactgaccctgtgctggcaggagctggaggccatgtgcaaggaggccaagggcatcatccagcagcagaagaagaagctgagcgtggacgagatgatccacgaggcccagaacttcgtggagaagatcagattcctggtggacgagccccagcacaccatccccgacgtgttcatctggatgctgagcaacaacagaagagtggcctacgccagaatcgccagcaaggacctgctgtacagccccgtggccggccagatgggcaagcactgcggcaagatcaagacccacttcctgaagccccccggcaagagacccgccggctggagcgtgcaggccaaggtggacgtgtacctgtggctgggcagcatcaagcacgccagcgccatcctggacaacctgcccgtgggctacgaggccgagatgagcagcaagggcgccggcaccaaccacccccccagcaacctgctgtaccaggagcagcacgtgttccagctgagagcccacatgtaccaggccagaggcctgatcgccgccgacagcaacggcctgagcgaccccttcgccaaggtgaccttcctgagccactgccagaccaccaagatcatcagccagaccctgagccccacctggaaccagatgctgctgttcaacgacctggtgctgcacggcgacgtgaaggagctggccgagagcccccccctggtggtggtggagctgtacgacagcgacgccgtgggcaagcccgagtacctgggcgccaccgtggccgcccccgtggtgaagctggccgaccaggactacgagccccccagactgtgctaccaccccatcttctgcggcaacctgagcggcggcgacctgctggccgtgttcgagctgctgcaggtgccccccagcggcctgcagggcctgccccccgtggagccccccgacatcacccagatctaccccgtgcccgccaacatcagacccgtgctgagcaagtacagagtggaggtgctgttctggggcgtgagagagatgaagaaggtgcagctgctgagcgtggacagaccccaggccctgatcgagtgcggcggccagggcgtgaagagctgcgtgatccagagctacaagaacaaccccaacttcagcatccaggccgacgccttcgaggtggagctgcccgagaacgagctgctgcacccccccctgagcatctgcgtggtggactggagagccttcggcagaagcaccctggtgggcacctacaccatcaactacctgaagcagttcctgtgcaagctgagagagcccctggcccccatcacccaggtggacggcacccagcccggccacgacatcagcgacagcctgaccgccaccgagagcagcggcgcccacagcagcagccaggacccccccgccgaccacatctacgtggacgtggagcccccccccaccgtggtgcccgacagcgcccaggcccagcccgccatcctggtggacgtgcccgacagcagccccatgctggagcccgagcacacccccgtggcccaggagccccccaaggacggcaagcccaaggaccccagaaagcccagcagaagaagcaccaagagaagaaagagaaccatcgccgacgagagcgccgagaacgtgatcgactggtggagcaagtactacgccagcctgaagaaggcccagaaggccaaggagagaaaccccaagggcaagaagggcaacaccgaggccaagcccgacgaggtggtggtggacatcgaggacggccccaagaagaagaaggacaagatgctgaagaagaagcccaaggacgacggcatccccaacctggccatcctgcagatctacgacggcgacctggagagcgagttcaacaacttcgaggactgggtgaagaccttcgagctgttcagaggcaagagcaccgaggacgaccacggcctggacggcgacagagtgatcggcaagttcaagggcagcttctgcatctacaagagcccccaggacagcagcagcgaggacagcggccagctgagaatccagcagggcatcccccccaaccaccccgtgaccgtgctgatcagagtgtacatcgtggccgccttcaacctgagccccgccgaccccgacggcaagagcgacccctacatcgtgatcaagctgggcaagaccgagatcaaggacagagacaagtacatccccaagcagctgaaccccgtgttcggcagaagcttcgagatccaggccaccttccccaaggagagcctgctgagcatcctgatctacgaccacgacatgatcggcaccgacgacctgatcggcgagaccaagatcgacctggagaacagattctacagcaagcacagagccatctgcggcctgcagagccagtacgagatcgagggctacaacgcctggagagacaccagcaagcccaccgagatcctgaccaagctgtgcaaggacaacaagctggacggcccctacttccaccccggcaagatccagatcggcaaccaggtgttcagcggcaagaccatcttcaccgaggaggacaccgacgagaccgtggagagctacgagcacctggccctgaaggtgctgcacagctgggaggacatccccgaggtgggctgcagactggtgcccgagcacatcgagaccagacccctgtaccacaaggacaagcccggcatggagcagggcagactgcagatgtgggtggacatgttccccaaggacatgccccagcccggcccccccgtggacatcagccccagaagacccaagggctacgagctgagagtgaccatctggaacaccgaggacgtgatcctggaggacgagaacatcttcaccggccagaagagcagcgacatctacgtgaagggctggctgaagggcctggaggacgacaagcaggagaccgacgtgcactacaacagcctgaccggcgagggcaacttcaactggagattcctgttccccttccagtacctgcccgccgagaagcagatggtgatcaccaagagagagaacatcttcagcctggagaagatggagtgcaagacccccgccgtgctggtgctgcaggtgtgggacttcgagagactgagcagcgacgacttcctgggcaccctggagatgaacctgaacagcttccccagagccgccaagagcgccaaggcctgcgacctggccaagttcgagaacgccagcgaggagaccaagatcagcatcttccagcagaagagagtgagaggctggtggcccttcagcaagagcaaggagctgaccggcaaggtggaggccgagttccacctggtgaccgccgaggaggccgagaagaaccccgtgggcaaggccagaaaggagcccgagcccctggccaagcccaacagacccgacaccagcttcagctggttcatgagccccttcaagtgcctgtactacctgatctggaagaactacaagaagtacatcatcatcgccttcatcctgatcatcctgatcatcttcctggtgctgttcatctacaccctgcccggcgccatcagcagaagaatcgtggtgggcagctag

SEQ ID NO: 18324 - DNA, 5574 bp, Artificial Sequence; identical to SEQ ID NO: 18323
  Description of Artificial Sequence: Synthetic coding sequence

SEQ ID NO: 18325 - DNA, 189 bp, Artificial Sequence
  Description of Artificial Sequence: Synthetic coding sequence
atggaggagctggagaccagcctgttccagaccagaaaggcccacagaatcgagcagatggtggccagatggctgagaagaagcagagacagcagcgccagagccaaggtggccgccgccgacggccccgccagaaaccccacccagaccctgatccccgtgagacacaccgtgaagatcgacaagtag

SEQ ID NO: 18326 - DNA, 4737 bp, Artificial Sequence
  Description of Artificial Sequence: Synthetic coding sequence
atggaggagctggagaccagcctgttccagaccagaaaggcccacagaatcgagcagatggtggccagatggctgagaagaagcagagacagcagcgccagagccaaggtggccgccgccgacggccccgccagaaaccccacccagaccctgatccccgtgagacacaccgtgaagatcgacaaggacaccctgctgcaggactacggcttccacatcagcgagagcctgcccctgaccgtggtggccgtgaccgccggcggcagcgcccacggcaagctgttccccggcgaccagatcctgcagatgaacaacgagcccgccgaggacctgagctgggagagagccgtggacatcctgagagaggccgaggacagcctgagcatcaccgtggtgagatgcaccagcggcgtgcccaagagcagcttcctgaccgaggagaagagagccagactgaagaccaaccccgtgaaggtgcacttcgccgaggaggtgctgatcagcggccacagccagggcaacagcctgctgtgcatgcccaacgtgctgaagctgtacctggagaacggccagaccaaggccttcaagttcgaggccaacaccaccgtgaaggacatcatcctgaccgtgaaggagaagctgagcatcagaagcatcgagtacttcgccctggccctggaggagcagtacagcatcagcagactgcacctgctgcacgaggaggagctgatccagcaggtggtggagagagaggagagccacgactacagatgcctgttcagagtgtgcttcgtgcccaaggaccccctggacctgctgaaggaggaccccgtggccttcgagtacctgtacctgcagagctgcagcgacgtgctgcaggagagattcgccgtggagatgaagtgcagcagcgccctgagactggccgccctgcacatccaggagagaatctacgcctgcgcccagccccagaagatcagcctgaagtacatcgagaaggactggggcatcgagaacttcatcagccccaccctgctgagaaacatgaagggcaaggacatcaagaaggccatcagcttccacatgaagagaaaccagaacctgctggagcccagacagaagcagctgatcagcgccgcccagctgagactgaactacctgcagatcctgggcgagctgaagacctacggcggcagaatcttcaacgccaccctgatgctgcaggacagagagagctacatcgccctgctggtgggcgccaagtacggcatcagccaggtgatcaacagcaagctgaacatcatgagcaccctggccgagttcgccaacatcagcagagtggagctgaccgaggagagcgagaaggtgagcgtggtgaaggtgtacctgcaggacgtgaaggtgctgaccctgctgctggagagcaacagcgccaaggacctggcctgcctgatcgccggctactacagactgctggtggaccccgtgaccagcatcttcctgtggcccggcaacaagcagcaggcccacagagtgagcgccgaggagggctacgagagcagagcctgcagcgacagcgaggagagcagcgaggtggactgcgtgctggagcccctgagcgacagaagactggtgaagctggccccctgcagaagcctgatcaaggaggagcagccccccggcaacagccccacccccgaggtggccagaagaggccccagcacctgcggcgccagcagcaccaccgacagcgccgagagcgaggccagcgacagcgccaacaccgagagcagaggctacagaaccagcggcagcagcgagagcatggacgccctggaggaggacgacctggacacctgcagcagcagcagaagcaccttcttccacttcggcagccccggcctggccgagagcatcgacagcgacagccaggaggagagaagcggcatcgagaccagcggcttcctgtgcctgctggacctggcccagagagccaacccccagtgccagaagaccgagttcagcgagagcgccgccctggagaccttcggctgggcccccgagctgagcaccgtgagactggaccccagactgtacgagggcagccacgccgactactacagcctgtgcagcagcgtgagccccgccagctacctgagcgacagcagcgagagcaccgccagcagacagggcggcgccccccccgcctggggccagcagggctggaccgaggcccagcccagcagcatgctggagcccctggccctgcacccccccctggccttcgaggacggcagcagcgacgaggagtactacgacgccgccgacaagctgaccccccccggcccccccagcggccccagagacgtgagcaccgccgagcccagcgccaccagcctgcagaacaaggccagcaccagcagccccgagaacagcctgccctgcggccccgacggcagacagcccagcagaagaggcggcgtgaagaagtacgccaagaccctgagaaagagaagaagcttcctgcagaccgactacaccagccaggtgagcttccccctggtgcccagcgccagcctggagagcgtggacgacgtgtgctactacgacagagagccctacctggccctgggcgcccccagccccaccgtgagcagcctgcaggacatgcagggcgagcccggcctgctggagaccaaggccctgggcctgctggcccccctgagagagaccaagagcaccaaccccgccagcagagtgatggagatggagcccgagaccatggagaccaagagcgtgatcgacagcagagtgagcagcatcagcgccatcagattcagaatcgaccccaacaacaaggagaacagcggcgtggtgcccgccgccagcagcagcgccagcaccccccactgcagcaaccccggcagcagcggccccgacaccgcccaggccagacccagccagatcctgcccctgagccaggacctggacggcatcgcccccaaggagcccaccatcgagcacggcgacagcagcttcagcctgagcagcggcgaccccaaccccgacagagcctgcctggccagcaaccccggcctgaacaacgtgagccagggcgacaccctggagctgcagctggagccccacgtgcagctggagatgggcctggagagcttctgcaccaaccacatccaggagaccgcccccaagtacaccgagcccctgctgagccccagagacgagcccagaagcgacgagtgcggcatcaaccccggcgagaagatcgccagcatccccaccaaggaggagccccagggccagctgagcctggagagagacagagaggtgaccaacaagaacggcaccaacgtgttccaggaggagagcagaaaggacagcggcgacagccccggcgacgtgagcaacaacgtgagccagaccctggacatcagcagccccgccggcaagatcgtgaccagcctgagcctggacgcccccgtgaccggcaccgagcagatccccccccacccccccagagacccccagggccagagcagagagccccccggccagggctgccaggcccaggagcagaagctgttcgtggagctggacctggaccccgacttcttcctgggcaagcagaccgtgagccccgccgtgccccccgagggcatcaaggccgaggcccccaaccacgtgaccggccaggacatcgcccccagagacagccccgagtgggtgtgcttcaaccccgagcccagcctgcccgagcccctgccctgcccccaggaggacccccacctggagaccagcaaccactgcctgctgagcgagggcaagagcgacagcagcagcatctgcctgagcgccgagaagagcttcctgtgcttcgcccccgagagccaccccgaggtgagcgccagcctgagagtggccaccagcctgggcttcgccggcatgaacgagatggtggcccccagaatcggcatggaccagtgcagctgccagttcagctacgccacctgcttcagaggcccccagcccgagaccgaggaggaggacagagacctggaggcccaccccatggcccccctgaccagcccccccagcgccggcagccccgtggtgctgccctggagacccgccagagcccacagctgcaccaccgcccccctgagcagaaagagccacatctggcccgagtactgcagcagagccctgagacagctgaaggccacccccgccagcacccccgagggcttcatccagctgatggagagcctgctggagctgcaggacatcctggagaccagctggggcgtgggcaacaagcacccccccgagaagtgcacctggcacttcaccgagagcagaagcagactgtgcatgggcagccagaagctgctgagcagctgcagacacgtgatcagaatggaccagagccccgaggagatgcagggcgccgtgagagacaccttccagcacctggtgcagctggccggcctgtgcttccagttcaccgactgcagcagatgcagcgccagacacagagaggccgccggcaacctgagagacgtggtgtacacctaccaccagttcatcgaggccgccaagagcacctgcgagagaggctaccacgacctgagcgtgaagctgctggccagacagtgcaccgccctgaccgccgccgtgttctgcctgacccagaagttcagagccagcaccgccctgtag

SEQ ID NO: 18327 - DNA, 1905 bp, Artificial Sequence
  Description of Artificial Sequence: Synthetic coding sequence
atgcccaacgtgctgaagctgtacctggagaacggccagaccaaggccttcaagttcgaggccaacaccaccgtgaaggacatcatcctgaccgtgaaggagaagctgagcatcagaagcatcgagtacttcgccctggccctggaggagcagtacagcatcagcagactgcacctgctgcacgaggaggagctgatccagcaggtggtggagagagaggagagccacgactacagatgcctgttcagagtgtgcttcgtgcccaaggaccccctggacctgctgaaggaggaccccgtggccttcgagtacctgtacctgcagagctgcagcgacgtgctgcaggagagattcgccgtggagatgaagtgcagcagcgccctgagactggccgccctgcacatccaggagagaatctacgcctgcgcccagccccagaagatcagcctgaagtacatcgagaaggactggggcatcgagaacttcatcagccccaccctgctgagaaacatgaagggcaaggacatcaagaaggccatcagcttccacatgaagagaaaccagaacctgctggagcccagacagaagcagctgatcagcgccgcccagctgagactgaactacctgcagatcctgggcgagctgaagacctacggcggcagaatcttcaacgccaccctgatgctgcaggacagagagagctacatcgccctgctggtgggcgccaagtacggcatcagccaggtgatcaacagcaagctgaacatcatgagcaccctggccgagttcgccaacatcagcagagtggagctgaccgaggagagcgagaaggtgagcgtggtgaaggtgtacctgcaggacgtgaaggtgctgaccctgctgctggagagcaacagcgccaaggacctggcctgcctgatcgccggctactacagactgctggtggaccccgtgaccagcatcttcctgtggcccggcaacaagcagcaggcccacagagtgagcgccgaggagggctacgagagcagagcctgcagcgacagcgaggagagcagcgaggtggactgcgtgctggagcccctgagcgacagaagactggtgaagctggccccctgcagaagcctgatcaaggaggagcagccccccggcaacagccccacccccgaggtggccagaagaggccccagcacctgcggcgccagcagcaccaccgacagcgccgagagcgaggccagcgacagcgccaacaccgagagcagaggctacagaaccagcggcagcagcgagagcatggacgccctggaggaggacgacctggacacctgcagcagcagcagaagcaccttcttccacttcggcagccccggcctggccgagagcatcgacagcgacagccaggaggagagaagcggcatcgagaccagcggcttcctgtgcctgctggacctggcccagagagccaacccccagtgccagaagaccgagttcagcgagagcgccgccctggagaccttcggctgggcccccgagctgagcaccgtgagactggaccccagactgtacgagggcagccacgccgactactacagcctgtgcagcagcgtgagccccgccagctacctgagcgacagcagcgagagcaccgccagcagacagggcggcgccccccccgcctggggccagcagggctggaccgaggcccagcccagcagcatgctggagcccctggccctgcacccccccctggccttcgaggacggcagcagcgacgaggagtactacgacgccgccgacaagctgaccccccccggcccccccagcggcgagcccagcctggccggcctgcagaccagacaggccgcccccgagtgcctgcccggcatcaaggcctggggccaggcctag

SEQ ID NO: 18328 - DNA, 4737 bp, Artificial Sequence; identical to SEQ ID NO: 18326
  Description of Artificial Sequence: Synthetic coding sequence

SEQ ID NO: 18329 - DNA, 2046 bp, Artificial Sequence
  Description of Artificial Sequence: Synthetic coding sequence
atggccgaggtgggcggcgtgcccaagagcagcttcctgaccgaggagaagagagccagactgaagaccaaccccgtgaaggtgcacttcgccgaggaggtgctgatcagcggccacagccagggcaacagcctgctgtgcatgcccaacgtgctgaagctgtacctggagaacggccagaccaaggccttcaagttcgaggccaacaccaccgtgaaggacatcatcctgaccgtgaaggagaagctgagcatcagaagcatcgagtacttcgccctggccctggaggagcagtacagcatcagcagactgcacctgctgcacgaggaggagctgatccagcaggtggtggagagagaggagagccacgactacagatgcctgttcagagtgtgcttcgtgcccaaggaccccctggacctgctgaaggaggaccccgtggccttcgagtacctgtacctgcagagctgcagcgacgtgctgcaggagagattcgccgtggagatgaagtgcagcagcgccctgagactggccgccctgcacatccaggagagaatctacgcctgcgcccagccccagaagatcagcctgaagtacatcgagaaggactggggcatcgagaacttcatcagccccaccctgctgagaaacatgaagggcaaggacatcaagaaggccatcagcttccacatgaagagaaaccagaacctgctggagcccagacagaagcagctgatcagcgccgcccagctgagactgaactacctgcagatcctgggcgagctgaagacctacggcggcagaatcttcaacgccaccctgatgctgcaggacagagagagctacatcgccctgctggtgggcgccaagtacggcatcagccaggtgatcaacagcaagctgaacatcatgagcaccctggccgagttcgccaacatcagcagagtggagctgaccgaggagagcgagaaggtgagcgtggtgaaggtgtacctgcaggacgtgaaggtgctgaccctgctgctggagagcaacagcgccaaggacctggcctgcctgatcgccggctactacagactgctggtggaccccgtgaccagcatcttcctgtggcccggcaacaagcagcaggcccacagagtgagcgccgaggagggctacgagagcagagcctgcagcgacagcgaggagagcagcgaggtggactgcgtgctggagcccctgagcgacagaagactggtgaagctggccccctgcagaagcctgatcaaggaggagcagccccccggcaacagccccacccccgaggtggccagaagaggccccagcacctgcggcgccagcagcaccaccgacagcgccgagagcgaggccagcgacagcgccaacaccgagagcagaggctacagaaccagcggcagcagcgagagcatggacgccctggaggaggacgacctggacacctgcagcagcagcagaagcaccttcttccacttcggcagccccggcctggccgagagcatcgacagcgacagccaggaggagagaagcggcatcgagaccagcggcttcctgtgcctgctggacctggcccagagagccaacccccagtgccagaagaccgagttcagcgagagcgccgccctggagaccttcggctgggcccccgagctgagcaccgtgagactggaccccagactgtacgagggcagccacgccgactactacagcctgtgcagcagcgtgagccccgccagctacctgagcgacagcagcgagagcaccgccagcagacagggcggcgccccccccgcctggggccagcagggctggaccgaggcccagcccagcagcatgctggagcccctggccctgcacccccccctggccttcgaggacggcagcagcgacgaggagtactacgacgccgccgacaagctgaccccccccggcccccccagcggcgagcccagcctggccggcctgcagaccagacaggccgcccccgagtgcctgcccggcatcaaggcctggggccaggcctag

SEQ ID NO: 18330 - DNA, 1713 bp, Artificial Sequence
  Description of Artificial Sequence: Synthetic coding sequence
atgctgagcagactgatgagcggcagcagcagaagcctggagagagagtacagctgcaccgtgagactgctggacgacagcgagtacacctgcaccatccagagagacgccaagggccagtacctgttcgacctgctgtgccaccacctgaacctgctggagaaggactacttcggcatcagattcgtggaccccgacaagcagagacactggctggagttcaccaagagcgtggtgaagcagctgagaagccagccccccttcaccatgtgcttcagagtgaagttctaccccgccgaccccgccgccctgaaggaggagatcaccagatacctggtgttcctgcagatcaagagagacctgtaccacggcagactgctgtgcaagaccagcgacgccgccctgctggccgcctacatcctgcaggccgagatcggcgactacgacagcggcaagcaccccgagggctacagcagcaagttccagttcttccccaagcacagcgagaagctggagagaaagatcgccgagatccacaagaccgagctgagcggccagacccccgccaccagcgagctgaacttcctgagaaaggcccagaccctggagacctacggcgtggacccccacccctgcaaggacgtgagcggcaacgccgccttcctggccttcacccccttcggcttcgtggtgctgcagggcaacaagagagtgcacttcatcaagtggaacgaggtgaccaagctgaagttcgagggcaagaccttctacctgtacgtgagccagaaggaggagaagaagatcatcctgacctacttcgcccccacccccgaggcctgcaagcacctgtggaagtgcggcatcgagaaccaggccttctacaagctggagaagagcagccaggtgagaaccgtgagcagcagcaacctgttcttcaagggcagcagattcagatacagcggcagagtggccaaggaggtgatggagagcagcgccaagatcaagagagagccccccgagatccacagagccggcatggtgcccagcagaagctgccccagcatcacccacggccccagactgagcagcgtgcccagaaccagaagaagagccgtgcacatcagcatcatggagggcctggagagcctgagagacagcgcccacagcacccccgtgagaagcaccagccacggcgacaccttcctgccccacgtgagaagcagcagaaccgacagcaacgagagagtggccgtgatcgccgacgaggcctacagccccgccgacagcgtgctgcccacccccgtggccgagcacagcctggagctgatgctgctgagcagacagatcaacggcgccacctgcagcatcgaggaggagaaggagagcgaggccagcacccccaccgccaccgaggtggaggccctgggcggcgagctgagagccctgtgccagggccacagcggccccgaggaggagcaggtgaacaagttcgtgctgagcgtgctgagactgctgctggtgaccatgggcctgctgttcgtgctgctgctgctgctgatcatcctgaccgagagcgacctggacatcgccttcttcagagacatcagacagacccccgagttcgagcagttccactaccagtacttctgccccctgagaagatggttcgcctgcaagatcagaagcgtggtgagcctgctgatcgacacctag

SEQ ID NO: 18331 - DNA, 1245 bp, Artificial Sequence
  Description of Artificial Sequence: Synthetic coding sequence
atgtgcttcagagtgaagttctaccccgccgaccccgccgccctgaaggaggagatcaccagatacctggtgttcctgcagatcaagagagacctgtaccacggcagactgctgtgcaagaccagcgacgccgccctgctggccgcctacatcctgcaggccgagatcggcgactacgacagcggcaagcaccccgagggctacagcagcaagttccagttcttccccaagcacagcgagaagctggagagaaagatcgccgagatccacaagaccgagctgagcggccagacccccgccaccagcgagctgaacttcctgagaaaggcccagaccctggagacctacggcgtggacccccacccctgcaaggacgtgagcggcaacgccgccttcctggccttcacccccttcggcttcgtggtgctgcagggcaacaagagagtgcacttcatcaagtggaacgaggtgaccaagctgaagttcgagggcaagaccttctacctgtacgagaagaagatcatcctgacctacttcgcccccacccccgaggcctgcaagcacctgtggaagtgcggcatcgagaaccaggccttctacaagctggagaagagcagccaggtgagaaccgtgagcagcagcaacctgttcttcaagggcagcagattcagatacagcggcagagtggccaaggaggtgatggagagcagcgccaagatcaagagagagccccccgagatccacagagccggcatggtgcccagcagaagctgccccagcatcacccacggccccagactgagcagcgtgcccagaaccagaagaagagccgtgcacatcagcatcatggagggcctggagagcctgagagacagcgcccacagcacccccgtgagaagcaccagccacggcgacaccttcctgccccacgtgagaagcagcagaaccgacagcaacgagagagtggccgtgatcgccgacgaggcctacagccccgccgacagcgtgctgcccacccccgtggccgagcacagcctggagctgatgctgctgagcagacagatcaacggcgccacctgcagcatcgaggaggagaaggagagcgaggccagcacccccaccgccaccgaggtggaggccctgggcggcgagctgagagccctgtgccagggccacagcggccccgaggaggagcaggccatggtgtgcctgcagaaccccctgagcggcgagcccgcccactag

SEQ ID NO: 18332 - DNA, 1869 bp, Artificial Sequence
  Description of Artificial Sequence: Synthetic coding sequence
atgaacaagctgaacttccacaacaacagagtgatgcaggacagaagaagcgtgtgcatcttcctgcccaacgacgagagcctgaacatcatcatcaacgtgaagatcctgtgccaccagctgctggtgcaggtgtgcgacctgctgagactgaaggactgccacctgttcggcctgagcgtgatccagaacaacgagcacgtgtacatggagctgagccagaagctgtacaagtactgccccaaggagtggaagaaggaggccagcaaggtgagacagtacgaggtgacctggggcatcgaccagttcggcccccccatgatcatccacttcagagtgcagtactacgtggagaacggcagactgatcagcgacagagccgccagatactactactactggcacctgagaaagcaggtgctgcacagccagtgcgtgctgagagaggaggcctacttcctgctggccgccttcgccctgcaggccgacctgggcaacttcaagagaaacaagcactacggcaagtacttcgagcccgaggcctacttccccagctgggtggtgagcaagagaggcaaggactacatcctgaagcacatccccaacatgcacaaggaccagttcgccctgaccgccagcgaggcccacctgaagtacatcaaggaggccgtgagactggacgacgtggccgtgcactactacagactgtacaaggacaagagagagatcgaggccagcctgaccctgggcctgaccatgagaggcatccagatcttccagaacctggacgaggagaagcagctgctgtacgacttcccctggaccaacgtgggcaagctggtgttcgtgggcaagaagttcgagatcctgcccgacggcctgcccagcgccagaaagctgatctactacaccggctgccccatgagaagcagacacctgctgcagctgctgagcaacagccacagactgtacatgaacctgcagcccgtgctgagacacatcagaaagctggaggagaacgaggagaagaagcagtacagagagagctacatcagcgacaacctggacctggacatggaccagctggagaagagaagcagagccagcggcagcagcgccggcagcatgaagcacaagagactgagcagacacagcaccgccagccacagcagcagccacaccagcggcatcgaggccgacaccaagcccagagacaccggccccgaggacagctacagcagcagcgccatccacagaaagctgaagacctgcagcagcatgaccagccacggcagcagccacaccagcggcgtggagagcggcggcaaggacagactggaggaggacctgcaggacgacgagatcgagatgctggtggacgaccccagagacctggagcagatgaacgaggagagcctggaggtgagccccgacatgtgcatctacatcaccgaggacatgctgatgagcagaaagctgaacggccacagcggcctgatcgtgaaggagatcggcagcagcaccagcagcagcagcgagaccgtggtgaagctgagaggccagagcaccgacagcctgccccagaccatctgcagaaagcccaagaccagcaccgacagacacagcctgagcctggacgacatcagactgtaccagaaggacttcctgagaatcgccggcctgtgccaggacaccgcccagagctacaccttcggctgcggccacgagctggacgaggagggcctgtactgcaacagctgcctggcccagcagtgcatcaacatccaggacgccttccccgtgaagagaaccagcaagtacttcagcctggacctgacccacgacgaggtgcccgagttcgtggtgtag

SEQ ID NO: 18333 - DNA, 1845 bp, Artificial Sequence
  Description of Artificial Sequence: Synthetic coding sequence
atgaacaagctgaacttccacaacaacagagtgatgcaggacagaagaagcgtgtgcatcttcctgcccaacgacgagagcctgaacatcatcatcaacgtgaagatcctgtgccaccagctgctggtgcaggtgtgcgacctgctgagactgaaggactgccacctgttcggcctgagcgtgatccagaacaacgagcacgtgtacatggagctgagccagaagctgtacaagtactgccccaaggagtggaagaaggaggccagcaagggcatcgaccagttcggcccccccatgatcatccacttcagagtgcagtactacgtggagaacggcagactgatcagcgacagagccgccagatactactactactggcacctgagaaagcaggtgctgcacagccagtgcgtgctgagagaggaggcctacttcctgctggccgccttcgccctgcaggccgacctgggcaacttcaagagaaacaagcactacggcaagtacttcgagcccgaggcctacttccccagctgggtggtgagcaagagaggcaaggactacatcctgaagcacatccccaacatgcacaaggaccagttcgccctgaccgccagcgaggcccacctgaagtacatcaaggaggccgtgagactggacgacgtggccgtgcactactacagactgtacaaggacaagagagagatcgaggccagcctgaccctgggcctgaccatgagaggcatccagatcttccagaacctggacgaggagaagcagctgctgtacgacttcccctggaccaacgtgggcaagctggtgttcgtgggcaagaagttcgagatcctgcccgacggcctgcccagcgccagaaagctgatctactacaccggctgccccatgagaagcagacacctgctgcagctgctgagcaacagccacagactgtacatgaacctgcagcccgtgctgagacacatcagaaagctggaggagaacgaggagaagaagcagtacagagagagctacatcagcgacaacctggacctggacatggaccagctggagaagagaagcagagccagcggcagcagcgccggcagcatgaagcacaagagactgagcagacacagcaccgccagccacagcagcagccacaccagcggcatcgaggccgacaccaagcccagagacaccggccccgaggacagctacagcagcagcgccatccacagaaagctgaagacctgcagcagcatgaccagccacggcagcagccacaccagcggcgtggagagcggcggcaaggacagactggaggaggacctgcaggacgacgagatcgagatgctggtggacgaccccagagacctggagcagatgaacgaggagagcctggaggtgagccccgacatgtgcatctacatcaccgaggacatgctgatgagcagaaagctgaacggccacagcggcctgatcgtgaaggagatcggcagcagcaccagcagcagcagcgagaccgtggtgaagctgagaggccagagcaccgacagcctgccccagaccatctgcagaaagcccaagaccagcaccgacagacacagcctgagcctggacgacatcagactgtaccagaaggacttcctgagaatcgccggcctgtgccaggacaccgcccagagctacaccttcggctgcggccacgagctggacgaggagggcctgtactgcaacagctgcctggcccagcagtgcatcaacatccaggacgccttccccgtgaagagaaccagcaagtacttcagcctggacctgacccacgacgaggtgcccgagttcgtggtgtag

SEQ ID NO: 18334 - DNA, 1845 bp, Artificial Sequence; identical to SEQ ID NO: 18333
  Description of Artificial Sequence: Synthetic coding sequence

SEQ ID NO: 18335 - DNA, 795 bp, Artificial Sequence
  Description of Artificial Sequence: Synthetic coding sequence
atggaccagctggagaagagaagcagagccagcggcagcagcgccggcagcatgaagcacaagagactgagcagacacagcaccgccagccacagcagcagccacaccagcggcatcgaggccgacaccaagcccagagacaccggccccgaggacagctacagcagcagcgccatccacagaaagctgaagacctgcagcagcatgaccagccacggcagcagccacaccagcggcgtggagagcggcggcaaggacagactggaggaggacctgcaggacgacgagatcgagatgctggtggacgaccccagagacctggagcagatgaacgaggagagcctggaggtgagccccgacatgtgcatctacatcaccgaggacatgctgatgagcagaaagctgaacggccacagcggcctgatcgtgaaggagatcggcagcagcaccagcagcagcagcgagaccgtggtgaagctgagaggccagagcaccgacagcctgccccagaccatctgcagaaagcccaagaccagcaccgacagacacagcctgagcctggacgacatcagactgtaccagaaggacttcctgagaatcgccggcctgtgccaggacaccgcccagagctacaccttcggctgcggccacgagctggacgaggagggcctgtactgcaacagctgcctggcccagcagtgcatcaacatccaggacgccttccccgtgaagagaaccagcaagtacttcagcctggacctgacccacgacgaggtgcccgagttcgtggtgtag

SEQ ID NO: 18336 - DNA, 186 bp, Artificial Sequence
  Description of Artificial Sequence: Synthetic coding sequence
atgaacaagctgaacttccacaacaacagagtgatgcaggacagaagaagcgtgtgcatcttcctgcccaacgacgagagcctgaacatcatcatcaacgtgaagatcctgtgccaccagctgctggtgcaggtgtgcgacctgctgagactgaaggactgccacctgttcggcctgagcgtgtag

SEQ ID NO: 18337 - DNA, 3138 bp, Artificial Sequence
  Description of Artificial Sequence: Synthetic coding sequence
atgggcgagatcgagcagagacccacccccggcagcagactgggcgcccccgagaacagcggcatcagcaccctggagagaggccagaagcccccccccacccccagcggcaagctggtgagcatcaagatccagatgctggacgacacccaggaggccttcgaggtgccccagagagcccccggcaaggtgctgctggacgccgtgtgcaaccacctgaacctggtggagggcgactacttcggcctggagttccccgaccacaagaagatcaccgtgtggctggacctgctgaagcccatcgtgaagcagatcagaagacccaagcacgtggtggtgaagttcgtggtgaagttcttcccccccgaccacacccagctgcaggaggagctgaccagatacctgttcgccctgcaggtgaagcaggacctggcccagggcagactgacctgcaacgacaccagcgccgccctgctgatcagccacatcgtgcagagcgagatcggcgacttcgacgaggccctggacagagagcacctggccaagaacaagtacatcccccagcaggacgccctggaggacaagatcgtggagttccaccacaaccacatcggccagacccccgccgagagcgacttccagctgctggagatcgccagaagactggagatgtacggcatcagactgcaccccgccaaggacagagagggcaccaagatcaacctggccgtggccaacaccggcatcctggtgttccagggcttcaccaagatcaacgccttcaactgggccaaggtgagaaagctgagcttcaagagaaagagattcctgatcaagctgagacccgacgccaacagcgcctaccaggacaccctggagttcctgatggccagcagagacttctgcaagagcttctggaagatctgcgtggagcaccacgccttcttcagactgttcgaggagcccaagcccaagcccaagcccgtgctgttcagcagaggcagcagcttcagattcagcggcagaacccagaagcaggtgctggactacgtgaaggagggcggccacaagaaggtgcagttcgagagaaagcacagcaagatccacagcatcagaagcctggccagccagcccaccgagctgaacagcgaggtgctggagcagagccagcagagcaccagcctgaccttcggcgagggcgccgagagccccggcggccagagctgcagaagaggcaaggagcccaaggtgagcgccggcgagcccggcagccaccccagccccgcccccagaagaagccccgccggcaacaagcaggccgacggcgccgccagcgcccccaccgaggaggaggaggaggtggtgaaggacagaacccagcagagcaagccccagcccccccagcccagcaccggcagcctgaccggcagcccccacctgagcgagctgagcgtgaacagccagggcggcgtggcccccgccaacgtgaccctgagccccaacctgagccccgacaccaagcaggccagccccctgatcagccccctgctgaacgaccaggcctgccccagaaccgacgacgaggacgagggcagaagaaagagattccccaccgacaaggcctacttcatcgccaaggaggtgagcaccaccgagagaacctacctgaaggacctggaggtgatcaccagctggttccagagcaccgtgagcaaggaggacgccatgcccgaggccctgaagagcctgatcttccccaacttcgagcccctgcacaagttccacaccaacttcctgaaggagatcgagcagagactggccctgtgggagggcagaagcaacgcccagatcagagactaccagagaatcggcgacgtgatgctgaagaacatccagggcatgaagcacctggccgcccacctgtggaagcacagcgaggccctggaggccctggagaacggcatcaagagcagcagaagactggagaacttctgcagagacttcgagctgcagaaggtgtgctacctgcccctgaacaccttcctgctgagacccctgcacagactgatgcactacaagcaggtgctggagagactgtgcaagcaccacccccccagccacgccgacttcagagactgcagagccgccctggccgagatcaccgagatggtggcccagctgcacggcaccatgatcaagatggagaacttccagaagctgcacgagctgaagaaggacctgatcggcatcgacaacctggtggtgcccggcagagagttcatcagactgggcagcctgagcaagctgagcggcaagggcctgcagcagagaatgttcttcctgttcaacgacgtgctgctgtacaccagcagaggcctgaccgccagcaaccagttcaaggtgcacggccagctgcccctgtacggcatgaccatcgaggagagcgaggacgagtggggcgtgccccactgcctgaccctgagaggccagagacagagcatcatcgtggccgccagcagcagaagcgagatggagaagtgggtggaggacatccagatggccatcgacctggccgagaagagcagcagccccgcccccgagttcctggccagcagcccccccgacaacaagagccccgacgaggccaccgccgccgaccaggagagcgaggacgacctgagcgccagcagaaccagcctggagagacaggccccccacagaggcaacaccatggtgcacgtgtgctggcacagaaacaccagcgtgagcatggtggacttcagcatcgccgtggagaaccagctgagcggcaacctgctgagaaagttcaagaacagcaacggctggcagaagctgtgggtggtgttcaccaacttctgcctgttcttctacaagagccaccaggacaaccaccccctggccagcctgcccctgctgggctacagcctgaccatccccagcgagagcgagaacatccagaaggactacgtgttcaagctgcacttcaagagccacgtgtactacttcagagccgagagcgagtacaccttcgagagatggatggaggtgatcagaagcgccaccagcagcgccagcagaccccacgtgctgagccacaaggagagcctggtgtactag

SEQ ID NO: 18338 - DNA, 390 bp, Artificial Sequence
  Description of Artificial Sequence: Synthetic coding sequence
atgggcgagatcgagcagagacccacccccggcagcagactgggcgcccccgagaacagcggcatcagcaccctggagagaggccagaagcccccccccacccccagcggcaagctggtgagcatcaagatccagatgctggacgacacccaggaggccttcgaggtgcccatggtgagcagcagcagcttcctgaaggccaccggcagcagctggaccggctgggtgctgagatgcagcatgaagcccaagcaccacagccacctgatcgagaagttcggcgaggacagaatcctgacccacctgaccggcagcatcagctacaccaactgggccggcagcagaagcctggccgtgaccgtgaccgaggagctgctgaacctgttctag

SEQ ID NO: 18339 - DNA, 1083 bp, Artificial Sequence
  Description of Artificial Sequence: Synthetic coding sequence
atggccagcagagacttctgcaagagcttctggaagatctgcgtggagcaccacgccttcttcagactgttcgaggagcccaagcccaagcccaagcccgtgctgttcagcagaggcagcagcttcagattcagcggcagaacccagaagcaggtgctggactacgtgaaggagggcggccacaagaaggtgcagttcgagagaaagcacagcaagatccacagcatcagaagcctggccagccagcccaccgagctgaacagcgaggtgctggagcagagccagcagagcaccagcctgaccttcggcgagggcgccgagagccccggcggccagagctgcagaagaggcaaggagcccaaggtgagcgccggcgagcccggcagccaccccagccccgcccccagaagaagccccgccggcaacaagcaggccgacggcgccgccagcgcccccaccgaggaggaggaggaggtggtgaaggacagaacccagcagagcaagccccagcccccccagcccagcaccggcagcctgaccggcagcccccacctgagcgagctgagcgtgaacagccagggcggcgtggcccccgccaacgtgaccctgagccccaacctgagccccgacaccaagcaggccagccccctgatcagccccctgctgaacgaccaggcctgccccagaaccgacgacgaggacgagggcagaagaaagagattccccaccgacaaggcctacttcatcgccaaggaggtgagcaccaccgagagaacctacctgaaggacctggaggtgatcaccagctggttccagagcaccgtgagcaaggaggacgccatgcccgaggccctgaagagcctgatcttccccaacttcgagcccctgcacaagttccacaccaacttcctgaaggagatcgagcagagactggccctgtgggagggcagaagcaacgcccagatcagagactaccagagaatcggcgacgtgatgctgaagaacatccagggcatgaaggccggcgtgcagtggagagacctgggcagcctgcagccccccccccccagattcaagccctag

SEQ ID NO: 18340 - DNA, 3231 bp, Artificial Sequence
  Description of Artificial Sequence: Synthetic coding sequence
atgggcgagatcgagcagagacccacccccggcagcagactgggcgcccccgagaacagcggcatcagcaccctggagagaggccagaagcccccccccacccccagcggcaagctggtgagcatcaagatccagatgctggacgacacccaggaggccttcgaggtgccccagagagcccccggcaaggtgctgctggacgccgtgtgcaaccacctgaacctggtggagggcgactacttcggcctggagttccccgaccacaagaagatcaccgtgtggctggacctgctgaagcccatcgtgaagcagatcagaagacccaagcacgtggtggtgaagttcgtggtgaagttcttcccccccgaccacacccagctgcaggaggagctgaccagatacctgttcgccctgcaggtgaagcaggacctggcccagggcagactgacctgcaacgacaccagcgccgccctgctgatcagccacatcgtgcagagcgagatcggcgacttcgacgaggccctggacagagagcacctggccaagaacaagtacatcccccagcaggacgccctggaggacaagatcgtggagttccaccacaaccacatcggccagacccccgccgagagcgacttccagctgctggagatcgccagaagactggagatgtacggcatcagactgcaccccgccaaggacagagagggcaccaagatcaacctggccgtggccaacaccggcatcctggtgttccagggcttcaccaagatcaacgccttcaactgggccaaggtgagaaagctgagcttcaagagaaagagattcctgatcaagctgagacccgacgccaacagcgcctaccaggacaccctggagttcctgatggccagcagagacttctgcaagagcttctggaagatctgcgtggagcaccacgccttcttcagactgttcgaggagcccaagcccaagcccaagcccgtgctgttcagcagaggcagcagcttcagattcagcggcagaacccagaagcaggtgctggactacgtgaaggagggcggccacaagaaggtgcagttcgagagaaagcacagcaagatccacagcatcagaagcctggccagccagcccaccgagctgaacagcgaggtgctggagcagagccagcagagcaccagcctgaccttcggcgagggcgccgagagccccggcggccagagctgcagaagaggcaaggagcccaaggtgagcgccggcgagcccggcagccaccccagccccgcccccagaagaagccccgccggcaacaagcaggccgacggcgccgccagcgcccccaccgaggaggaggaggaggtggtgaaggacagaacccagcagagcaagccccagcccccccagcccagcaccggcagcctgaccggcagcccccacctgagcgagctgagcgtgaacagccagggcggcgtggcccccgccaacgtgaccctgagccccaacctgagccccgacaccaagcaggccagccccctgatcagccccctgctgaacgaccaggcctgccccagaaccgacgacgaggacgagggcagaagaaagagattccccaccgacaaggcctacttcatcgccaaggaggtgagcaccaccgagagaacctacctgaaggacctggaggtgatcaccagctggttccagagcaccgtgagcaaggaggacgccatgcccgaggccctgaagagcctgatcttccccaacttcgagcccctgcacaagttccacaccaacttcctgaaggagatcgagcagagactggccctgtgggagggcagaagcaacgcccagatcagagactaccagagaatcggcgacgtgatgctgaagaacatccagggcatgaagcacctggccgcccacctgtggaagcacagcgaggccctggaggccctggagaacggcatcaagagcagcagaagactggagaacttctgcagagacttcgagctgcagaaggtgtgctacctgcccctgaacaccttcctgctgagacccctgcacagactgatgcactacaagcaggtgctggagagactgtgcaagcaccacccccccagccacgccgacttcagagactgcagagccgccctggccgagatcaccgagatggtggcccagctgcacggcaccatgatcaagatggagaacttccagaagctgcacgagctgaagaaggacctgatcggcatcgacaacctggtggtgcccggcagacccggcagcttcagcctgatcagaaccccccacctgggccaggccagaagaatcccctgcgcccccgagagaagacccctgctgctggtgaaggagttcatcagactgggcagcctgagcaagctgagcggcaagggcctgcagcagagaatgttcttcctgttcaacgacgtgctgctgtacaccagcagaggcctgaccgccagcaaccagttcaaggtgcacggccagctgcccctgtacggcatgaccatcgaggagagcgaggacgagtggggcgtgccccactgcctgaccctgagaggccagagacagagcatcatcgtggccgccagcagcagaagcgagatggagaagtgggtggaggacatccagatggccatcgacctggccgagaagagcagcagccccgcccccgagttcctggccagcagcccccccgacaacaagagccccgacgaggccaccgccgccgaccaggagagcgaggacgacctgagcgccagcagaaccagcctggagagacaggccccccacagaggcaacaccatggtgcacgtgtgctggcacagaaacaccagcgtgagcatggtggacttcagcatcgccgtggagaaccagctgagcggcaacctgctgagaaagttcaagaacagcaacggctggcagaagctgtgggtggtgttcaccaacttctgcctgttcttctacaagagccaccaggacaaccaccccctggccagcctgcccctgctgggctacagcctgaccatccccagcgagagcgagaacatccagaaggactacgtgttcaagctgcacttcaagagccacgtgtactacttcagagccgagagcgagtacaccttcgagagatggatggaggtgatcagaagcgccaccagcagcgccagcagaccccacgtgctgagccacaaggagagcctggtgtactag

SEQ ID NO: 18341 - DNA, 462 bp, Artificial Sequence
  Description of Artificial Sequence: Synthetic coding sequence
tgactgtgcaagcaccacccccccagccacgccgacttcagagactgcagagccgccctggccgagatcaccgagatggtggcccagctgcacggcaccatgatcaagatggagaacttccagaagctgcacgagctgaagaaggacctgatcggcatcgacaacctggtggtgcccggcagagtgagcagcagcggcctgaccatgcactgcgccggcagcagaaaggaggccagcgagggcctgaccttcgagcccttcgaggagagacccctgcagagcaagatgagcagcttccacccccccggcagacagctggagaagcacaacagcgtggtgagcagcgagagcctgtgcagcgaggagatcaagcagagcagcgacctgatcttctgcttcttcagcctgagaggcgacagcctgctgtacctgttcccctaccacatcccccagaagatctag

SEQ ID NO: 18342 - DNA, 555 bp, Artificial Sequence
  Description of Artificial Sequence: Synthetic coding sequence
tgaagcctgaccggcagcccccacctgagcgagctgagcgtgaacagccagggcggcgtggcccccgccaacgtgaccctgagccccaacctgagccccgacaccaagcaggccagccccctgatcagccccctgctgaacgaccaggcctgccccagaaccgacgacgaggacgagggcagaagaaagagattccccaccgacaaggcctacttcatcgccaaggaggtgagcaccaccgagagaacctacctgaaggacctggaggtgatcaccagctggttccagagcaccgtgagcaaggaggacgccatgcccgaggccctgaagagcctgatcttccccaacttcgagcccctgcacaagttccacaccaacttcctgaaggagatcgagcagagactggccctgtgggagggcagaagcaacgcccagatcagagactaccagagaatcggcgacgtgatgctgaagaacatccagggcatgaaggccggcgtgcagtggagagacctgggcagcctgcagccccccccccccagattcaagccctag

SEQ ID NO: 18343 - DNA, 3165 bp, Artificial Sequence
  Description of Artificial Sequence: Synthetic coding sequence
atgggcgagatcgagggcacctacagagtgctgcagaccgccggcatgagactgggcgcccagacccccgtgggcgtgagcaccctggagcccggccagaccctgctgcccagaatgcaggagaagcacctgcacctgagagtgaagctgctggacaacaccatggagatcttcgacatcgagcccaagtgcgacggccaggtgctgctgacccaggtgtggaagagactgaacctggtggagtgcgactacttcggcatggagttccagaacacccagagctactggatctggctggagcccatgaagcccatcatcagacagatcagaagacccaagaacgtggtgctgagactggccgtgaagttcttcccccccgaccccggccagctgcaggaggagtacaccagatacctgttcgccctgcagctgaagagagacctgctggaggagagactgacctgcgccgacaccaccgccgccctgctgaccagccacctgctgcagagcgagatcggcgactacgacgagaccctggacagagagcacctgaaggtgaacgagtacctgcccggccagcagcactgcctggagaagatcctggagttccaccagaagcacgtgggccagacccccgccgagagcgacttccaggtgctggagatcgccagaaagctggagatgtacggcatcagattccacatggccagcgacagagagggcaccaagatccagctggccgtgagccacatgggcgtgctggtgttccagggcaccaccaagatcaacaccttcaactggagcaaggtgagaaagctgagcttcaagagaaagagattcctgatcaagctgcaccccgaggtgcacggcccctaccaggacaccctggagttcctgctgggcagcagagacgagtgcaagaacttctggaagatctgcgtggagtaccacaccttcttcagactgctggaccagcccaagcccaaggccaaggccgtgttcttcagcagaggcagcagcttcagatacagcggcagaacccagaagcagctggtggactacttcaaggacagcggcatgaagagaatcccctacgagagaagacacagcaagacccacaccagcgtgagagccctgaccgccgacctgcccaagcagagcatcagcttccccgagggcctgagaacccccgccagccccagcagcgccaacgccttctacagcctgagccccagcaccctggtgcccagcggcctgcccgagttcaaggacagcagcagcagcctgaccgacccccaggtgagctacgtgaagagccccgccgccgagagaagaagcggcgccgtggccggcggccccgacacccccagcgcccagcccctgggcccccccgccctgcagcccggccccggcctgagcaccaagagcccccagcccagccccagcagcagaaagagccccctgagcctgagccccgccttccaggtgcccctgggccccgccgagcagggcagcagccccctgctgagccccgtgctgagcgacgccggcggcgccggcatggactgcgaggagcccagacacaagagagtgcccgccgacgaggcctacttcatcgtgaaggagatcctggccaccgagagaacctacctgaaggacctggaggtgatcaccgtgtggttcagaagcgccgtggtgaaggaggacgccatgcccgccaccctgatgaccctgctgttcagcaacatcgaccccatctacgagttccacagaggcttcctgagagaggtggagcagagactggccctgtgggagggccccagcaaggcccacaccaagggcagccaccagagaatcggcgacatcctgctgagaaacatgagacagctgaaggagttcaccagctacttccagagacacgacgaggtgctgaccgagctggagaaggccaccaagagatgcaagaagctggaggccgtgtacaaggagttcgagctgcagaaggtgtgctacctgcccctgaacaccttcctgctgaagcccatccagagactgctgcactacagactgctgctgagaagactgtgcggccactacagccccggccaccacgactacgccgactgccacgacgccctgaaggccatcaccgaggtgaccaccaccctgcagcacatcctgatcagactggagaacctgcagaagctgaccgagctgcagagagacctggtgggcatcgagaacctgatcgcccccggcagagagttcatcagagagggctgcctgcacaagctgaccaagaagggcctgcagcagagaatgttcttcctgttcagcgacatgctgctgtacaccagcaagggcgtggccggcaccagccacttcagaatcagaggcctgctgcccctgcagggcatgctggtggaggagagcgacaacgagtggagcgtgccccactgcttcaccatctacgccgcccagaagaccatcgtggtggccgccagcaccagactggagaaggagaagtggatgctggacctgaacagcgccatccaggccgccaagagcggcggcgacaccgcccccgccctgcccggcagaaccgtgtgcaccagaccccccagaagccccaacgaggtgagcctggagcaggagagcgaggacgacgccagaggcgtgagaagcagcctggagggccacggccagcacagagccaacaccaccatgcacgtgtgctggtacagaaacaccagcgtgagcagagccgaccacagcgccgccgtggagaaccagctgagcggctacctgctgagaaagttcaagaacagccacggctggcagaagctgtgggtggtgttcaccaacttctgcctgttcttctacaagacccaccaggacgactaccccctggccagcctgcccctgctgggctacagcgtgagcatccccagagaggccgacggcatccacaaggactacgtgttcaagctgcagttcaagagccacgtgtacttcttcagagccgagagcaagtacaccttcgagagatggatggaggtgatccagggcgccagcagcagcgccggcagagcccccagcatcgtgcaggacggcccccagcccagcagcggcctggagggcatggtgagaggcaaggaggagtag

SEQ ID NO: 18344 - DNA, 1944 bp, Artificial Sequence
  Description of Artificial Sequence: Synthetic coding sequence
atgggcgagatcgagggcacctacagagtgctgcagaccgccggcatgagactgggcgcccagacccccgtgggcgtgagcaccctggagcccggccagaccctgctgcccagaatgcaggagaagcacctgcacctgagagtgaagctgctggacaacaccatggagatcttcgacatcgagcccaagtgcgacggccaggtgctgctgacccaggtgtggaagagactgaacctggtggagtgcgactacttcggcatggagttccagaacacccagagctactggatctggctggagcccatgaagcccatcatcagacagatcagaagacccaagaacgtggtgctgagactggccgtgaagttcttcccccccgaccccggccagctgcaggaggagtacaccagatacctgttcgccctgcagctgaagagagacctgctggaggagagactgacctgcgccgacaccaccgccgccctgctgaccagccacctgctgcagagcgagatcggcgactacgacgagaccctggacagagagcacctgaaggtgaacgagtacctgcccggccagcagcactgcctggagaagatcctggagttccaccagaagcacgtgggccagacccccgccgagagcgacttccaggtgctggagatcgccagaaagctggagatgtacggcatcagattccacatggccagcgacagagagggcaccaagatccagctggccgtgagccacatgggcgtgctggtgttccagggcaccaccaagatcaacaccttcaactggagcaaggtgagaaagctgagcttcaagagaaagagattcctgatcaagctgcaccccgaggtgcacggcccctaccaggacaccctggagttcctgctgggcagcagagacgagtgcaagaacttctggaagatctgcgtggagtaccacaccttcttcagactgctggaccagcccaagcccaaggccaaggccgtgttcttcagcagaggcagcagcttcagatacagcggcagaacccagaagcagctggtggactacttcaaggacagcggcatgaagagaatcccctacgagagaagacacagcaagacccacaccagcgtgagagccctgaccgccgacctgcccaagcagagcatcagcttccccgagggcctgagaacccccgccagccccagcagcgccaacgccttctacagcctgagccccagcaccctggtgcccagcggcctgcccgagttcaaggacagcagcagcagcctgaccgacccccaggtgagctacgtgaagagccccgccgccgagagaagaagcggcgccgtggccggcggccccgacacccccagcgcccagcccctgggcccccccgccctgcagcccggccccggcctgagcaccaagagcccccagcccagccccagcagcagaaagagccccctgagcctgagccccgccttccaggtgcccctgggccccgccgagcagggcagcagccccctgctgagccccgtgctgagcgacgccggcggcgccggcatggactgcgaggagcccagacacaagagagtgcccgccgacgaggcctacttcatcgtgaaggagatcctggccaccgagagaacctacctgaaggacctggaggtgatcaccgtgtggttcagaagcgccgtggtgaaggaggacgccatgcccgccaccctgatgaccctgctgttcagcaacatcgaccccatctacgagttccacagaggcttcctgagagaggtggagcagagactggccctgtgggagggccccagcaaggcccacaccaagggcagccaccagagaatcggcgacatcctgctgagaaacatgagacagctgaaggtgttccagctgcacgagggccacgtggccggcgtgaccaagatggagtag

SEQ ID NO: 18345 - DNA, 171 bp, Artificial Sequence
  Description of Artificial Sequence: Synthetic coding sequence
tgaaagagccacgtgtacttcttcagagccgagagcaagtacaccttcgagagatggatggaggtgatccagggcgccagcagcagcgccggcagagcccccagcatcgtgcaggacggcccccagcccagcagcggcctggagggcatggtgagaggcaaggaggagtag

SEQ ID NO: 18346 - DNA, 405 bp, Artificial Sequence
  Description of Artificial Sequence: Synthetic coding sequence
atgggcgagatcgagggcacctacagagtgctgcagaccgccggcatgagactgggcgcccagacccccgtgggcgtgagcaccctggagcccggccagaccctgctgcccagaatgcaggagaagcacctgcacctgagagtgaagctgctggacaacaccatggagatcttcgacatcgagcccaagtgcgacggccaggtgctgctgacccaggtgtggaagagactgaacctggtggagtgcgactacttcggcatggagttccagaacacccagagctactggatctggctggagcccatgaagcccatcatcagacagatcagaagacccaagaacgtggtgctgagactggccgtgaagttcttcccccccgaccccggccagctgcaggaggagtag

SEQ ID NO: 18347 - DNA, 282 bp, Artificial Sequence
  Description of Artificial Sequence: Synthetic coding sequence
atgggcgagatcgagggcacctacagagtgctgcagaccgccggcatgagactgggcgcccagacccccgtgggcgtgagcaccctggagcccggccagaccctgctgcccagaatgcaggagaagcacctgcacctgagagtgaagctgctggacaacaccatggagatcttcgacatcgagcccaagtgcgacggccaggtgctgctgacccaggtgtggaagagactgaacctggtggagtgcgactacttcggcatggagttccagaacacccagtag

SEQ ID NO: 18348 - DNA, 1917 bp, Artificial Sequence
  Description of Artificial Sequence: Synthetic coding sequence
atgggcgagatcgagggcacctacagagtgctgcagaccgccggcatgagactgggcgcccagacccccgtgggcgtgagcaccctggagcccggccagaccctgctgcccagaatgcaggagaagcacctgcacctgagagtgaagctgctggacaacaccatggagatcttcgacatcgagcccaagtgcgacggccaggtgctgctgacccaggtgtggaagagactgaacctggtggagtgcgactacttcggcatggagttccagaacacccagagctactggatctggctggagcccatgaagcccatcatcagacagatcagaagacccaagaacgtggtgctgagactggccgtgaagttcttcccccccgaccccggccagctgcaggaggagtacaccagatacctgttcgccctgcagctgaagagagacctgctggaggagagactgacctgcgccgacaccaccgccgccctgctgaccagccacctgctgcagagcgagatcggcgactacgacgagaccctggacagagagcacctgaaggtgaacgagtacctgcccggccagcagcactgcctggagaagatcctggagttccaccagaagcacgtgggccagacccccgccgagagcgacttccaggtgctggagatcgccagaaagctggagatgtacggcatcagattccacatggccagcgacagagagggcaccaagatccagctggccgtgagccacatgggcgtgctggtgttccagggcaccaccaagatcaacaccttcaactggagcaaggtgagaaagctgagcttcaagagaaagagattcctgatcaagctgcaccccgaggtgcacggcccctaccaggacaccctggagttcctgctgggcagcagagacgagtgcaagaacttctggaagatctgcgtggagtaccacaccttcttcagactgctggaccagcccaagcccaaggccaaggccgtgttcttcagcagaggcagcagcttcagatacagcggcagaacccagaagcagctggtggactacttcaaggacagcggcatgaagagaatcccctacgagagaagacacagcaagacccacaccagcgtgagagccctgaccgccgacctgcccaagcagagcatcagcttccccgagggcctgagaacccccgccagccccagcagcgccaacgccttctacagcctgagccccagcaccctggtgcccagcggcctgcccgagttcaaggacagcagcagcagcctgaccgacccccaggtgagctacgtgaagagccccgccgccgagagaagaagcggcgccgtggccggcggccccgacacccccagcgcccagcccctgggcccccccgccctgcagcccggccccggcctgagcaccaagagcccccagcccagccccagcagcagaaagagccccctgagcctgagccccgccttccaggtgcccctgggccccgccgagcagggcagcagccccctgctgagccccgtgctgagcgacgccggcggcgccggcatggactgcgaggagcccagacacaagagagtgcccgccgacgaggcctacttcatcgtgaaggagatcctggccaccgagagaacctacctgaaggacctggaggtgatcaccgtgtggttcagaagcgccgtggtgaaggaggacgccatgcccgccaccctgatgaccctgctgttcagcaacatcgaccccatctacgagttccacagaggcttcctgagagaggtggagcagagactggccctgtgggagggccccagcaaggcccacaccaagggcagccaccagagaatcggcgacatcctgctgagaaacatgagacagctgaaggccgcccacgagttcaccacctag

SEQ ID NO: 18349 - DNA, 1155 bp, Artificial Sequence
  Description of Artificial Sequence: Synthetic coding sequence
atggccgcccagaacggcaacaccagcttcacccccaacttcaaccccccccaggaccacgccagcagcctgagcttcaacttcagctacggcgactacgacctgcccatggacgaggacgaggacatgaccaagaccagaaccttcttcgccgccaagatcgtgatcggcatcgccctggccggcatcatgctggtgtgcggcatcggcaacttcgtgttcatcgccgccctgaccagatacaagaagctgagaaacctgaccaacctgctgatcgccaacctggccatcagcgacttcctggtggccatcatctgctgccccttcgagatggactactacgtggtgagacagctgagctgggagcacggccacgtgctgtgcgccagcgtgaactacctgagaaccgtgagcctgtacgtgagcaccaacgccctgctggccatcgccatcgacagatacctggccatcgtgcaccccctgaagcccagaatgaactaccagaccgccagcttcctgatcgccctggtgtggatggtgagcatcctgatcgccatccccagcgcctacttcgccaccgagaccgtgctgttcatcgtgaagagccaggagaagatcttctgcggccagatctggcccgtggaccagcagctgtactacaagagctacttcctgttcatcttcggcgtggagttcgtgggccccgtggtgaccatgaccctgtgctacgccagaatcagcagagagctgtggttcaaggccgtgcccggcttccagaccgagcagatcagaaagagactgagatgcagaagaaagaccgtgctggtgctgatgtgcatcctgaccgcctacgtgctgtgctgggcccccttctacggcttcaccatcgtgagagacttcttccccaccgtgttcgtgaaggagaagcactacctgaccgccttctacgtggtggagtgcatcgccatgagcaacagcatgatcaacaccgtgtgcttcgtgaccgtgaagaacaacaccatgaagtacttcaagaagatgatgctgctgcactggagacccagccagagaggcagcaagagcagcgccgacctggacctgagaaccaacggcgtgcccaccaccgaggaggtggactgcatcagactgaagtag

SEQ ID NO: 18350 - DNA, 1668 bp, Artificial Sequence
  Description of Artificial Sequence: Synthetic coding sequence
atgctgagcagcaccgacttcaccttcgccagctgggagctggtggtgagagtggaccaccccaacgaggagcagcagaaggacgtgaccctgagagtgagcggcgacctgcacgtgggcggcgtgatgctgaagctggtggagcagatcaacatcagccaggactggagcgacttcgccctgtggtgggagcagaagcactgctggctgctgaagacccactggaccctggacaagtacggcgtgcaggccgacgccaagctgctgttcaccccccagcacaagatgctgagactgagactgcccaacctgaagatggtgagactgagagtgagcttcagcgccgtggtgttcaaggccgtgagcgacatctgcaagatcctgaacatcagaagaagcgaggagctgagcctgctgaagcccagcggcgactacttcaagaagaagaagaagaaggacaagaacaacaaggagcccatcatcgaggacatcctgaacctggagagcagccccaccgccagcggcagcagcgtgagccccggcctgtacagcaagaccatgacccccatctacgaccccatcaacggcacccccgccagcagcaccatgacctggttcagcgacagccccctgaccgagcagaactgcagcatcctggccttcagccagcccccccagagccccgaggccctggccgacatgtaccagcccagaagcctggtggacaaggccaagctgaacgccggctggctggacagcagcagaagcctgatggagcagggcatccaggaggacgagcagctgctgctgagattcaagtactacagcttcttcgacctgaaccccaagtacgacgccgtgagaatcaaccagctgtacgagcaggccagatgggccatcctgctggaggagatcgactgcaccgaggaggagatgctgatcttcgccgccctgcagtaccacatcagcaagctgagcctgagcgccgagacccaggacttcgccggcgagagcgaggtggacgagatcgaggccgccctgagcaacctggaggtgaccctggagggcggcaaggccgacagcctgctggaggacatcaccgacatccccaagctggccgacaacctgaagctgttcagacccaagaagctgctgcccaaggccttcaagcagtactggttcatcttcaaggacaccagcatcgcctacttcaagaacaaggagctggagcagggcgagcccctggagaagctgaacctgagaggctgcgaggtggtgcccgacgtgaacgtggccggcagaaagttcggcatcaagctgctgatccccgtggccgacggcatgaacgagatgtacctgagatgcgaccacgagaaccagtacgcccagtggatggccgcctgcatgctggccagcaagggcaagaccatggccgacagcagctaccagcccgaggtgctgaacatcctgagcttcctgagaatgaagaacagaaacagcgccagccaggtggccagcagcctggagaacatggacatgaaccccgagtgcttcgtgagccccagatgcgccaagagacacaagagcaagcagctggccgccagaatcctggaggcccaccacctgcaggcccccttccacagctacagaagcctgagccacctgtag

SEQ ID NO: 18351 - DNA, 441 bp, Artificial Sequence
  Description of Artificial Sequence: Synthetic coding sequence
atgctgagcagcaccgacttcaccttcgccagctgggagctggtggtgagagtggaccaccccaacgaggagcagcagaaggacgtgaccctgagagtgagcggcgacctgcacgtgggcggcgtgatgctgaagctggtggagcagatcaacatcagccaggactggagcgacttcgccctgtggtgggagcagaagcactgctggctgctgaagacccactggaccctggacaagtacggcgtgcaggccgacgccaagctgctgttcaccccccagcacaagatgctgagactgagactgcccaacctgaagatggtgagactgagagtgagcttcagcgccgtggtgttcaaggccgtgagcgacatctgcaagatcctgaacatcagaagaagcgaggagctgagcctgctgaagcccagcggcgactacttctag

SEQ ID NO: 18352 - DNA, 1263 bp, Artificial Sequence
  Description of Artificial Sequence: Synthetic coding sequence
atggagcagggcatccaggaggacgagcagctgctgctgagattcaagtactacagcttcttcgacctgaaccccaagtacgacgccgtgagaatcaaccagctgtacgagcaggccagatgggccatcctgctggaggagatcgactgcaccgaggaggagatgctgatcttcgccgccctgcagtaccacatcagcaagctgagcctgagcgccgagacccaggacttcgccggcgagagcgaggtggacgagatcgaggccgccctgagcaacctggaggtgaccctggagggcggcaaggccgacagcctgctggaggacatcaccgacatccccaagctggccgacaacctgaagctgttcagacccaagaagctgctgcccaaggccttcaagcagtactggttcatcttcaaggacaccagcatcgcctacttcaagaacaaggagctggagcagggcgagcccctggagaagctgaacctgagaggctgcgaggtggtgcccgacgtgaacgtggccggcagaaagttcggcatcaagctgctgatccccgtggccgacggcatgaacgagatgtacctgagatgcgaccacgagaaccagtacgcccagtggatggccgcctgcatgctggccagcaagggcaagaccatggccgacagcagctaccagcccgaggtgctgaacatcctgagcttcctgagaatgaagaacagaaacagcgccagccaggtggccagcagcctggagaacatggacatgaaccccgagtgcttcgtgagccccagatgcgccaagagacacaagagcaagcagctggccgccagaatcctggaggcccaccagaacgtggcccagatgcccctggtggaggccaagctgagattcatccaggcctggcagagcctgcccgagttcggcctgacctactacctggtgagattcaagggcagcaagaaggacgacatcctgggcgtgagctacaacagactgatcaagatcgacgccgccaccggcatccccgtgaccacctggagattcaccaacatcaagcagtggaacgtgaactgggagaccagacaggtggtgatcgagttcgaccagaacgtgttcaccgccttcacctgcctgagcgccgactgcaagatcgtgcacgagtacatcggcggctacatcttcctgagcaccagaagcaaggaccagaacgagaccctggacgaggacctgttccacaagctgaccggcggccaggactag

SEQ ID NO: 18353 - DNA, 552 bp, Artificial Sequence
  Description of Artificial Sequence: Synthetic coding sequence
atggccgccagcatggccagaggcggcgtgagcgccagagtgctgctgcaggccgccagaggcacctggtggaacagacccggcggcaccagcggcagcggcgagggcgtggccctgggcaccaccagaaagttccaggccaccggcagcagacccgccggcgaggaggacgccggcggccccgagagacccggcgacgtggtgaacgtggtgttcgtggacagaagcggccagagaatccccgtgagcggcagagtgggcgacaacgtgctgcacctggcccagagacacggcgtggacctggagggcgcctgcgaggccagcctggcctgcagcacctgccacgtgtacgtgagcgaggaccacctggacctgctgcccccccccgaggagagagaggacgacatgctggacatggcccccctgctgcaggagaacagcagactgggctgccagatcgtgctgacccccgagctggagggcgccgagttcaccctgcccaagatcaccagaaacttctacgtggacggccacgtgcccaagccccactag

SEQ ID NO: 18354 - DNA, 438 bp, Artificial Sequence
  Description of Artificial Sequence: Synthetic coding sequence
atgcacgtgatggccgccagcatggccagaggcggcgtgagcgccagagtgctgctgcaggccgccagaggcacctggtggaacagacccggcggcaccagcggcagcggcgagggcgtggccctgggcaccaccagaaagttccaggccaccggcagcagacccgccggcgaggaggacgccggcggccccgagagacccggcgacgtggtgaacgtggtgttcgtggacagaagcggccagagaatccccgtgagcggcagagtgggcgacaacgtgctgcacctggcccagagacacggcgtggacctggagggcgcctgcgaggccagcctggcctgcagcacctgccacgtgtacgtgagcgaggaccacctggacctgctgcccccccccgaggagagaagaaccagaggctgggccgccagactgtgctag

SEQ ID NO: 18355 - DNA, 552 bp, Artificial Sequence
  Description of Artificial Sequence: Synthetic coding sequence
atggccggcggcccccccaacaccaaggccgagatggagatgagcctggccgaggagctgaaccacggcagacagggcgagaaccaggagcacctggtgatcgccgagatgatggagctgggcagcagaagcagaggcgccagccagaagaagcagaagctggagcagaaggccgccggcagcgccagcgccaagagagtgtggaacatgaccgccaccagacccaagaagatgggcagccagctgcccaagcccagaatgctgagagagagcggccacggcgacgcccacctgcaggagtacgccggcaacttccagggcatcagattccactacgacagaaaccccggcaccgacgccgtggcccagaccagcctggaggagttcaacgtgctggagatggaggtgatgagaagacagctgtacgccgtgaacagaagactgagagccctggaggagcagggcgccacctggagacacagagagaccctgatcatcgccgtgctggtgagcgccagcatcgccaacctgtggctgtggatgaaccagtag

SEQ ID NO: 18356 - DNA, 1527 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgggcagcggcatcatggagctgaccgacaccgagctgatcctgtacaccagaaagagagacagcgtgaagtggcactacctgtgcctgagaagatacggctacgacagcaacctgttcagcttcgagagcggcagaagatgccagaccggccagggcatcttcgccttcaagtgcgccagagccgaggagctgttcaacatgctgcaggagatcatgcagaacaacagcatcaacgtggtggaggagcccgtggtggagagaaacaaccaccagaccgagctggaggtgcccagaacccccagaacccccaccacccccggcttcgccgcccagaacctgcccaacggctaccccagataccccagcttcggcgacgccagcagccaccccagcagcagacaccccagcgtgggcagcgccagactgcccagcgtgggcgaggagagcacccaccccctgctggtggccgaggagcaggtgcacacctacgtgaacaccaccggcgtgcaggaggagagaaagaacagaaccagcgtgcacgtgcccctggaggccagagtgagcaacgccgagagcagcacccccaaggaggagcccagcagcatcgaggacagagacccccagatcctgctggagcccgagggcgtgaagttcgtgctgggccccacccccgtgcagaagcagctgatggagaaggagaagctggagcagctgggcagagaccaggtgagcggcagcggcgccaacaacaccgagtgggacaccggctacgacagcgacgagagaagagacgcccccagcgtgaacaagctggtgtacgagaacatcaacggcctgagcatccccagcgccagcggcgtgagaagaggcagactgaccagcaccagcaccagcgacacccagaacatcaacaacagcgcccagagaagaaccgccctgctgaactacgagaacctgcccagcctgccccccgtgtgggaggccagaaagctgagcagagacgaggacgacaacctgggccccaagacccccagcctgaacggctaccacaacaacctggaccccatgcacaactacgtgaacaccgagaacgtgaccgtgcccgccagcgcccacaagatcgagtacagcagaagaagagactgcacccccaccgtgttcaacttcgacatcagaagacccagcctggagcacagacagctgaactacatccaggtggacctggagggcggcagcgacagcgacaacccccagacccccaagacccccaccacccccctgccccagacccccaccagaagaaccgagctgtacgccgtgatcgacatcgagagaaccgccgccatgagcaacctgcagaaggccctgcccagagacgacggcaccagcagaaagaccagacacaacagcaccgacctgcccatgtag

SEQ ID NO: 18357 - DNA, 1527 bp, Artificial Sequence; identical to SEQ ID NO: 18356
  Description of Artificial Sequence: Synthetic coding sequence

SEQ ID NO: 18358 - DNA, 111 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgggcagcggctag

SEQ ID NO: 18359 - DNA, 123 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgggcagcggcatcatggagctgtag

SEQ ID NO: 18360 - DNA, 102 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgtag

SEQ ID NO: 18361 - DNA, 1527 bp, Artificial Sequence; identical to SEQ ID NO: 18356
  Description of Artificial Sequence: Synthetic coding sequence

SEQ ID NO: 18362 - DNA, 33 bp, Artificial Sequence
  Description of Artificial Sequence: Synthetic coding sequence
atgggcagctgctgcagctgccccgacaagtag

SEQ ID NO: 18363 - DNA, 39 bp, Artificial Sequence
  Description of Artificial Sequence: Synthetic coding sequence
atgggcagctgctgcagctgccccgacaaggacacctag

SEQ ID NO: 18364 - DNA, 1527 bp, Artificial Sequence; identical to SEQ ID NO: 18356
  Description of Artificial Sequence: Synthetic coding sequence

SEQ ID NO: 18365 - DNA, 276 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgggcagcggcatcatggagctgaccgacaccgagctgatcctgtacaccagaaagagagacagcgtgaagtggcactacctgtgcctgagaagatacggctacgacagcaacctgttcagcttcgagagcggcagaagatgccagaccggccagggcatcttcgccttcaagtgctag

SEQ ID NO: 18366 - DNA, 552 bp, Artificial Sequence
  Description of Artificial Sequence: Synthetic coding sequence
atgggcagctgctgcagctgccccgacaaggacaccgtgcccgacaaccacagaaacaagttcaaggtgatcaacgtggacgacgacggcaacgagctgggcagcggcatcatggagctgaccgacaccgagctgatcctgtacaccagaaagagagacagcgtgaagtggcactacctgtgcctgagaagatacggctacgacagcaacctgttcagcttcgagagcggcagaagatgccagaccggccagggcatcttcgccttcaagtgcgccagagccgaggagctgttcaacatgctgcaggagatcatgcagaacaacagcatcaacgtggtggaggagcccgtggtggagagaaacaaccaccagaccgagctggaggtgcccagaacccccagaacccccaccacccccggcttcgccgcccagaacctgcccaacggctaccccagataccccagcttcggcgacgccagcagccaccccagcagcagacaccccagcgtgggcagcgccagactgcccagcgtgggcgaggagagcacctag

SEQ ID NO: 18367 - DNA, 1479 bp, Artificial Sequence
  Description of Artificial Sequence: Synthetic coding sequence
atgggcagctgctgcagctgcctgaacagagacagcgtgcccgacaaccaccccaccaagttcaaggtgaccaacgtggacgacgagggcgtggagctgggcagcggcgtgatggagctgacccagagcgagctggtgctgcacctgcacagaagagaggccgtgagatggccctacctgtgcctgagaagatacggctacgacagcaacctgttcagcttcgagagcggcagaagatgccagaccggccagggcatcttcgccttcaagtgcagcagagccgaggagatcttcaacctgctgcaggacctgatgcagtgcaacagcatcaacgtgatggaggagcccgtgatcatcaccagaaacagccaccccgccgagctggacctgcccagagccccccagccccccaacgccctgggctacaccgtgagcagcttcagcaacggctgccccggcgagggccccagattcagcgcccccagaagactgagcaccagcagcctgagacaccccagcctgggcgaggagagcacccacgccctgatcgcccccgacgagcagagccacacctacgtgaacacccccgccagcgaggacgaccacagaagaggcagacactgcctgcagcccctgcccgagggccaggcccccttcctgccccaggccagaggccccgaccagagagacccccaggtgttcctgcagcccggccaggtgaagttcgtgctgggccccacccccgccagaagacacatggtgaagtgccagggcctgtgccccagcctgcacgaccccccccaccacaacaacaacaacgaggcccccagcgagtgccccgcccagcccaagtgcacctacgagaacgtgaccggcggcctgtggagaggcgccggctggagactgagccccgaggagcccggctggaacggcctggcccacagaagagccgccctgctgcactacgagaacctgccccccctgccccccgtgtgggagagccaggcccagcagctgggcggcgaggccggcgacgacggcgacagcagagacggcctgacccccagcagcaacggcttccccgacggcgaggaggacgagacccccctgcagaagcccaccagcaccagagccgccatcagaagccacggcagcttccccgtgcccctgaccagaagaagaggcagccccagagtgttcaacttcgacttcagaagacccggccccgagccccccagacagctgaactacatccaggtggagctgaagggctggggcggcgacagacccaagggcccccagaaccccagcagcccccaggcccccatgcccaccacccaccccgccagaagcagcgacagctacgccgtgatcgacctgaagaagaccgtggccatgagcaacctgcagagagccctgcccagagacgacggcaccgccagaaagaccagacacaacagcaccgacctgcccctgtag

SEQ ID NO: 18368 - DNA, 1479 bp, Artificial Sequence; identical to SEQ ID NO: 18367
  Description of Artificial Sequence: Synthetic coding sequence

SEQ ID NO: 18369 - DNA, 111 bp, Artificial Sequence
  Description of Artificial Sequence: Synthetic coding sequence
atgggcagctgctgcagctgcctgaacagagacagcgtgcccgacaaccaccccaccaagttcaaggtgaccaacgtggacgacgagggcgtggagctgggcagcggctag

SEQ ID NO: 18370 - DNA, 444 bp, Artificial Sequence
  Description of Artificial Sequence: Synthetic coding sequence
atggagacccccagaagagccagaagccccgtgagcccccagttccccggccaggccggctgcagcgacaccatgggcagctgctgcagctgcctgaacagagacagcgtgcccgacaaccaccccaccaagttcaaggtgaccaacgtggacgacgagggcgtggagctgggcagcggcgtgatggagctgacccagagcgagctggtgctgcacctgcacagaagagaggccgtgagatggccctacctgtgcctgagaagatacggctacgacagcaacctgttcagcttcgagagcggcagaagatgccagaccggccagggcatcttcgccttcaagtgcagcagagccgaggagatcttcaacctgctgcaggacctgatgcagtgcaacagcatcaacgtgatggaggagcccgtgatcatcaccagaaacagctag

SEQ ID NO: 18371 - DNA, 3405 bp, Artificial Sequence
  Description of Artificial Sequence: Synthetic coding sequence
atgatgagccccaacggcagcgtgccccccatctacgtgccccccggctacgccccccaggtgatcgaggacaacggcgtgagaagagtggtggtggtgccccaggcccccgagttccaccccggcagccacaccgtgctgcacagaagcccccacccccccctgcccggcttcatccccgtgcccaccatgatgccccccccccccagacacatgtacagccccgtgaccggcgccggcgacatgaccacccagtacatgccccagtaccagagcagccaggtgtacggcgacgtggacgcccacagcacccacggcagaagcaacttcagagacgagagaagcagcaagacctacgagagactgcagaagaagctgaaggacagacagggcacccagaaggacaagatgagcagcccccccagcagcccccagaagtgccccagccccatcaacgagcacaacggcctgatcaagggccagatcgccggcggcatcaacaccggcagcgccaagatcaagagcggcaagggcaagggcggcacccaggtggacaccgagatcgaggagaaggacgaggagaccaaggccttcgaggccctgctgagcaacatcgtgaagcccgtggccagcgacatccaggccagaaccgtggtgctgacctggagcccccccagcagcctgatcaacggcgagaccgacgagagcagcgtgcccgagctgtacggctacgaggtgctgatcagcagcaccggcaaggacggcaagtacaagagcgtgtacgtgggcgaggagaccaacatcaccctgaacgacctgaagcccgccatggactaccacgccaaggtgcaggccgagtacaacagcatcaagggcacccccagcgaggccgagatcttcaccaccctgagctgcgagcccgacatccccaacccccccagaatcgccaacagaaccaagaacagcctgaccctgcagtggaaggcccccagcgacaacggcagcaagatccagaacttcgtgctggagtgggacgagggcaagggcaacggcgagttctgccagtgctacatgggcagccagaagcagttcaagatcaccaagctgagccccgccatgggctgcaagttcagactgagcgccagaaacgactacggcaccagcggcttcagcgaggaggtgctgtactacaccagcggctgcgcccccagcatgcccgccagccccgtgctgaccaaggccggcatcacctggctgagcctgcagtggagcaagcccagcggcacccccagcgacgagggcatcagctacatcctggagatggaggaggagaccagcggctacggcttcaagcccaagtacgacggcgaggacctggcctacaccgtgaagaacctgagaagaagcaccaagtacaagttcaaggtgatcgcctacaacagcgagggcaagagcaaccccagcgaggtggtggagttcaccacctgccccgacaagcccggcatccccgtgaagcccagcgtgaagggcaagatccacagccacagcttcaagatcacctgggacccccccaaggacaacggcggcgccaccatcaacaagtacgtggtggagatggccgagggcagcaacggcaacaagtgggagatgatctacagcggcgccaccagagagcacctgtgcgacagactgaaccccggctgcttctacagactgagagtgtactgcatcagcgacggcggccagagcgccgtgagcgagagcctgctggtgcagacccccgccgtgccccccggcccctgcctgccccccagactgcagggcagacccaaggccaaggagatccagctgagatggggcccccccctggtggacggcggcagccccatcagctgctacagcgtggagatgagccccatcgagaaggacgagcccagagaggtgtaccagggcagcgaggtggagtgcaccgtgagcagcctgctgcccggcaagacctacagcttcagactgagagccgccaacaagatgggcttcggccccttcagcgagaagtgcgacatcaccaccgcccccggcccccccgaccagtgcaagcccccccaggtgacctgcagaagcgccacctgcgcccaggtgaactgggaggtgcccctgagcaacggcaccgacgtgaccgagtacagactggagtggggcggcgtggagggcagcatgcagatctgctactgcggccccggcctgagctacgagatcaagggcctgagccccgccaccacctactactgcagagtgcaggccctgagcgtggtgggcgccggccccttcagcgaggtggtggcctgcgtgaccccccccagcgtgcccggcatcgtgacctgcctgcaggagatcagcgacgacgagatcgagaacccccactacagccccagcacctgcctggccatcagctgggagaagccctgcgaccacggcagcgagatcctggcctacagcatcgacttcggcgacaagcagagcctgaccgtgggcaaggtgaccagctacatcatcaacaacctgcagcccgacaccacctacagaatcagaatccaggccctgaacagcctgggcgccggccccttcagccacatgatcaagctgaagaccaagcccctgccccccgacccccccagactggagtgcgtggccttcagccaccagaacctgaagctgaagtggggcgagggcacccccaagaccctgagcaccgacagcatccagtaccacctgcagatggaggacaagaacggcagattcgtgagcctgtacagaggcccctgccacacctacaaggtgcagagactgaacgagagcaccagctacaagttctgcatccaggcctgcaacgaggccggcgagggccccctgagccaggagtacatcttcaccacccccaagagcgtgcccgccgccctgaaggcccccaagatcgagaaggtgaacgaccacatctgcgagatcacctgggagtgcctgcagcccatgaagggcgaccccgtgatctacagcctgcaggtgatgctgggcaaggacagcgagttcaagcagatctacaagggccccgacagcagcttcagatacagcagcctgcagctgaactgcgagtacagattcagagtgtgcgccatcagacagtgccaggacagcctgggccaccaggacctggtgggcccctacagcaccaccgtgctgttcatcagccagagaaccgagccccccgccagcaccaacagagacaccgtggagagcaccagaaccagaagagccctgagcgacgagcagtgcgccgccgtgatcctggtgctgttcgccttcttcagcatcctgatcgccttcatcatccagtacttcgtgatcaagtag

SEQ ID NO: 18372 - DNA, 3429 bp, Artificial Sequence
  Description of Artificial Sequence: Synthetic coding sequence
atgagcggccccgcccaggtgcccatgatgagccccaacggcagcgtgccccccatctacgtgccccccggctacgccccccaggtgatcgaggacaacggcgtgagaagagtggtggtggtgccccaggcccccgagttccaccccggcagccacaccgtgctgcacagaagcccccacccccccctgcccggcttcatccccgtgcccaccatgatgccccccccccccagacacatgtacagccccgtgaccggcgccggcgacatgaccacccagtacatgccccagtaccagagcagccaggtgtacggcgacgtggacgcccacagcacccacggcagaagcaacttcagagacgagagaagcagcaagacctacgagagactgcagaagaagctgaaggacagacagggcacccagaaggacaagatgagcagcccccccagcagcccccagaagtgccccagccccatcaacgagcacaacggcctgatcaagggccagatcgccggcggcatcaacaccggcagcgccaagatcaagagcggcaagggcaagggcggcacccaggtggacaccgagatcgaggagaaggacgaggagaccaaggccttcgaggccctgctgagcaacatcgtgaagcccgtggccagcgacatccaggccagaaccgtggtgctgacctggagcccccccagcagcctgatcaacggcgagaccgacgagagcagcgtgcccgagctgtacggctacgaggtgctgatcagcagcaccggcaaggacggcaagtacaagagcgtgtacgtgggcgaggagaccaacatcaccctgaacgacctgaagcccgccatggactaccacgccaaggtgcaggccgagtacaacagcatcaagggcacccccagcgaggccgagatcttcaccaccctgagctgcgagcccgacatccccaacccccccagaatcgccaacagaaccaagaacagcctgaccctgcagtggaaggcccccagcgacaacggcagcaagatccagaacttcgtgctggagtgggacgagggcaagggcaacggcgagttctgccagtgctacatgggcagccagaagcagttcaagatcaccaagctgagccccgccatgggctgcaagttcagactgagcgccagaaacgactacggcaccagcggcttcagcgaggaggtgctgtactacaccagcggctgcgcccccagcatgcccgccagccccgtgctgaccaaggccggcatcacctggctgagcctgcagtggagcaagcccagcggcacccccagcgacgagggcatcagctacatcctggagatggaggaggagaccagcggctacggcttcaagcccaagtacgacggcgaggacctggcctacaccgtgaagaacctgagaagaagcaccaagtacaagttcaaggtgatcgcctacaacagcgagggcaagagcaaccccagcgaggtggtggagttcaccacctgccccgacaagcccggcatccccgtgaagcccagcgtgaagggcaagatccacagccacagcttcaagatcacctgggacccccccaaggacaacggcggcgccaccatcaacaagtacgtggtggagatggccgagggcagcaacggcaacaagtgggagatgatctacagcggcgccaccagagagcacctgtgcgacagactgaaccccggctgcttctacagactgagagtgtactgcatcagcgacggcggccagagcgccgtgagcgagagcctgctggtgcagacccccgccgtgccccccggcccctgcctgccccccagactgcagggcagacccaaggccaaggagatccagctgagatggggcccccccctggtggacggcggcagccccatcagctgctacagcgtggagatgagccccatcgagaaggacgagcccagagaggtgtaccagggcagcgaggtggagtgcaccgtgagcagcctgctgcccggcaagacctacagcttcagactgagagccgccaacaagatgggcttcggccccttcagcgagaagtgcgacatcaccaccgcccccggcccccccgaccagtgcaagcccccccaggtgacctgcagaagcgccacctgcgcccaggtgaactgggaggtgcccctgagcaacggcaccgacgtgaccgagtacagactggagtggggcggcgtggagggcagcatgcagatctgctactgcggccccggcctgagctacgagatcaagggcctgagccccgccaccacctactactgcagagtgcaggccctgagcgtggtgggcgccggccccttcagcgaggtggtggcctgcgtgaccccccccagcgtgcccggcatcgtgacctgcctgcaggagatcagcgacgacgagatcgagaacccccactacagccccagcacctgcctggccatcagctgggagaagccctgcgaccacggcagcgagatcctggcctacagcatcgacttcggcgacaagcagagcctgaccgtgggcaaggtgaccagctacatcatcaacaacctgcagcccgacaccacctacagaatcagaatccaggccctgaacagcctgggcgccggccccttcagccacatgatcaagctgaagaccaagcccctgccccccgacccccccagactggagtgcgtggccttcagccaccagaacctgaagctgaagtggggcgagggcacccccaagaccctgagcaccgacagcatccagtaccacctgcagatggaggacaagaacggcagattcgtgagcctgtacagaggcccctgccacacctacaaggtgcagagactgaacgagagcaccagctacaagttctgcatccaggcctgcaacgaggccggcgagggccccctgagccaggagtacatcttcaccacccccaagagcgtgcccgccgccctgaaggcccccaagatcgagaaggtgaacgaccacatctgcgagatcacctgggagtgcctgcagcccatgaagggcgaccccgtgatctacagcctgcaggtgatgctgggcaaggacagcgagttcaagcagatctacaagggccccgacagcagcttcagatacagcagcctgcagctgaactgcgagtacagattcagagtgtgcgccatcagacagtgccaggacagcctgggccaccaggacctggtgggcccctacagcaccaccgtgctgttcatcagccagagaaccgagccccccgccagcaccaacagagacaccgtggagagcaccagaaccagaagagccctgagcgacgagcagtgcgccgccgtgatcctggtgctgttcgccttcttcagcatcctgatcgccttcatcatccagtacttcgtgatcaagtag

SEQ ID NO: 18373 - DNA, 3597 bp, Artificial Sequence
  Description of Artificial Sequence: Synthetic coding sequence
atggccgagcacccccccctgctggacaccacccagatcctgagcagcgacatcagcctgctgagcgcccccatcgtgagcgccgacggcacccagcaggtgatcctggtgcaggtgaaccccggcgaggccttcaccatcagaagagaggacggccagttccagtgcatcaccggccccgcccaggtgcccatgatgagccccaacggcagcgtgccccccatctacgtgccccccggctacgccccccaggtgatcgaggacaacggcgtgagaagagtggtggtggtgccccaggcccccgagttccaccccggcagccacaccgtgctgcacagaagcccccacccccccctgcccggcttcatccccgtgcccaccatgatgccccccccccccagacacatgtacagccccgtgaccggcgccggcgacatgaccacccagtacatgccccagtaccagagcagccaggtgtacggcgacgtggacgcccacagcacccacggcagaagcaacttcagagacgagagaagcagcaagacctacgagagactgcagaagaagctgaaggacagacagggcacccagaaggacaagatgagcagcccccccagcagcccccagaagtgccccagccccatcaacgagcacaacggcctgatcaagggccagatcgccggcggcatcaacaccggcagcgccaagatcaagagcggcaagggcaagggcggcacccaggtggacaccgagatcgaggagaaggacgaggagaccaaggccttcgaggccctgctgagcaacatcgtgaagcccgtggccagcgacatccaggccagaaccgtggtgctgacctggagcccccccagcagcctgatcaacggcgagaccgacgagagcagcgtgcccgagctgtacggctacgaggtgctgatcagcagcaccggcaaggacggcaagtacaagagcgtgtacgtgggcgaggagaccaacatcaccctgaacgacctgaagcccgccatggactaccacgccaaggtgcaggccgagtacaacagcatcaagggcacccccagcgaggccgagatcttcaccaccctgagctgcgagcccgacatccccaacccccccagaatcgccaacagaaccaagaacagcctgaccctgcagtggaaggcccccagcgacaacggcagcaagatccagaacttcgtgctggagtgggacgagggcaagggcaacggcgagttctgccagtgctacatgggcagccagaagcagttcaagatcaccaagctgagccccgccatgggctgcaagttcagactgagcgccagaaacgactacggcaccagcggcttcagcgaggaggtgctgtactacaccagcggctgcgcccccagcatgcccgccagccccgtgctgaccaaggccggcatcacctggctgagcctgcagtggagcaagcccagcggcacccccagcgacgagggcatcagctacatcctggagatggaggaggagaccagcggctacggcttcaagcccaagtacgacggcgaggacctggcctacaccgtgaagaacctgagaagaagcaccaagtacaagttcaaggtgatcgcctacaacagcgagggcaagagcaaccccagcgaggtggtggagttcaccacctgccccgacaagcccggcatccccgtgaagcccagcgtgaagggcaagatccacagccacagcttcaagatcacctgggacccccccaaggacaacggcggcgccaccatcaacaagtacgtggtggagatggccgagggcagcaacggcaacaagtgggagatgatctacagcggcgccaccagagagcacctgtgcgacagactgaaccccggctgcttctacagactgagagtgtactgcatcagcgacggcggccagagcgccgtgagcgagagcctgctggtgcagacccccgccgtgccccccggcccctgcctgccccccagactgcagggcagacccaaggccaaggagatccagctgagatggggcccccccctggtggacggcggcagccccatcagctgctacagcgtggagatgagccccatcgagaaggacgagcccagagaggtgtaccagggcagcgaggtggagtgcaccgtgagcagcctgctgcccggcaagacctacagcttcagactgagagccgccaacaagatgggcttcggccccttcagcgagaagtgcgacatcaccaccgcccccggcccccccgaccagtgcaagcccccccaggtgacctgcagaagcgccacctgcgcccaggtgaactgggaggtgcccctgagcaacggcaccgacgtgaccgagtacagactggagtggggcggcgtggagggcagcatgcagatctgctactgcggccccggcctgagctacgagatcaagggcctgagccccgccaccacctactactgcagagtgcaggccctgagcgtggtgggcgccggccccttcagcgaggtggtggcctgcgtgaccccccccagcgtgcccggcatcgtgacctgcctgcaggagatcagcgacgacgagatcgagaacccccactacagccccagcacctgcctggccatcagctgggagaagccctgcgaccacggcagcgagatcctggcctacagcatcgacttcggcgacaagcagagcctgaccgtgggcaaggtgaccagctacatcatcaacaacctgcagcccgacaccacctacagaatcagaatccaggccctgaacagcctgggcgccggccccttcagccacatgatcaagctgaagaccaagcccctgccccccgacccccccagactggagtgcgtggccttcagccaccagaacctgaagctgaagtggggcgagggcacccccaagaccctgagcaccgacagcatccagtaccacctgcagatggaggacaagaacggcagattcgtgagcctgtacagaggcccctgccacacctacaaggtgcagagactgaacgagagcaccagctacaagttctgcatccaggcctgcaacgaggccggcgagggccccctgagccaggagtacatcttcaccacccccaagagcgtgcccgccgccctgaaggcccccaagatcgagaaggtgaacgaccacatctgcgagatcacctgggagtgcctgcagcccatgaagggcgaccccgtgatctacagcctgcaggtgatgctgggcaaggacagcgagttcaagcagatctacaagggccccgacagcagcttcagatacagcagcctgcagctgaactgcgagtacagattcagagtgtgcgccatcagacagtgccaggacagcctgggccaccaggacctggtgggcccctacagcaccaccgtgctgttcatcagccagagaaccgagccccccgccagcaccaacagagacaccgtggagagcaccagaaccagaagagccctgagcgacgagcagtgcgccgccgtgatcctggtgctgttcgccttcttcagcatcctgatcgccttcatcatccagtacttcgtgatcaagtag

SEQ ID NO: 18374 - DNA, 3597 bp, Artificial Sequence; identical to SEQ ID NO: 18373
  Description of Artificial Sequence: Synthetic coding sequence

SEQ ID NO: 18375 - DNA, 2055 bp, Artificial Sequence
  Description of Artificial Sequence: Synthetic coding sequence
atggccgagcacccccccctgctggacaccacccagatcctgagcagcgacatcagcctgctgagcgcccccatcgtgagcgccgacggcacccagcaggtgatcctggtgcaggtgaaccccggcgaggccttcaccatcagaagagaggacggccagttccagtgcatcaccggccccgcccaggtgcccatgatgagccccaacggcagcgtgccccccatctacgtgccccccggctacgccccccaggtgatcgaggacaacggcgtgagaagagtggtggtggtgccccaggcccccgagttccaccccggcagccacaccgtgctgcacagaagcccccacccccccctgcccggcttcatccccgtgcccaccatgatgccccccccccccagacacatgtacagccccgtgaccggcgccggcgacatgaccacccagtacatgccccagtaccagagcagccaggtgtacggcgacgtggacgcccacagcacccacggcagaagcaacttcagagacgagagaagcagcaagacctacgagagactgcagaagaagctgaaggacagacagggcacccagaaggacaagatgagcagcccccccagcagcccccagaagtgccccagccccatcaacgagcacaacggcctgatcaagggccagatcgccggcggcatcaacaccggcagcgccaagatcaagagcggcaagggcaagggcggcacccaggtggacaccgagatcgaggagaaggacgaggagaccaaggccttcgaggccctgctgagcaacatcgtgaagcccgtggccagcgacatccaggccagaaccgtggtgctgacctggagcccccccagcagcctgatcaacggcgagaccgacgagagcagcgtgcccgagctgtacggctacgaggtgctgatcagcagcaccggcaaggacggcaagtacaagagcgtgtacgtgggcgaggagaccaacatcaccctgaacgacctgaagcccgccatggactaccacgccaaggtgcaggccgagtacaacagcatcaagggcacccccagcgaggccgagatcttcaccaccctgagctgcgagcccgacatccccaacccccccagaatcgccaacagaaccaagaacagcctgaccctgcagtggaaggcccccagcgacaacggcagcaagatccagaacttcgtgctggagtgggacgagggcaagggcaacggcgagttctgccagtgctacatgggcagccagaagcagttcaagatcaccaagctgagccccgccatgggctgcaagttcagactgagcgccagaaacgactacggcaccagcggcttcagcgaggaggtgctgtactacaccagcggctgcgcccccagcatgcccgccagccccgtgctgaccaaggccggcatcacctggctgagcctgcagtggagcaagcccagcggcacccccagcgacgagggcatcagctacatcctggagatggaggaggagaccagcggctacggcttcaagcccaagtacgacggcgaggacctggcctacaccgtgaagaacctgagaagaagcaccaagtacaagttcaaggtgatcgcctacaacagcgagggcaagagcaaccccagcgaggtggtggagttcaccacctgccccgacaagcccggcatccccgtgaagcccagcgtgaagggcaagatccacagccacagcttcaagatcacctgggacccccccaaggacaacggcggcgccaccatcaacaagtacgtggtggagatggccgagggcagcaacggcaacaagtgggagatgatctacagcggcgccaccagagagcacctgtgcgacagactgaaccccggctgcttctacagactgagagtgtactgcatcagcgacggcggccagagcgccgtgagcgagagcctgctggtgcagacccccgccgtgccccccggcccctgcctgccccccagactgcagggcagacccaaggccaaggagatccagacccccagcggctag

SEQ ID NO: 18376 - DNA, 675 bp, Artificial Sequence
  Description of Artificial Sequence: Synthetic coding sequence
atgaacatcgaggtgggcaacatcagctacaccggcgccatcatcagctggagcagcagcgagccctgcctggaggactactaccacatcatgtacagacccaactggaacagcatcttcagcggctacctgagatacagcttccaccacgaggagaaggtgcccagaaccatcagcagcgtggtgctggagcacctggcccccagcaccctgtacttcctgtgcatcagctgcaagaaggccgccttcccctacagacactactgcaccatgttccacaccctggacaagagccccctggcccccggcagcagcctggtggacccccagatcagcctgtgggtgctgatggccatcctgctggcctgcttcaccgccgtgctggccttcatctgcctgcagttctggtgcgtgagatgccacgagcccagatggagctacagagccggccacatggaggaggccaacggcctggtgagatggcccgaggaggcccccgacctgggccagagagaggaggacctgcagggcctgcccctggtggagatgcccagaaagaacagcagagacggcgccgagctggaccccgaggccaaccaggacgcccccgacgccggcgccctgcagagaggcggcggcgacccccccgccatcctgccccactgcggcgagtag

SEQ ID NO: 18377 - DNA, 543 bp, Artificial Sequence
  Description of Artificial Sequence: Synthetic coding sequence
atgaacatcgaggtgggcaacatcagctacaccggcgccatcatcagctggagcagcagcgagccctgcctggaggactactaccacatcatgtacagacccaactggaacagcatcttcagcggctacctgagatacagcttccaccacgaggagaaggtgcccagaaccatcagcagcgtggtgctggagcacctggcccccagcaccctgtacttcctgtgcatcagctgcaagaaggccgccttcccctacagacactactgcaccatgttccacaccctggacaagagccccctggcccccggcagcagcctggtggacccccagatcagcctgtgggtgctgatggccatcctgctggcctgcttcaccgccgtgctggccttcatctgcctgcagttctggtgcgtgagatgccacgagcccagatggagctacagagccggccacatggaggaggccaacggcctggtgagatggcccgaggaggcccccgacctgggccagagagaggaggacctgcagggcctgcccctgtag

SEQ ID NO: 18378 - DNA, 10401 bp, Artificial Sequence
  Description of Artificial Sequence: Synthetic coding sequence
atggagctgtacctgggcgcctgcagcaagcccgccaaggtggccgtgaccaagaccgtggccagcgtgctggccgccgacacccagcagtgcagagacggcgtgcacaagacccacttcgccggcgtgggccccgcccagctgctggacctgcccctgggcgtgaagctgcccgtgatccccggcagcaacgccgtgttctacaccaccaacttcggcgagaagctgttcagacccagctacggcttcaacctgaccgacccctactgcagactgctggagaaccagtacaagagcctgcacgacccccacctgaaggcctactacaagagaaaggacatcctgaagagactgaagaagggcggctacatcaccagcaacaacaaggtggtgtgcaccctgagagagctgaacaagtacagacagtacctgaccagcctgaagctggacttcgagagaaactacatcaaggagcagagaatcctggccaagcagctgcacaacatccccgagaacaaccagatcccccagcactgcgacgtggcccaggtgcagaactggctgctgaaggagggcaccgagagcatcaaggaccaggagagactgatgagacacagatacctggacatgatcagcagaaagctggagcagctggagagaaccgccgaggagcagagactgttcctgatggacagagaggagagaagacagagagagcacaccagaagaaagctgaccctgagaagaaagatcgaggaggagtggaagaccaaggagatgctgctgctgaccagaatggccgaggacgtgaagagagaggagagaatcgaggagcagcagcacagaaacagagaggagagcgacagaaagaagcaggacctgctggagaagaagatggcctaccacctgcagaagatgcaggacaccggcttcaacggcgaggacatcggcaagaacaccttcaagtacagaggccaggacggcacccacgccagccccaagaacaagaagaagaccagcgaggacatcatgctggtgtaccccgccggcgaccagaacacctacaaggagacccacggccacaccgccaacgccgcccaccagagacagaacagcagcaacaacttcaccaagaagaacagcgccagcgtggtgtaccaggccgacgtgcaggacaacggcatcaaccagaagagagacggcatggtgagcaagaacagcagcatcttcgacgacagaggcggcatcaacatcagcggccagggcagcatcatcagcgcccaggtgagccccaccagaaacttcagcagagtgagccaggccttcctggaccccagcaaggaggagaaggagaccaacgccgactgggacggcagacccaccaagagaagcagctacctgtgcgagagcggcccccaggcccacgccaccgaccccggcatcttcagcagccccgtgtacaccaacatgcagcagaacctgctgcagaactgcctgcaggagaaggtgaccagcgaggagctgaacatcatcatccagaacgtgatgacctgggtggtggccaccgtgaccagcatcctgtaccccgccatcaccaagtacgagaagagactgcagaacaacacctaccccgtgagcgacgacagcatcctgagcagcgacagcagcagcttctgcagcacctgcagcgaggacttcacctacagaagctacaccagcgccaccaccaagaccttccaggccgagccctgcgccttcgtggtggacaccagcgtgagaagacccaccacccccatcaagcccccccccgcccacgtggagaagaccgtggtgggcaagacctgccacatcaagggccagagcatcatcagcaagcacaagtacaacaagaccaacctgctgtacagctaccccaagctgagaagctgcaagagcgacagccacctgctggccagcttcgagaccggcaccaagaagagcaaggacgccaccaccgagaccgacagcctgggcagcagcctgcactgcgacaagaccgccaaggccatggacgagatgaagaacctgaagaacgtgttcgtgaacttcaagtgctacctgaagggcgagaccgaggtgatcctggagagcatcctgagagagatcatgagcgacctgacccaggccatccccagcctgagcagcgtgaccgccgaggtgttcgtggagcagtgcgagagagagaaggagatcctgctgagcaacgcccacatccccagcgtggccagcgagatcgtggagaacatgctggagaagctggagagcgccgtggagaagaagtgcgtggagatgttcagccaggacctgagcgtggacatcaagcccagcctggccgccagcgacgagctgctgaccagcagcaacggcaagcccctgaagaacagcatgccccacaccctggaccccatgtgcgacatcgccgaggacatggtgcacgccatcctggagaagctgatgaccctggtgagcttcaagcagaacgagttcctgcacctgaaggacaccaacaagctgagctgccagcagcacaagaccgaccccatctgcatgttcctgcagagagccggcaagaacaagagcagcctggagagcgacgaggccagcctgatcgtgaacgaggaggtgcagaacctgatcagcaacatcttcagccagagcagcctggtggcctacatcgaggaggccatcaacgccatcctgggctacatccagaccgagctgaacaacgagagaatcatcgccagcgaggagaccgtggtgctgctgcagctgctggaggacatcctgttccagctgcaccaggagcccgtgaacgagagcttccagaagagcagacagcccagaatcagcagccccagcgacaccaaggagaagtacagactgaccggcaccagactgagcaacagccccagaagcggcagacccttcccccccatcaacgtgcccggcatggtgctgtacagcgacgacgagaacgaggagatcgacaacatcgtgaagaacgtgctggacagcaccttcaaggacgagaaggtgaagagccaggagcagatccccaaccactggttcaccaagggcaacacctgcttcgagtgcaagagaaacatcaagccccccaccaagcccggcagcagaagcaaggccgccttccacgactgggagctgaagaccgagccccccagcaccaaccacgaggacatcctgaagaagaagctgagcagcaacaaggacatcagcaccttcagccaggaccagaagcaccagatcgagaaggccagcgagaacatcgtgaccagcatcctgaaggagatgctgaaggacatcagcagcgtgcccttcggccacctggacagcaagaccggcagcgaggccagcgtgctggtgagcgagaagccccagggcctgagccaccaggagtggatcgaccagatgttcagcgtgagcgagatcagcaccgtggcccaggagatcaccgacagcgtgctgaacatcctgcacaaggccagcaactacatcagcaacaccaccaagagcagcatcagcagcagcgtgcaccagatcagcctgcacaacagcgacaccgagcacatcgtgaaggaggcccccaacaagtaccccctgaagacctggttcgacagcgagaagaagatgaagtacctgagcctgttcgacgtggaccccgagaagcccccctggctgaagagcggcaagagcgagcccaagcccgtggacgacatcaacgacaagatcatcagaaccatcttcaagagactgaagagcttcatctgccccaagctgcacatgggcttcaagagcagcctgagaagccagctgagcaagtacaccgccaagatcgtgaacatcgtgctgtgcgccatccagaacgagctggagctgcacaaggagaacctgaacctgagagagatcgaccacaccaagagcctgaccgacaagggcttcttcgccaacaccgacaagaagctggagagcctggtgaccagcatcgacgacgacatcctggccagccccctgctgacctgcatctacgacatgctgctgagcagcgagaacgcccaccagagaagcatcagcctgagcagcagaaagcccaagagcgccaccgacagcgtggacgtgcagagcatcctgcccaacagacaggacaagaagagcttccacaagtacctggccaccccctgcacccaccacagcgtgaacggcggcaaccacatcaaggagaacgccaagctgcaggtgctggagagaatcggcgagaccctgcacgagatgctgagcaagctgctgggcacccacctgcacagccagctgagctgcagccagcagagcagagagatgaccaacaagaaccagaagatggccgccgccctgcagagcaacatccagctgatcagcaaggccatcctggactacatcctggccaagctgtgcggcgtggacatggacaccagcttcgccagctgcggcctgaaggccatcagcgagagcctggacatcgacaaccccagcttcgccagcatcatcgagaagatggccaagagcaccaagatcatcagcagcatcgtgagcagaagagtgcaggaggacaacaaggaggagaccaagagcaaggccaagcccgtggcccccgtgagcagcaagacccccagcaccaaggagatgcaccccaacaagctgaaggccgtggccagcgacatcctgaacatggtgttcgccaagctggagggcttcgccaacggccacctggagatcctgggcgccatcaacgacggcaacaagaagagcaacaagatcggctgggagtacgagagcaccaacatcagcagagacacccacgaggccagcttcctgagcgccctgtacatgcacgccaagaaggtgagcagcgccatcctgaaggtgatccagaccgagctgaacgtgaccagcagcgacctgaagaccagcgtggagaaccccccccccgagacccagatcctgaagtacgtggtgaagctgatcctggacgccgtgagcagcgacatgttcaacgagatggagagcgagggcggcggcatcgagacctacagatacagacccacctacggcagcctgcccggcggcgccgagagcgacagcttcctggaggacgacgcctacaccgccaagaagatcatcgacgagagaagcccccagagagaggaggtgaagaccagaagcctgaagcagtgggccctggagaagaccctgaacaagatcgaggtgaagctgaaggagccccacatcagccccatcgcccccatcatcagaaacatcctgaacgagatcttccagagcaccctgatcaaccagctgaacgtgctgagcctgagccacagcaacttcaacggcatgccccacaacgtggacgagcccaccccccagaccagcgtgcagttcatggacaagatgatggaccccctgctgagcgaggccgacatcaccatcgtgaccgacaacatcgtgagaaccgtgttccacaagctgtacagcgccgccatgaccgagagaaacgtgagagagaacagatacaagaccatcaccttcagcgccaacgtgagcagccacgagcacacctacaagggcaagagcagcgtgaccgccctggacgagaacccctgcaccttccagagcagattcagcgtggccgacaaggagaccaaggtgaacctggccgaggacatcgtgcaggccatcctgaccaacctggagaccttcgccaccagcaaggtgaagagcctgttctacagccaggtgaacttcaccgtgcccgtggccctgcccatccagcaggaccacagcaccctgagcaaggccctgagcgccaaggacagctacagcgacgagcagttcagctgctgcagcgtggaccacaccaagagcggcaagaccaacctgtgccagctgagcctgagcaagctgaacacctacgccctgcaggtggccagaagaaacctgcagggcatcaagcaggagctggacaaggagagagagaaccccttcctgacccacgacatcggcatcagcgagagcatcgccagccagatcgtgaacgccctgctggacatcatcagcagaaagggcaagtgcgacaagaacagcagcgacaaggagatcgacctggaccagcagaagggcgtgatcgagaagctgctgaacgagaccaagtacagaaaggtgctgcagctgcagatccaggacaccatcgagggcatcctgtgcgacatctacgagaagaccctgttccagaacaacctgagcttcgccacccccaccctgaagtgcagcatcgccgacaagcacagcgaggagaacagcgagatgttcatggagggcgccaacaagatcatccccaagctgagcgtgcccaagagcgacgtgatcctgatcagcaacgacatcgtgaacatcgtgctgcacaacctgagcagcgccgccaccctggtgatcaacgccaagaaccccaccagcgccagactgcccctgaccttctgcgacaccttccccaagatcgactgccagcagcccctgaagggcagcaagaccgagagaaagaccgagagattcagctacagcagaaaccagaagagcgcctacgccgacgacaaccagatcaccgtggtggagaaggaggacacccagaagagcgccaccgacagctgcgaggagaacgccaacttcatcaccaagaccatcttcaagagactggagagcttcgccaccgagagaatcgacagcctgatcaccctggccttccagagcaaggagaagagcttcgtgatccccgagctggagaactgcaagcagaacgacagcatcttctacgacagcagccaggtggagagcgacgtgaacgtgctgaagatcagcgccaccgagaccatcctgagccaggagctgaccgacttcaccttcgtgggcagaagagagaagctgggcagcaccatccacctgagccaggccagactgaagacctacgccgacgtgatcgccagcgccatcctgaagctgatcaagaacgacctggacctggagatccagaagatctacccctaccagaacaacatcctgttccaggagaacatcatcgtgagcgagatcgtggacagcatgctgaagatgctggacgacaagagaagcgtgaaggagatctgcttcaacagcaaggagaacagcaacttcagccagctggccctgagcaacgagatcctgctgggccacaaggagaaggagagaagcaccaagcagagcctgttcaccaagtaccccctggagcagaaccagatgatcctggagaacaagagacagatcatcgtgctggaggagatcttcatgagaaacggcgagagcaagaacaaggagaagggcgagctgctgatcgccgtggaggagctgctgaacaagctgtaccagagagtgagagaggtgaccggccacctgccccccctgaacgagaccgccaacttcatcagcaacagcaagatcaagaccagcgacaccacccagaagaacagcttccagagccacatcaacagcgtggccaacgacatcgtggagagcgtgctgggcaagatgtacctggtggtggtgaccagcctgtacgagaacaacaagagcagaaccgaggtggagatcagcgaccacaacgacagcctgctgatgaagcccctgagattcagagagaccaagcaggccggcaagatcagcaacagccccagatacgccatcagccaggcctacagctacgtggacagccagaacatcagcgtgatggagaacaccctgctgccctacctgcccctgcaggtgaagaaggacctgatccagatggtgctgaacaagatcaccaacttcgtgagcctgcccctgaaggtgagccccaaggacaaccccaagccctgcttcaaggcccacctgaagaccagaagcaagatcaccaccctgcccaagttcaccaagaagacccacctgggcctgagcgccgccaaggccaagagcaagaccaagctgggccccggcgagaagaccctgaaggacagcagaagcaagaccgccatcggcctgagccacatcatgagcgccggcgacgccaagaacctgctggacaccaagctgcccaccagcgagctgaagatctacgccaaggacatcatcatcaacatcctggagaccatcgtgaaggagttcggcaaggtgaagcagaccaaggccctgcccagcgaccagatcatcgccgccggcaagatcgtgaacaccgtgctgcaggagctgtacgtgaccaacaactgcaacctggcctaccccatgaagagcagccacctgagactgagccagggcaacatcggcaccggcagcctgcccaagcagcaggcctgcttctacctggagaacgtgagcagccagctggagcacatcttccccagagagggcatcttcaagaagctgttcgacaagtggcagaccgagagcaacgacaaggagaacgagaagtgcaagctgctgatgatcgccgagaacgtgctgaccgagatcagcatcaaggccaaggagctggagtacagcctgagcctgctgaacctgccccccctggagaactgcgagagcagattctacaaccacttcaagggcgccagcaccagagccgaggacaccaaggcccagatcaacatgttcggcagagagatcgtggagatgctgctggagaagctgcagctgtgcttcctgagccagatccccacccccgacagcgaggagaccctgagcaacagcaaggagcacatcaccgccaagagcaagtacggcttccccaacaagcacagcctgagcagcctgcccatctacaacaccaagaccaaggaccagatcagcgtgggcagcagcaaccagatcgtgcaggagatcgtggagaccgtgctgaacatgctggagagcttcgtggacctgcagttcaagcacatcagcaagtacgagttcagcgagatcgtgaagatgcccatcgagaacctgagcagcatccagcagaagctgctgaacaagaagatgctgcccaagctgcagcccctgaagatgttcagcgacaagagcgagagcaacaccatcaacttcaaggagaacatccagaacatcctgctgagagtgcacagcttccacagccagctgctgacctacgccgtgaacatcatcagcgacatgctggccgtgatcaagaacaagctggacaacgagatcagccagatggagcccagcagcatcagcatcctgaaggagaacatcgtggccagcgagatcatcggcaccctgatggaccagtgcacctacttcaacgagagcctgatccagaacctgagcagagagagcctgttccagggcgccgagaacgcctacaccgtgaaccaggtggagctggccaccaacatgaagatgttcaccagcaagctgaaggagggcagcctgggcatcaaccccagccaggtgagcaagaccggcttcgtgttctgcagcgacgaggacatgaaggagaagtacagagtgagcagcgacctgcccaccagcgtgagaagcagcgtggaggacaccgtgaagaacagcgagcccaccaagagacccgacagcgagaccatgcccagctgcagcaccagaaacaaggtgcaggaccacagacccagagagagcaacttcggcagcttcgaccagaccatgaagggcaacagctacctgcccgagggcagcttcctgcagaagctgctgagaaaggccagcgacagcaccgaggccgccctgaagcaggtgctgagcttcatcgagatgggcaagggcgagaacctgagagtgttccactacgagaacctgaagcccgtggtggagcccaaccagatccagaccaccatcagccccctgaagatctgcctggccgccgagaacatcgtgaacaccgtgctgagcagctgcggcttccccagccagccccacaccaacgagaacagagagatcatgaagcccttcttcatcagcaagcagagcagcctgagcgaggtgagcggcggccagaaggacaacgagaagagcctgctgagaatgcaggacaagaagatcaactacatccccgaggaggagaacgagaacctggaggccagcagagaggacagcagcttcctgcagaagctgaagaagaaggagtaccccaagatcgagaccgtgaaggaggtggaggccttcaccttcgccgaccacgagatgggcagcaacgaggtgcacctgatcgccagacacgtgaccaccagcgtggtgacctacctgaagaacttcgagaccaccggcaagtgctag

SEQ ID NO: 18379 - DNA, 20991 bp, Artificial Sequence
  Description of Artificial Sequence: Synthetic coding sequence
atgaagttccagctgtggagcagccagatcagacccctgggccccatcttccccgccctgagagccctgtacgccctggccagagccgccccccaggaggccaccgccctgctgggccccctgcccctggaggcctggaacgccggcggcggcgccgaggtggtgggcctgtggcccttcctggtgagaagcggccagagagacaacggcgtgctggagaaggagagcggcgccggcgaggagggcgccgagggcgccgtgcccgccatggagctgtacctgggcgcctgcagcaagcccgccaaggtggccgtgaccaagaccgtggccagcgtgctggccgccgacacccagcagtgcagagacggcgtgcacaagacccacttcgccggcgtgggccccgcccagctgctggacctgcccctgggcgtgaagctgcccgtgatccccggcagcaacgccgtgttctacaccaccaacttcggcgagaagctgttcagacccagctacggcttcaacctgaccgacccctactgcagactgctggagaaccagtacaagagcctgcacgacccccacctgaaggcctactacaagagaaaggacatcctgaagagactgaagaagggcggctacatcaccagcaacaacaaggtggtgtgcaccctgagagagctgaacaagtacagacagtacctgaccagcctgaagctggacttcgagagaaactacatcaaggagcagagaatcctggccaagcagctgcacaacatccccgagaacaaccagatcccccagcactgcgacgtggcccaggtgcagaactggctgctgaaggagggcaccgagagcatcaaggaccaggagagactgatgagacacagatacctggacatgatcagcagaaagctggagcagctggagagaaccgccgaggagcagagactgttcctgatggacagagaggagagaagacagagagagcacaccagaagaaagctgaccctgagaagaaagatcgaggaggagtggaagaccaaggagatgctgctgctgaccagaatggccgaggacgtgaagagagaggagagaatcgaggagcagcagcacagaaacagagaggagagcgacagaaagaagcaggacctgctggagaagaagatggcctaccacctgcagaagatgcaggacaccggcttcaacggcgaggacatcggcaagaacaccttcaagtacagaggccaggacggcacccacgccagccccaagaacaagaagaagaccagcgaggacatcatgctggtgtaccccgccggcgaccagaacacctacaaggagacccacggccacaccgccaacgccgcccaccagagacagaacagcagcaacaacttcaccaagaagaacagcgccagcgtggtgtaccaggccgacgtgcaggacaacggcatcaaccagaagagagacggcatggtgagcaagaacagcagcatcttcgacgacagaggcggcatcaacatcagcggccagggcagcatcatcagcgcccaggtgagccccaccagaaacttcagcagagtgagccaggccttcctggaccccagcaaggaggagaaggagaccaacgccgactgggacggcagacccaccaagagaagcagctacctgtgcgagagcggcccccaggcccacgccaccgaccccggcatcttcagcagccccgtgtacaccaacatgcagcagaacctgctgcagaactgcctgcaggagaaggtgaccagcgaggagctgaacatcatcatccagaacgtgatgacctgggtggtggccaccgtgaccagcatcctgtaccccgccatcaccaagtacgagaagagactgcagaacaacacctaccccgtgagcgacgacagcatcctgagcagcgacagcagcagcttctgcagcacctgcagcgaggacttcacctacagaagctacaccagcgccaccaccaagaccttccaggccgagccctgcgccttcgtggtggacaccagcgtgagaagacccaccacccccatcaagcccccccccgcccacgtggagaagaccgtggtgggcaagacctgccacatcaagggccagagcatcatcagcaagcacaagtacaacaagaccaacctgctgtacagctaccccaagctgagaagctgcaagagcgacagccacctgctggccagcttcgagaccggcaccaagaagagcaaggacgccaccaccgagaccgacagcctgggcagcagcctgcactgcgacaagaccgccaaggccatggacgagatgaagaacctgaagaacgtgttcgtgaacttcaagtgctacctgaagggcgagaccgaggtgatcctggagagcatcctgagagagatcatgagcgacctgacccaggccatccccagcctgagcagcgtgaccgccgaggtgttcgtggagcagtgcgagagagagaaggagatcctgctgagcaacgcccacatccccagcgtggccagcgagatcgtggagaacatgctggagaagctggagagcgccgtggagaagaagtgcgtggagatgttcagccaggacctgagcgtggacatcaagcccagcctggccgccagcgacgagctgctgaccagcagcaacggcaagcccctgaagaacagcatgccccacaccctggaccccatgtgcgacatcgccgaggacatggtgcacgccatcctggagaagctgatgaccctggtgagcttcaagcagaacgagttcctgcacctgaaggacaccaacaagctgagctgccagcagcacaagaccgaccccatctgcatgttcctgcagagagccggcaagaacaagagcagcctggagagcgacgaggccagcctgatcgtgaacgaggaggtgcagaacctgatcagcaacatcttcagccagagcagcctggtggcctacatcgaggaggccatcaacgccatcctgggctacatccagaccgagctgaacaacgagagaatcatcgccagcgaggagaccgtggtgctgctgcagctgctggaggacatcctgttccagctgcaccaggagcccgtgaacgagagcttccagaagagcagacagcccagaatcagcagccccagcgacaccaaggagaagtacagactgaccggcaccagactgagcaacagccccagaagcggcagacccttcccccccatcaacgtgcccggcatggtgctgtacagcgacgacgagaacgaggagatcgacaacatcgtgaagaacgtgctggacagcaccttcaaggacgagaaggtgaagagccaggagcagatccccaaccactggttcaccaagggcaacacctgcttcgagtgcaagagaaacatcaagccccccaccaagcccggcagcagaagcaaggccgccttccacgactgggagctgaagaccgagccccccagcaccaaccacgaggacatcctgaagaagaagctgagcagcaacaaggacatcagcaccttcagccaggaccagaagcaccagatcgagaaggccagcgagaacatcgtgaccagcatcctgaaggagatgctgaaggacatcagcagcgtgcccttcggccacctggacagcaagaccggcagcgaggccagcgtgctggtgagcgagaagccccagggcctgagccaccaggagtggatcgaccagatgttcagcgtgagcgagatcagcaccgtggcccaggagatcaccgacagcgtgctgaacatcctgcacaaggccagcaactacatcagcaacaccaccaagagcagcatcagcagcagcgtgcaccagatcagcctgcacaacagcgacaccgagcacatcgtgaaggaggcccccaacaagtaccccctgaagacctggttcgacagcgagaagaagatgaagtacctgagcctgttcgacgtggaccccgagaagcccccctggctgaagagcggcaagagcgagcccaagcccgtggacgacatcaacgacaagatcatcagaaccatcttcaagagactgaagagcttcatctgccccaagctgcacatgggcttcaagagcagcctgagaagccagctgagcaagtacaccgccaagatcgtgaacatcgtgctgtgcgccatccagaacgagctggagctgcacaaggagaacctgaacctgagagagatcgaccacaccaagagcctgaccgacaagggcttcttcgccaacaccgacaagaagctggagagcctggtgaccagcatcgacgacgacatcctggccagccccctgctgacctgcatctacgacatgctgctgagcagcgagaacgcccaccagagaagcatcagcctgagcagcagaaagcccaagagcgccaccgacagcgtggacgtgcagagcatcctgcccaacagacaggacaagaagagcttccacaagtacctggccaccccctgcacccaccacagcgtgaacggcggcaaccacatcaaggagaacgccaagctgcaggtgctggagagaatcggcgagaccctgcacgagatgctgagcaagctgctgggcacccacctgcacagccagctgagctgcagccagcagagcagagagatgaccaacaagaaccagaagatggccgccgccctgcagagcaacatccagctgatcagcaaggccatcctggactacatcctggccaagctgtgcggcgtggacatggacaccagcttcgccagctgcggcctgaaggccatcagcgagagcctggacatcgacaaccccagcttcgccagcatcatcgagaagatggccaagagcaccaagatcatcagcagcatcgtgagcagaagagtgcaggaggacaacaaggaggagaccaagagcaaggccaagcccgtggcccccgtgagcagcaagacccccagcaccaaggagatgcaccccaacaagctgaaggccgtggccagcgacatcctgaacatggtgttcgccaagctggagggcttcgccaacggccacctggagatcctgggcgccatcaacgacggcaacaagaagagcaacaagatcggctgggagtacgagagcaccaacatcagcagagacacccacgaggccagcttcctgagcgccctgtacatgcacgccaagaaggtgagcagcgccatcctgaaggtgatccagaccgagctgaacgtgaccagcagcgacctgaagaccagcgtggagaaccccccccccgagacccagatcctgaagtacgtggtgaagctgatcctggacgccgtgagcagcgacatgttcaacgagatggagagcgagggcggcggcatcgagacctacagatacagacccacctacggcagcctgcccggcggcgccgagagcgacagcttcctggaggacgacgcctacaccgccaagaagatcatcgacgagagaagcccccagagagaggaggtgaagaccagaagcctgaagcagtgggccctggagaagaccctgaacaagatcgaggtgaagctgaaggagccccacatcagccccatcgcccccatcatcagaaacatcctgaacgagatcttccagagcaccctgatcaaccagctgaacgtgctgagcctgagccacagcaacttcaacggcatgccccacaacgtggacgagcccaccccccagaccagcgtgcagttcatggacaagatgatggaccccctgctgagcgaggccgacatcaccatcgtgaccgacaacatcgtgagaaccgtgttccacaagctgtacagcgccgccatgaccgagagaaacgtgagagagaacagatacaagaccatcaccttcagcgccaacgtgagcagccacgagcacacctacaagggcaagagcagcgtgaccgccctggacgagaacccctgcaccttccagagcagattcagcgtggccgacaaggagaccaaggtgaacctggccgaggacatcgtgcaggccatcctgaccaacctggagaccttcgccaccagcaaggtgaagagcctgttctacagccaggtgaacttcaccgtgcccgtggccctgcccatccagcaggaccacagcaccctgagcaaggccctgagcgccaaggacagctacagcgacgagcagttcagctgctgcagcgtggaccacaccaagagcggcaagaccaacctgtgccagctgagcctgagcaagctgaacacctacgccctgcaggtggccagaagaaacctgcagggcatcaagcaggagctggacaaggagagagagaaccccttcctgacccacgacatcggcatcagcgagagcatcgccagccagatcgtgaacgccctgctggacatcatcagcagaaagggcaagtgcgacaagaacagcagcgacaaggagatcgacctggaccagcagaagggcgtgatcgagaagctgctgaacgagaccaagtacagaaaggtgctgcagctgcagatccaggacaccatcgagggcatcctgtgcgacatctacgagaagaccctgttccagaacaacctgagcttcgccacccccaccctgaagtgcagcatcgccgacaagcacagcgaggagaacagcgagatgttcatggagggcgccaacaagatcatccccaagctgagcgtgcccaagagcgacgtgatcctgatcagcaacgacatcgtgaacatcgtgctgcacaacctgagcagcgccgccaccctggtgatcaacgccaagaaccccaccagcgccagactgcccctgaccttctgcgacaccttccccaagatcgactgccagcagcccctgaagggcagcaagaccgagagaaagaccgagagattcagctacagcagaaaccagaagagcgcctacgccgacgacaaccagatcaccgtggtggagaaggaggacacccagaagagcgccaccgacagctgcgaggagaacgccaacttcatcaccaagaccatcttcaagagactggagagcttcgccaccgagagaatcgacagcctgatcaccctggccttccagagcaaggagaagagcttcgtgatccccgagctggagaactgcaagcagaacgacagcatcttctacgacagcagccaggtggagagcgacgtgaacgtgctgaagatcagcgccaccgagaccatcctgagccaggagctgaccgacttcaccttcgtgggcagaagagagaagctgggcagcaccatccacctgagccaggccagactgaagacctacgccgacgtgatcgccagcgccatcctgaagctgatcaagaacgacctggacctggagatccagaagatctacccctaccagaacaacatcctgttccaggagaacatcatcgtgagcgagatcgtggacagcatgctgaagatgctggacgacaagagaagcgtgaaggagatctgcttcaacagcaaggagaacagcaacttcagccagctggccctgagcaacgagatcctgctgggccacaaggagaaggagagaagcaccaagcagagcctgttcaccaagtaccccctggagcagaaccagatgatcctggagaacaagagacagatcatcgtgctggaggagatcttcatgagaaacggcgagagcaagaacaaggagaagggcgagctgctgatcgccgtggaggagctgctgaacaagctgtaccagagagtgagagaggtgaccggccacctgccccccctgaacgagaccgccaacttcatcagcaacagcaagatcaagaccagcgacaccacccagaagaacagcttccagagccacatcaacagcgtggccaacgacatcgtggagagcgtgctgggcaagatgtacctggtggtggtgaccagcctgtacgagaacaacaagagcagaaccgaggtggagatcagcgaccacaacgacagcctgctgatgaagcccctgagattcagagagaccaagcaggccggcaagatcagcaacagccccagatacgccatcagccaggcctacagctacgtggacagccagaacatcagcgtgatggagaacaccctgctgccctacctgcccctgcaggtgaagaaggacctgatccagatggtgctgaacaagatcaccaacttcgtgagcctgcccctgaaggtgagccccaaggacaaccccaagccctgcttcaaggcccacctgaagaccagaagcaagatcaccaccctgcccaagttcaccaagaagacccacctgggcctgagcgccgccaaggccaagagcaagaccaagctgggccccggcgagaagaccctgaaggacagcagaagcaagaccgccatcggcctgagccacatcatgagcgccggcgacgccaagaacctgctggacaccaagctgcccaccagcgagctgaagatctacgccaaggacatcatcatcaacatcctggagaccatcgtgaaggagttcggcaaggtgaagcagaccaaggccctgcccagcgaccagatcatcgccgccggcaagatcgtgaacaccgtgctgcaggagctgtacgtgaccaacaactgcaacctggcctaccccatgaagagcagccacctgagactgagccagggcaacatcggcaccggcagcctgcccaagcagcaggcctgcttctacctggagaacgtgagcagccagctggagcacatcttccccagagagggcatcttcaagaagctgttcgacaagtggcagaccgagagcaacgacaaggagaacgagaagtgcaagctgctgatgatcgccgagaacgtgctgaccgagatcagcatcaaggccaaggagctggagtacagcctgagcctgctgaacctgccccccctggagaactgcgagagcagattctacaaccacttcaagggcgccagcaccagagccgaggacaccaaggcccagatcaacatgttcggcagagagatcgtggagatgctgctggagaagctgcagctgtgcttcctgagccagatccccacccccgacagcgaggagaccctgagcaacagcaaggagcacatcaccgccaagagcaagtacggcttccccaacaagcacagcctgagcagcctgcccatctacaacaccaagaccaaggaccagatcagcgtgggcagcagcaaccagatcgtgcaggagatcgtggagaccgtgctgaacatgctggagagcttcgtggacctgcagttcaagcacatcagcaagtacgagttcagcgagatcgtgaagatgcccatcgagaacctgagcagcatccagcagaagctgctgaacaagaagatgctgcccaagctgcagcccctgaagatgttcagcgacaagagcgagagcaacaccatcaacttcaaggagaacatccagaacatcctgctgagagtgcacagcttccacagccagctgctgacctacgccgtgaacatcatcagcgacatgctggccgtgatcaagaacaagctggacaacgagatcagccagatggagcccagcagcatcagcatcctgaaggagaacatcgtggccagcgagatcatcggcaccctgatggaccagtgcacctacttcaacgagagcctgatccagaacctgagcagagagagcctgttccagggcgccgagaacgcctacaccgtgaaccaggtggagctggccaccaacatgaagatgttcaccagcaagctgaaggagggcagcctgggcatcaaccccagccaggtgagcaagaccggcttcgtgttctgcagcgacgaggacatgaaggagaagtacagagtgagcagcgacctgcccaccagcgtgagaagcagcgtggaggacaccgtgaagaacagcgagcccaccaagagacccgacagcgagaccatgcccagctgcagcaccagaaacaaggtgcaggaccacagacccagagagagcaacttcggcagcttcgaccagaccatgaagggcaacagctacctgcccgagggcagcttcctgcagaagctgctgagaaaggccagcgacagcaccgaggccgccctgaagcaggtgctgagcttcatcgagatgggcaagggcgagaacctgagagtgttccactacgagaacctgaagcccgtggtggagcccaaccagatccagaccaccatcagccccctgaagatctgcctggccgccgagaacatcgtgaacaccgtgctgagcagctgcggcttccccagccagccccacaccaacgagaacagagagatcatgaagcccttcttcatcagcaagcagagcagcctgagcgaggtgagcggcggccagaaggacaacgagaagagcctgctgagaatgcaggacaagaagatcaactacatccccgaggaggagaacgagaacctggaggccagcagagaggacagcagcttcctgcagaagctgaagaagaaggagtaccccaagatcgagaccgtgaaggaggtggaggccttcaccttcgccgaccacgagatgggcagcaacgaggtgcacctgatcgccagacacgtgaccaccagcgtggtgacctacctgaagaacttcgagaccaccgtgttcagcgaggagaagatgagcgtgagcacctggagcagaaagaagtacgagagcaagcagttcctgagaaacatctacgacgacagcagcatctaccagtgctgcgagcacctgaccgagagcgtgctgtaccacctgaccagcagcatcagcgacggcaccaagaagggcagagagaaggagaaggcctgggagatccaggaggccaccttcagcaagatcatcagcatccacagccaggtgttcgagagcagaagcatcagcatcggcgagctggccctgtgcatcagcgagatcatcatcaagatcctgttcaacaacaagatcatccaggccgacatcgcccagaagatggtggccatccccaccaagtacacctactgccccggcatcgtgagcggcggcttcgacgacctgttccaggacctgctggtgggcgtgatccacgtgctgagcaaggagatcgaggtggactaccacttcgagagcaacgtgagaaacaagagcttcagcatgcacagaaacaacagcgtgcccctgtgcaacaagatcaacagacaggccagccccagagactggcagttcagcacccagcagatcggccagctgttccagaagaacaagctgagctacctggcctgcaagctgaacagcctggtgggcaacctgaagaccagcgagagcaaggaggtggtgaacaaggtgttcaacatcgtgagcgacctgttcagccccgacgagtgcctggacaccggcatggacagcggcaagatccagagaacctacttctacagcagcaacaacgagcagcccaacagcatcctgaccaacaacctgcagctgagcagcaagagcgtgttcctgctgaacgtggtgtgcgagaagctgatcagaatcctgctggaggagtgcaccagcaccgccttccccgacaagggcagcgtgagcgaggagaccagcgccgaggagtgccagctgctgaagatgctgcagagcgtggaggacggcaagagcgactacagaaagggcggcatggactgcgagtgcctgcaggtggactacatgagcgacctgctggagaacgtggccgagatcgaccaggacctgctgaccagcgacagcatgctgaccatcatcagccacagcctggtgaagagcctgatggacaagctgagccacagcatccagcaggcccccgagagcctgcccttcgccaacaagcacctgaactacagaaccagagagatccagagcagcttcatcaaggccagaaagagcgagctgatcgagctgggccagagcaagagcagcctggagctgagaagctacgacagcaacagcctgaccgtgagcctgaacaaccccagcgtggtgagcagcaagatccaggcccccttcaacaagcactgcgccgtgaagagcagcagcgtgagccccttcgagagacagagaaccaaggagatggacaaggtggccatccacaacaagctgcaccaggagggcatctacgccggcgtgtacagcgccaccttcctggagggcatcatcagcgagctgttcttcaacctgagcatgagcctgtggggcaagaacaagaacatcaccgtgagctggctgaacgagatgaacaccctgttcgtgaacaacgtggtgaacgagttcaacaacgcccaggtgaccgtgctgagaaacgccgaggagagactgtgcttcccccccgtgcacaccgagaccgtgagcaagatcgtggacagcgtgtactacgacgtgctgcagcagtacgagctgaaggtggcctgcggcaacaaccccgtgtacgacaacgccagcatcgccgagcagatcaccaacggcatcctgctggagatcctggactacaagctgcccagctgcttcaaggagcacctgatcccccacagctactaccccctgaagcccgagatcatcctgcagaagctgcagagcaacctgaccgagttcaccagcctgcccagaagcagcagcgactacagcaccatgctgagccacagcttcctggaggacgtgatcagaagactgctgagccagctgatccccccccccatcacctgcagcagcctgggcaagaagtacctgatgagcagcgacttcaacgagatgagcacctgcatcatcaacaaggtgatgagcgccatcagcaagcacaagatctggttcaccatctacgacaaccagtacctgtacaccggcaagaacctgcagaagatggtggacagcgtgtactgcaacatcctgcagatgagcgacagcctggtgagcatccagaagagcatcgtgagcagaagccccatcatgatcgaccagatcgccagcttcatcatccaggagatcatcgagaaccacctgcagcccttcctgagcggcgaggtgctgtgccaccccagaacccccctggaccccgtgagcaccatcgtgacccaggtgctgagcgaggtgatcgagagccacagaccccagaagcagagccccctggacatccacctggacagcttcgtgagagagatcgtggccagactgctgagcaagatcttcagccccaagcacaacaccgagatcgagctgaagaacatgacccagagaatcgtgaacagcatcaacagacacttcaacaaggccaagatccacatcctgtacgacgacaaggagcaggccttcttcagcttcaacaccgacatcgtggacgagctggccaccagcgtgtacagaaacgccctgaagcagcacggcctggacctggccgtggacaaggagagcgaggacagcggcatcttcgtggagaacatcaccaacctgatcgtggccgccatcagcgactacctgctgcaccccctgttcagcggcgacttcagcgccagcacctacagcaacagcgtggccgagaacatcgtgcaggacatcctgagcaacatcagcaagagcaccgagcccagccagagcgtgcccctgtacaacaccctgctgccctacaccttcctggaggacatgatcagagtgctgctgagcaagctgttcagcagcgccagcagcctggtgctgaacagagacacccagaaggacatcagcagagtgaacttcaacgacatcgccagcaacctggtgagcgacatcagaatgaaggtgagccagcacgagatcagattcagcaaggaggaggaggagaccaagttcatctacagcgaggacgacatccagcacctggtggacagcgtgttcgccaacgtggtgcagaccagcggcagccaggagagcgccgtgcagaacatcaccagcagcaacgacatcctgatcgacagaatcgccggcttcatcatcaagcacatctgccagaagcacctgcagcccttcgtgagcggcaagagcctgagcagcagcgacacctacttcgacgacgagagaagacagctgttctacaccagcgtgtacagcagcaccttcctggaggacgtgatcagcggcgtgctgagaaagatcttccacagagtggtgggcatcgtgcagaccaagagcatcagagacagcgaggacgagctgttcgagaaggccgaggagctgatccacctgatcaccggcgagttcagcaaggcccaggtgagcatcatcgacaacaccgaggagagactgtgcctgccccccgtggagagagacgtggtgaagaccatcgtggacatggtgtacagcaaggtgctgcaggagtacgagatggaggtggtgcccaacaaggacttcctgaacgacaccaagaccctggccgccagaatcaccaacatcatcctggccgagatcttcgacttccagatccaccccgacctgatcgccaacctgcccttcaagagccacagcaagctgagcgccaacgtgctgatccagagagtgcagtacgacatcagcaagagcagattccagagacaggccagcaccatgtacaccaccatgctgagccacagccacctggagaagatcgtgacccagctgaccagccagatcagccccctgaacaccagcgccgagcagagcgacaccaccaagagcgacctgagcaacaccgtgatcaagctgatcaacgagatcatgagcatcatcagcaagcacgagatctgcatcatcaagtacggcaacaagaagcagagcatgatcagcgccaaggacatccagagcatggtggacagcatctacgccgacctgagccacagcaacatctaccagagcatcaccaaggacaagaagagcatcagcgacatccccgtgagcaagatcgccagcttcatcatcaaggagatcttcaaccaccacatccagagcttcctgagcgaggacaagaccctgctgctggccgccgtggaccagacctacaagctgaaggccatcgaccccaagcagagagagctgagcttcatcgtgaacagcagcgtgttcctggaggaggtgatcagcgagctgctgtgcaagatcctgtacgccttcagccacaacatgctggtgaccgagaaccccgacagagtgaagctgaagctgaccagaatcgtgaccaccctggtgaacagcatcgtgctggagttcaccaccagcgagatcctggtggccgacaacttcgacaagaacctgtgcttcagcgagagatacaaggagatggtgcagaagatcgtgaacagcgtgtacggcaaggtgctggaccagtacaagagcctgatccagatccacagagtgatccagagcgacaccatctgcttcggcagaaagatctactacctgctgctggaggagatctacgactaccaggtgcagagcctggtgagcggcgagctggagagcagcagctacagctacccccaggccgacaacatcatcagaaacgtgctgaacatcatcaccaaggacagccacgccctgcccccctacatcaccgtgctgccccacagcctgctggaggacatggtgtacagactgctgggccacgtgttccccagcacccacaccgagaacgagctgaaggagaagaagttcccccccgacgacgagttcgtggaggccgccagcaagctgaccgacgagatcatcaaggagatcagcgagcacgagatcagactgagcatggccgaggacaacgccgagagcatgcagctggagcccatcgagaacctggtggacagcatctgcaacaacatcctgaagaccagcgagttccaggccgaggtgcagaaggacgccgacaagaagggctgcagcttcctgagcaagctggccggcttcatcatgaaggagatcatgtaccaccacctgcagcccttcctgcacggcgaggagagcagcttcagcgacctgagcgactacgaccacgtgagcgagctggccaagagcggcaaggagaagacccagcccagcctgtacagcgccaccttcctggaggacatcatcatcgacctggtgcacaagttctgcagcctgctgatcatcaccgaggacagcaagaagaacgagatggccgagctggacatcatgggcctggccctgaagctggccaacagcctgatcagagagttcaagaagagcgacatcaaggtgctgcccaacgccgagaagatgttcagcttcccccccatcgacaaggagaccgtggacaagatcagcaacttcgtgtacgagcagttcatcgagaagtgcaccagccacgacatccagaagggcgacgagagcaacatcgccatcggcatgatcgccgccctgacccagaaggccatcagcgccttcagaatccagcccctgttcagcggcgactggagcagcaccttcttcagcttcctgaaccccgacaacatcacccagagagtgcagcacctgccccagaacaccttcacccagatcagcagatgcgccaaggagaaccagctgagcctgcccgaccagagctacaaggacaccagcagcacccccgactgcaagaacatgatgagcaccctggagatcaacagaggcaccatgaacagaaagaagagcttcaagaccaaggacaccagcgtgaagaagggcgacatccagaaccccgtgctgagcagcatcaacgccatcatgaagagcggcatgatcaacctgaccagcggcctggccaccggcgtgaccaacaagaaggaggtggacgagaacaaggtgggcatctgcacccagaagcacagcgagaacgtgagcaaggtgaccagcaccaccaccgtgaagagcaaggacacccaggagcccaacctgagcgagaccttcaacaacaacgagatcgagaagaagagaaacctgatccccaccgacaagaagggcaaggacgacgagatctacacccacttcagcctgatcatcgacgacaccgagtacgagaaggaggtgctgggcagcgacagcgagatcggctacaagaagaagatcgacaacgccagagagagcagcttcaagaaggacgacaagctgttccagctgagcagcctgaagagcaagagaaacctgggcaccaccaccgacaccctggagatcagaatcagaaccagcagcaacgagggcagaagagacagccccacccagacctgcagagacgaggagcaccacagcgactacgagcacgtgcagaacgtgatcgagaacatcttcgaggacgtgctggagctgagcagcagccccgagcccgcctactacagcaagctgagctacgaccagagcccccccggcgacaacgtgctgaacgtgatccaggagatcagcagagacagcgcccagagcgtgaccaccaagaaggtgagcagcagcaccaacaagaacatcagcgccaaggagaaggaggaggaggagagagagaaggagaaggtgagagaggagatcaagagcgagcccagcaagcccgacgacccccagaaccagagagagagcaagcccggcatcttccccgccaagttcctggaggacgtgatcaccgagatggtgaagcagctgatcttcagcagcatccccgagacccagatccaggacagatgccagaacgtgagcgacaagcagaaccaggccaagctgtacgacaccgccatgaagctgatcaacagcctgctgaaggagttcagcgacgcccagatcaaggtgttcagacccgacaagggcaaccagttccccggcggcaaggtgagcagcgtgcccaaggtgccccccagatacaaggagcccaccaccgacgaggcccccagcagcatcaagatcaagagcgccgacaagatgccccccatgcacaagatgatgagaaagcccagcagcgacaagatccccagcatcgacaagaccctggtgaacaaggtggtgcacagcagcgtgtgcaacatcctgaacgactacggcagccaggacagcatctggaagaacatcaacagcaacggcgagaacctggccagaagactgaccagcgccgtgatcaacgagatcttccagagacaggtgaacctgatcttctgcgacgaggtgagcgtgagcgcctgcctgcccctggagagcaaggacgtggtgaagaaggtgcagaagctggcccagaccgccagcaaggagtgccagaccagcagcccctacaccatcatcctgccccacaagttcctggagaacgtgatcagcgccctgttcagcaagatcttcagcaccatcagcagcaccaagaccaaggagcccgaggacaacctgagcaccgagctgaacttcctgcagatgaagctggtgagcgccgtggccaccgagatcagccaggacaagtacatgaccatccagtacgtggagaccctgcagagcgacgacgacgagatcatccagctggtggtgcagagcgtgtacaacaacctgctgccccagttcggcagccaggagatcatccagaactgcgtgaccagcggctgcaagatcctgagcgagaacatcgtggacctggtgctgagagaggtggccagcaaccagctgcagagctacttctgcggcgagctgaccccccaccagtgcgtggaggtggagaacatcgtggagaagatcctgaaggacgtgttccagaccaccgacgtgcccctgcccaagcccagccacgccgacaagctgagctacaacatcatcgaggagatcgccgtgaagttcctgagcaagctgctgagcatcttccccaaggtgcacaaggagagaaccaagagcctggagaccgacatgcagaagatcaccagcaaggtgctgaacagcgtgcaggagttcatcagcaagagcaagatcaagctggtgccccccaccaaggagagccccaccgtgcccgtggccgacaacgccaccatcgagaacatcgtgaacagcatctacaccagcgtgctgaagcacagcggcagctacaccagcgtgttcaaggacctgatgggcaagagcaacgtgctgagcgacaccatcggcttcctgatggtgaacgccatcagcaacagcgagttccagccccaggtggaggaggaggtgagcaacagcgagctggtgctggaggccgtgaagatcatggagaaggtgatcaagatcatcgacgagctgaagagcaaggagaagagcagcagcagaaagggcctgaccctggacgccaagctgctggaggaggtgctggccctgttcctggccaagctgatcagactgcccagcagcagcagcaaggacgagaagaacctgagcaagaccgagctgaacaagatcgccagccagctgagcaagctggtgaccgccgagatcagcagaagcagcatcagcctgatcgccagcgaccccgaggagcactgcctgaaccccgagaacaccgagagaatctaccaggtggtggacagcgtgtacagcaacatcctgcagcagagcggcaccaacaaggagttctactacgacatcaaggacaccaacaccgccttccccaagaaggtggccagcctgatcatcgacggcgtgagcagcttccccctggacaccatcaacagcaccatcagcaacgccgacctgagcggcgagctggacgtgaacagaatcgtgcagaaggcccaggagcacgccttcaacgtgatccccgagctggagcaggagaagctggaccagaacctgagcgaggaggagagccccatcaagatcgtgccccacgtgggcaagaagcccgtgaagatcgaccccaagatcatcagcgagcacctggccgtgatcagcatcaagacccagcccctggagaagctgaagcaggagtgcctgaagagaaccggccacagcatcgccgagctgagaagagccagcatcagcggcagaaactacagcctgggcagccccgacctggagaagagaaagaccgagagaagaaccagcctggacaagaccggcagactggacgtgaagcccctggaggccgtggccagaaacagcttccagaacatcagaaagcccgacatcaccaaggtggagctgctgaaggacgtgcagagcaagaacgacctgatcgtgagactggtggcccacgacatcgaccaggtgtacctggagaactacatcaaggaggagagagacagcgacgaggacgaggtggtgctgacccagaccttcgccaaggaggagggcatcaaggtgttcgaggaccaggtgaaggaggtgaagaagcccatccagagcaagctgagccccaagagcaccctgagcaccagcagcctgaagaagttcctgagcctgagcaagtgctgccagaccaccgccagcgccaacatcgagagcaccgaggccatcagcaaccaggtgatcgagagcaaggagacccacgtgaagagagccgtggccgagctggacatggccacccccaagaccatgcccgagaccgccagcagcagctgggaggagaagccccagtgcaagaaggaggagaagaacctggtgaccgagcccacccactacttcatccacagaatcatgagcagcagcagctacaaccaggaggacctgatcagcagcaccggcgaggccgaggactgccacagcgaccccagcgccaagatcctggaggagagcagccaggagcagaagcccgagcacggcaacagcgtgaagttcatcaccatcttcgagagaagcaaggacgtgctgggcagcgccaaccccagcaaggaggtgatcagcgagacccccaagcccgacgtgagcaagcagggcagcaagatgctgaccaagatgagcagcaccctgagcaaggtgttcagccagtgcaacaccaacatcagcagaagcagcagccccgcccaccaggacgagcactag

SEQ ID NO: 18380 - DNA, 20724 bp, Artificial Sequence
  Description of Artificial Sequence: Synthetic coding sequence
atggagctgtacctgggcgcctgcagcaagcccgccaaggtggccgtgaccaagaccgtggccagcgtgctggccgccgacacccagcagtgcagagacggcgtgcacaagacccacttcgccggcgtgggccccgcccagctgctggacctgcccctgggcgtgaagctgcccgtgatccccggcagcaacgccgtgttctacaccaccaacttcggcgagaagctgttcagacccagctacggcttcaacctgaccgacccctactgcagactgctggagaaccagtacaagagcctgcacgacccccacctgaaggcctactacaagagaaaggacatcctgaagagactgaagaagggcggctacatcaccagcaacaacaaggtggtgtgcaccctgagagagctgaacaagtacagacagtacctgaccagcctgaagctggacttcgagagaaactacatcaaggagcagagaatcctggccaagcagctgcacaacatccccgagaacaaccagatcccccagcactgcgacgtggcccaggtgcagaactggctgctgaaggagggcaccgagagcatcaaggaccaggagagactgatgagacacagatacctggacatgatcagcagaaagctggagcagctggagagaaccgccgaggagcagagactgttcctgatggacagagaggagagaagacagagagagcacaccagaagaaagctgaccctgagaagaaagatcgaggaggagtggaagaccaaggagatgctgctgctgaccagaatggccgaggacgtgaagagagaggagagaatcgaggagcagcagcacagaaacagagaggagagcgacagaaagaagcaggacctgctggagaagaagatggcctaccacctgcagaagatgcaggacaccggcttcaacggcgaggacatcggcaagaacaccttcaagtacagaggccaggacggcacccacgccagccccaagaacaagaagaagaccagcgaggacatcatgctggtgtaccccgccggcgaccagaacacctacaaggagacccacggccacaccgccaacgccgcccaccagagacagaacagcagcaacaacttcaccaagaagaacagcgccagcgtggtgtaccaggccgacgtgcaggacaacggcatcaaccagaagagagacggcatggtgagcaagaacagcagcatcttcgacgacagaggcggcatcaacatcagcggccagggcagcatcatcagcgcccaggtgagccccaccagaaacttcagcagagtgagccaggccttcctggaccccagcaaggaggagaaggagaccaacgccgactgggacggcagacccaccaagagaagcagctacctgtgcgagagcggcccccaggcccacgccaccgaccccggcatcttcagcagccccgtgtacaccaacatgcagcagaacctgctgcagaactgcctgcaggagaaggtgaccagcgaggagctgaacatcatcatccagaacgtgatgacctgggtggtggccaccgtgaccagcatcctgtaccccgccatcaccaagtacgagaagagactgcagaacaacacctaccccgtgagcgacgacagcatcctgagcagcgacagcagcagcttctgcagcacctgcagcgaggacttcacctacagaagctacaccagcgccaccaccaagaccttccaggccgagccctgcgccttcgtggtggacaccagcgtgagaagacccaccacccccatcaagcccccccccgcccacgtggagaagaccgtggtgggcaagacctgccacatcaagggccagagcatcatcagcaagcacaagtacaacaagaccaacctgctgtacagctaccccaagctgagaagctgcaagagcgacagccacctgctggccagcttcgagaccggcaccaagaagagcaaggacgccaccaccgagaccgacagcctgggcagcagcctgcactgcgacaagaccgccaaggccatggacgagatgaagaacctgaagaacgtgttcgtgaacttcaagtgctacctgaagggcgagaccgaggtgatcctggagagcatcctgagagagatcatgagcgacctgacccaggccatccccagcctgagcagcgtgaccgccgaggtgttcgtggagcagtgcgagagagagaaggagatcctgctgagcaacgcccacatccccagcgtggccagcgagatcgtggagaacatgctggagaagctggagagcgccgtggagaagaagtgcgtggagatgttcagccaggacctgagcgtggacatcaagcccagcctggccgccagcgacgagctgctgaccagcagcaacggcaagcccctgaagaacagcatgccccacaccctggaccccatgtgcgacatcgccgaggacatggtgcacgccatcctggagaagctgatgaccctggtgagcttcaagcagaacgagttcctgcacctgaaggacaccaacaagctgagctgccagcagcacaagaccgaccccatctgcatgttcctgcagagagccggcaagaacaagagcagcctggagagcgacgaggccagcctgatcgtgaacgaggaggtgcagaacctgatcagcaacatcttcagccagagcagcctggtggcctacatcgaggaggccatcaacgccatcctgggctacatccagaccgagctgaacaacgagagaatcatcgccagcgaggagaccgtggtgctgctgcagctgctggaggacatcctgttccagctgcaccaggagcccgtgaacgagagcttccagaagagcagacagcccagaatcagcagccccagcgacaccaaggagaagtacagactgaccggcaccagactgagcaacagccccagaagcggcagacccttcccccccatcaacgtgcccggcatggtgctgtacagcgacgacgagaacgaggagatcgacaacatcgtgaagaacgtgctggacagcaccttcaaggacgagaaggtgaagagccaggagcagatccccaaccactggttcaccaagggcaacacctgcttcgagtgcaagagaaacatcaagccccccaccaagcccggcagcagaagcaaggccgccttccacgactgggagctgaagaccgagccccccagcaccaaccacgaggacatcctgaagaagaagctgagcagcaacaaggacatcagcaccttcagccaggaccagaagcaccagatcgagaaggccagcgagaacatcgtgaccagcatcctgaaggagatgctgaaggacatcagcagcgtgcccttcggccacctggacagcaagaccggcagcgaggccagcgtgctggtgagcgagaagccccagggcctgagccaccaggagtggatcgaccagatgttcagcgtgagcgagatcagcaccgtggcccaggagatcaccgacagcgtgctgaacatcctgcacaaggccagcaactacatcagcaacaccaccaagagcagcatcagcagcagcgtgcaccagatcagcctgcacaacagcgacaccgagcacatcgtgaaggaggcccccaacaagtaccccctgaagacctggttcgacagcgagaagaagatgaagtacctgagcctgttcgacgtggaccccgagaagcccccctggctgaagagcggcaagagcgagcccaagcccgtggacgacatcaacgacaagatcatcagaaccatcttcaagagactgaagagcttcatctgccccaagctgcacatgggcttcaagagcagcctgagaagccagctgagcaagtacaccgccaagatcgtgaacatcgtgctgtgcgccatccagaacgagctggagctgcacaaggagaacctgaacctgagagagatcgaccacaccaagagcctgaccgacaagggcttcttcgccaacaccgacaagaagctggagagcctggtgaccagcatcgacgacgacatcctggccagccccctgctgacctgcatctacgacatgctgctgagcagcgagaacgcccaccagagaagcatcagcctgagcagcagaaagcccaagagcgccaccgacagcgtggacgtgcagagcatcctgcccaacagacaggacaagaagagcttccacaagtacctggccaccccctgcacccaccacagcgtgaacggcggcaaccacatcaaggagaacgccaagctgcaggtgctggagagaatcggcgagaccctgcacgagatgctgagcaagctgctgggcacccacctgcacagccagctgagctgcagccagcagagcagagagatgaccaacaagaaccagaagatggccgccgccctgcagagcaacatccagctgatcagcaaggccatcctggactacatcctggccaagctgtgcggcgtggacatggacaccagcttcgccagctgcggcctgaaggccatcagcgagagcctggacatcgacaaccccagcttcgccagcatcatcgagaagatggccaagagcaccaagatcatcagcagcatcgtgagcagaagagtgcaggaggacaacaaggaggagaccaagagcaaggccaagcccgtggcccccgtgagcagcaagacccccagcaccaaggagatgcaccccaacaagctgaaggccgtggccagcgacatcctgaacatggtgttcgccaagctggagggcttcgccaacggccacctggagatcctgggcgccatcaacgacggcaacaagaagagcaacaagatcggctgggagtacgagagcaccaacatcagcagagacacccacgaggccagcttcctgagcgccctgtacatgcacgccaagaaggtgagcagcgccatcctgaaggtgatccagaccgagctgaacgtgaccagcagcgacctgaagaccagcgtggagaaccccccccccgagacccagatcctgaagtacgtggtgaagctgatcctggacgccgtgagcagcgacatgttcaacgagatggagagcgagggcggcggcatcgagacctacagatacagacccacctacggcagcctgcccggcggcgccgagagcgacagcttcctggaggacgacgcctacaccgccaagaagatcatcgacgagagaagcccccagagagaggaggtgaagaccagaagcctgaagcagtgggccctggagaagaccctgaacaagatcgaggtgaagctgaaggagccccacatcagccccatcgcccccatcatcagaaacatcctgaacgagatcttccagagcaccctgatcaaccagctgaacgtgctgagcctgagccacagcaacttcaacggcatgccccacaacgtggacgagcccaccccccagaccagcgtgcagttcatggacaagatgatggaccccctgctgagcgaggccgacatcaccatcgtgaccgacaacatcgtgagaaccgtgttccacaagctgtacagcgccgccatgaccgagagaaacgtgagagagaacagatacaagaccatcaccttcagcgccaacgtgagcagccacgagcacacctacaagggcaagagcagcgtgaccgccctggacgagaacccctgcaccttccagagcagattcagcgtggccgacaaggagaccaaggtgaacctggccgaggacatcgtgcaggccatcctgaccaacctggagaccttcgccaccagcaaggtgaagagcctgttctacagccaggtgaacttcaccgtgcccgtggccctgcccatccagcaggaccacagcaccctgagcaaggccctgagcgccaaggacagctacagcgacgagcagttcagctgctgcagcgtggaccacaccaagagcggcaagaccaacctgtgccagctgagcctgagcaagctgaacacctacgccctgcaggtggccagaagaaacctgcagggcatcaagcaggagctggacaaggagagagagaaccccttcctgacccacgacatcggcatcagcgagagcatcgccagccagatcgtgaacgccctgctggacatcatcagcagaaagggcaagtgcgacaagaacagcagcgacaaggagatcgacctggaccagcagaagggcgtgatcgagaagctgctgaacgagaccaagtacagaaaggtgctgcagctgcagatccaggacaccatcgagggcatcctgtgcgacatctacgagaagaccctgttccagaacaacctgagcttcgccacccccaccctgaagtgcagcatcgccgacaagcacagcgaggagaacagcgagatgttcatggagggcgccaacaagatcatccccaagctgagcgtgcccaagagcgacgtgatcctgatcagcaacgacatcgtgaacatcgtgctgcacaacctgagcagcgccgccaccctggtgatcaacgccaagaaccccaccagcgccagactgcccctgaccttctgcgacaccttccccaagatcgactgccagcagcccctgaagggcagcaagaccgagagaaagaccgagagattcagctacagcagaaaccagaagagcgcctacgccgacgacaaccagatcaccgtggtggagaaggaggacacccagaagagcgccaccgacagctgcgaggagaacgccaacttcatcaccaagaccatcttcaagagactggagagcttcgccaccgagagaatcgacagcctgatcaccctggccttccagagcaaggagaagagcttcgtgatccccgagctggagaactgcaagcagaacgacagcatcttctacgacagcagccaggtggagagcgacgtgaacgtgctgaagatcagcgccaccgagaccatcctgagccaggagctgaccgacttcaccttcgtgggcagaagagagaagctgggcagcaccatccacctgagccaggccagactgaagacctacgccgacgtgatcgccagcgccatcctgaagctgatcaagaacgacctggacctggagatccagaagatctacccctaccagaacaacatcctgttccaggagaacatcatcgtgagcgagatcgtggacagcatgctgaagatgctggacgacaagagaagcgtgaaggagatctgcttcaacagcaaggagaacagcaacttcagccagctggccctgagcaacgagatcctgctgggccacaaggagaaggagagaagcaccaagcagagcctgttcaccaagtaccccctggagcagaaccagatgatcctggagaacaagagacagatcatcgtgctggaggagatcttcatgagaaacggcgagagcaagaacaaggagaagggcgagctgctgatcgccgtggaggagctgctgaacaagctgtaccagagagtgagagaggtgaccggccacctgccccccctgaacgagaccgccaacttcatcagcaacagcaagatcaagaccagcgacaccacccagaagaacagcttccagagccacatcaacagcgtggccaacgacatcgtggagagcgtgctgggcaagatgtacctggtggtggtgaccagcctgtacgagaacaacaagagcagaaccgaggtggagatcagcgaccacaacgacagcctgctgatgaagcccctgagattcagagagaccaagcaggccggcaagatcagcaacagccccagatacgccatcagccaggcctacagctacgtggacagccagaacatcagcgtgatggagaacaccctgctgccctacctgcccctgcaggtgaagaaggacctgatccagatggtgctgaacaagatcaccaacttcgtgagcctgcccctgaaggtgagccccaaggacaaccccaagccctgcttcaaggcccacctgaagaccagaagcaagatcaccaccctgcccaagttcaccaagaagacccacctgggcctgagcgccgccaaggccaagagcaagaccaagctgggccccggcgagaagaccctgaaggacagcagaagcaagaccgccatcggcctgagccacatcatgagcgccggcgacgccaagaacctgctggacaccaagctgcccaccagcgagctgaagatctacgccaaggacatcatcatcaacatcctggagaccatcgtgaaggagttcggcaaggtgaagcagaccaaggccctgcccagcgaccagatcatcgccgccggcaagatcgtgaacaccgtgctgcaggagctgtacgtgaccaacaactgcaacctggcctaccccatgaagagcagccacctgagactgagccagggcaacatcggcaccggcagcctgcccaagcagcaggcctgcttctacctggagaacgtgagcagccagctggagcacatcttccccagagagggcatcttcaagaagctgttcgacaagtggcagaccgagagcaacgacaaggagaacgagaagtgcaagctgctgatgatcgccgagaacgtgctgaccgagatcagcatcaaggccaaggagctggagtacagcctgagcctgctgaacctgccccccctggagaactgcgagagcagattctacaaccacttcaagggcgccagcaccagagccgaggacaccaaggcccagatcaacatgttcggcagagagatcgtggagatgctgctggagaagctgcagctgtgcttcctgagccagatccccacccccgacagcgaggagaccctgagcaacagcaaggagcacatcaccgccaagagcaagtacggcttccccaacaagcacagcctgagcagcctgcccatctacaacaccaagaccaaggaccagatcagcgtgggcagcagcaaccagatcgtgcaggagatcgtggagaccgtgctgaacatgctggagagcttcgtggacctgcagttcaagcacatcagcaagtacgagttcagcgagatcgtgaagatgcccatcgagaacctgagcagcatccagcagaagctgctgaacaagaagatgctgcccaagctgcagcccctgaagatgttcagcgacaagagcgagagcaacaccatcaacttcaaggagaacatccagaacatcctgctgagagtgcacagcttccacagccagctgctgacctacgccgtgaacatcatcagcgacatgctggccgtgatcaagaacaagctggacaacgagatcagccagatggagcccagcagcatcagcatcctgaaggagaacatcgtggccagcgagatcatcggcaccctgatggaccagtgcacctacttcaacgagagcctgatccagaacctgagcagagagagcctgttccagggcgccgagaacgcctacaccgtgaaccaggtggagctggccaccaacatgaagatgttcaccagcaagctgaaggagggcagcctgggcatcaaccccagccaggtgagcaagaccggcttcgtgttctgcagcgacgaggacatgaaggagaagtacagagtgagcagcgacctgcccaccagcgtgagaagcagcgtggaggacaccgtgaagaacagcgagcccaccaagagacccgacagcgagaccatgcccagctgcagcaccagaaacaaggtgcaggaccacagacccagagagagcaacttcggcagcttcgaccagaccatgaagggcaacagctacctgcccgagggcagcttcctgcagaagctgctgagaaaggccagcgacagcaccgaggccgccctgaagcaggtgctgagcttcatcgagatgggcaagggcgagaacctgagagtgttccactacgagaacctgaagcccgtggtggagcccaaccagatccagaccaccatcagccccctgaagatctgcctggccgccgagaacatcgtgaacaccgtgctgagcagctgcggcttccccagccagccccacaccaacgagaacagagagatcatgaagcccttcttcatcagcaagcagagcagcctgagcgaggtgagcggcggccagaaggacaacgagaagagcctgctgagaatgcaggacaagaagatcaactacatccccgaggaggagaacgagaacctggaggccagcagagaggacagcagcttcctgcagaagctgaagaagaaggagtaccccaagatcgagaccgtgaaggaggtggaggccttcaccttcgccgaccacgagatgggcagcaacgaggtgcacctgatcgccagacacgtgaccaccagcgtggtgacctacctgaagaacttcgagaccaccgtgttcagcgaggagaagatgagcgtgagcacctggagcagaaagaagtacgagagcaagcagttcctgagaaacatctacgacgacagcagcatctaccagtgctgcgagcacctgaccgagagcgtgctgtaccacctgaccagcagcatcagcgacggcaccaagaagggcagagagaaggagaaggcctgggagatccaggaggccaccttcagcaagatcatcagcatccacagccaggtgttcgagagcagaagcatcagcatcggcgagctggccctgtgcatcagcgagatcatcatcaagatcctgttcaacaacaagatcatccaggccgacatcgcccagaagatggtggccatccccaccaagtacacctactgccccggcatcgtgagcggcggcttcgacgacctgttccaggacctgctggtgggcgtgatccacgtgctgagcaaggagatcgaggtggactaccacttcgagagcaacgtgagaaacaagagcttcagcatgcacagaaacaacagcgtgcccctgtgcaacaagatcaacagacaggccagccccagagactggcagttcagcacccagcagatcggccagctgttccagaagaacaagctgagctacctggcctgcaagctgaacagcctggtgggcaacctgaagaccagcgagagcaaggaggtggtgaacaaggtgttcaacatcgtgagcgacctgttcagccccgacgagtgcctggacaccggcatggacagcggcaagatccagagaacctacttctacagcagcaacaacgagcagcccaacagcatcctgaccaacaacctgcagctgagcagcaagagcgtgttcctgctgaacgtggtgtgcgagaagctgatcagaatcctgctggaggagtgcaccagcaccgccttccccgacaagggcagcgtgagcgaggagaccagcgccgaggagtgccagctgctgaagatgctgcagagcgtggaggacggcaagagcgactacagaaagggcggcatggactgcgagtgcctgcaggtggactacatgagcgacctgctggagaacgtggccgagatcgaccaggacctgctgaccagcgacagcatgctgaccatcatcagccacagcctggtgaagagcctgatggacaagctgagccacagcatccagcaggcccccgagagcctgcccttcgccaacaagcacctgaactacagaaccagagagatccagagcagcttcatcaaggccagaaagagcgagctgatcgagctgggccagagcaagagcagcctggagctgagaagctacgacagcaacagcctgaccgtgagcctgaacaaccccagcgtggtgagcagcaagatccaggcccccttcaacaagcactgcgccgtgaagagcagcagcgtgagccccttcgagagacagagaaccaaggagatggacaaggtggccatccacaacaagctgcaccaggagggcatctacgccggcgtgtacagcgccaccttcctggagggcatcatcagcgagctgttcttcaacctgagcatgagcctgtggggcaagaacaagaacatcaccgtgagctggctgaacgagatgaacaccctgttcgtgaacaacgtggtgaacgagttcaacaacgcccaggtgaccgtgctgagaaacgccgaggagagactgtgcttcccccccgtgcacaccgagaccgtgagcaagatcgtggacagcgtgtactacgacgtgctgcagcagtacgagctgaaggtggcctgcggcaacaaccccgtgtacgacaacgccagcatcgccgagcagatcaccaacggcatcctgctggagatcctggactacaagctgcccagctgcttcaaggagcacctgatcccccacagctactaccccctgaagcccgagatcatcctgcagaagctgcagagcaacctgaccgagttcaccagcctgcccagaagcagcagcgactacagcaccatgctgagccacagcttcctggaggacgtgatcagaagactgctgagccagctgatccccccccccatcacctgcagcagcctgggcaagaagtacctgatgagcagcgacttcaacgagatgagcacctgcatcatcaacaaggtgatgagcgccatcagcaagcacaagatctggttcaccatctacgacaaccagtacctgtacaccggcaagaacctgcagaagatggtggacagcgtgtactgcaacatcctgcagatgagcgacagcctggtgagcatccagaagagcatcgtgagcagaagccccatcatgatcgaccagatcgccagcttcatcatccaggagatcatcgagaaccacctgcagcccttcctgagcggcgaggtgctgtgccaccccagaacccccctggaccccgtgagcaccatcgtgacccaggtgctgagcgaggtgatcgagagccacagaccccagaagcagagccccctggacatccacctggacagcttcgtgagagagatcgtggccagactgctgagcaagatcttcagccccaagcacaacaccgagatcgagctgaagaacatgacccagagaatcgtgaacagcatcaacagacacttcaacaaggccaagatccacatcctgtacgacgacaaggagcaggccttcttcagcttcaacaccgacatcgtggacgagctggccaccagcgtgtacagaaacgccctgaagcagcacggcctggacctggccgtggacaaggagagcgaggacagcggcatcttcgtggagaacatcaccaacctgatcgtggccgccatcagcgactacctgctgcaccccctgttcagcggcgacttcagcgccagcacctacagcaacagcgtggccgagaacatcgtgcaggacatcctgagcaacatcagcaagagcaccgagcccagccagagcgtgcccctgtacaacaccctgctgccctacaccttcctggaggacatgatcagagtgctgctgagcaagctgttcagcagcgccagcagcctggtgctgaacagagacacccagaaggacatcagcagagtgaacttcaacgacatcgccagcaacctggtgagcgacatcagaatgaaggtgagccagcacgagatcagattcagcaaggaggaggaggagaccaagttcatctacagcgaggacgacatccagcacctggtggacagcgtgttcgccaacgtggtgcagaccagcggcagccaggagagcgccgtgcagaacatcaccagcagcaacgacatcctgatcgacagaatcgccggcttcatcatcaagcacatctgccagaagcacctgcagcccttcgtgagcggcaagagcctgagcagcagcgacacctacttcgacgacgagagaagacagctgttctacaccagcgtgtacagcagcaccttcctggaggacgtgatcagcggcgtgctgagaaagatcttccacagagtggtgggcatcgtgcagaccaagagcatcagagacagcgaggacgagctgttcgagaaggccgaggagctgatccacctgatcaccggcgagttcagcaaggcccaggtgagcatcatcgacaacaccgaggagagactgtgcctgccccccgtggagagagacgtggtgaagaccatcgtggacatggtgtacagcaaggtgctgcaggagtacgagatggaggtggtgcccaacaaggacttcctgaacgacaccaagaccctggccgccagaatcaccaacatcatcctggccgagatcttcgacttccagatccaccccgacctgatcgccaacctgcccttcaagagccacagcaagctgagcgccaacgtgctgatccagagagtgcagtacgacatcagcaagagcagattccagagacaggccagcaccatgtacaccaccatgctgagccacagccacctggagaagatcgtgacccagctgaccagccagatcagccccctgaacaccagcgccgagcagagcgacaccaccaagagcgacctgagcaacaccgtgatcaagctgatcaacgagatcatgagcatcatcagcaagcacgagatctgcatcatcaagtacggcaacaagaagcagagcatgatcagcgccaaggacatccagagcatggtggacagcatctacgccgacctgagccacagcaacatctaccagagcatcaccaaggacaagaagagcatcagcgacatccccgtgagcaagatcgccagcttcatcatcaaggagatcttcaaccaccacatccagagcttcctgagcgaggacaagaccctgctgctggccgccgtggaccagacctacaagctgaaggccatcgaccccaagcagagagagctgagcttcatcgtgaacagcagcgtgttcctggaggaggtgatcagcgagctgctgtgcaagatcctgtacgccttcagccacaacatgctggtgaccgagaaccccgacagagtgaagctgaagctgaccagaatcgtgaccaccctggtgaacagcatcgtgctggagttcaccaccagcgagatcctggtggccgacaacttcgacaagaacctgtgcttcagcgagagatacaaggagatggtgcagaagatcgtgaacagcgtgtacggcaaggtgctggaccagtacaagagcctgatccagatccacagagtgatccagagcgacaccatctgcttcggcagaaagatctactacctgctgctggaggagatctacgactaccaggtgcagagcctggtgagcggcgagctggagagcagcagctacagctacccccaggccgacaacatcatcagaaacgtgctgaacatcatcaccaaggacagccacgccctgcccccctacatcaccgtgctgccccacagcctgctggaggacatggtgtacagactgctgggccacgtgttccccagcacccacaccgagaacgagctgaaggagaagaagttcccccccgacgacgagttcgtggaggccgccagcaagctgaccgacgagatcatcaaggagatcagcgagcacgagatcagactgagcatggccgaggacaacgccgagagcatgcagctggagcccatcgagaacctggtggacagcatctgcaacaacatcctgaagaccagcgagttccaggccgaggtgcagaaggacgccgacaagaagggctgcagcttcctgagcaagctggccggcttcatcatgaaggagatcatgtaccaccacctgcagcccttcctgcacggcgaggagagcagcttcagcgacctgagcgactacgaccacgtgagcgagctggccaagagcggcaaggagaagacccagcccagcctgtacagcgccaccttcctggaggacatcatcatcgacctggtgcacaagttctgcagcctgctgatcatcaccgaggacagcaagaagaacgagatggccgagctggacatcatgggcctggccctgaagctggccaacagcctgatcagagagttcaagaagagcgacatcaaggtgctgcccaacgccgagaagatgttcagcttcccccccatcgacaaggagaccgtggacaagatcagcaacttcgtgtacgagcagttcatcgagaagtgcaccagccacgacatccagaagggcgacgagagcaacatcgccatcggcatgatcgccgccctgacccagaaggccatcagcgccttcagaatccagcccctgttcagcggcgactggagcagcaccttcttcagcttcctgaaccccgacaacatcacccagagagtgcagcacctgccccagaacaccttcacccagatcagcagatgcgccaaggagaaccagctgagcctgcccgaccagagctacaaggacaccagcagcacccccgactgcaagaacatgatgagcaccctggagatcaacagaggcaccatgaacagaaagaagagcttcaagaccaaggacaccagcgtgaagaagggcgacatccagaaccccgtgctgagcagcatcaacgccatcatgaagagcggcatgatcaacctgaccagcggcctggccaccggcgtgaccaacaagaaggaggtggacgagaacaaggtgggcatctgcacccagaagcacagcgagaacgtgagcaaggtgaccagcaccaccaccgtgaagagcaaggacacccaggagcccaacctgagcgagaccttcaacaacaacgagatcgagaagaagagaaacctgatccccaccgacaagaagggcaaggacgacgagatctacacccacttcagcctgatcatcgacgacaccgagtacgagaaggaggtgctgggcagcgacagcgagatcggctacaagaagaagatcgacaacgccagagagagcagcttcaagaaggacgacaagctgttccagctgagcagcctgaagagcaagagaaacctgggcaccaccaccgacaccctggagatcagaatcagaaccagcagcaacgagggcagaagagacagccccacccagacctgcagagacgaggagcaccacagcgactacgagcacgtgcagaacgtgatcgagaacatcttcgaggacgtgctggagctgagcagcagccccgagcccgcctactacagcaagctgagctacgaccagagcccccccggcgacaacgtgctgaacgtgatccaggagatcagcagagacagcgcccagagcgtgaccaccaagaaggtgagcagcagcaccaacaagaacatcagcgccaaggagaaggaggaggaggagagagagaaggagaaggtgagagaggagatcaagagcgagcccagcaagcccgacgacccccagaaccagagagagagcaagcccggcatcttccccgccaagttcctggaggacgtgatcaccgagatggtgaagcagctgatcttcagcagcatccccgagacccagatccaggacagatgccagaacgtgagcgacaagcagaaccaggccaagctgtacgacaccgccatgaagctgatcaacagcctgctgaaggagttcagcgacgcccagatcaaggtgttcagacccgacaagggcaaccagttccccggcggcaaggtgagcagcgtgcccaaggtgccccccagatacaaggagcccaccaccgacgaggcccccagcagcatcaagatcaagagcgccgacaagatgccccccatgcacaagatgatgagaaagcccagcagcgacaagatccccagcatcgacaagaccctggtgaacaaggtggtgcacagcagcgtgtgcaacatcctgaacgactacggcagccaggacagcatctggaagaacatcaacagcaacggcgagaacctggccagaagactgaccagcgccgtgatcaacgagatcttccagagacaggtgaacctgatcttctgcgacgaggtgagcgtgagcgcctgcctgcccctggagagcaaggacgtggtgaagaaggtgcagaagctggcccagaccgccagcaaggagtgccagaccagcagcccctacaccatcatcctgccccacaagttcctggagaacgtgatcagcgccctgttcagcaagatcttcagcaccatcagcagcaccaagaccaaggagcccgaggacaacctgagcaccgagctgaacttcctgcagatgaagctggtgagcgccgtggccaccgagatcagccaggacaagtacatgaccatccagtacgtggagaccctgcagagcgacgacgacgagatcatccagctggtggtgcagagcgtgtacaacaacctgctgccccagttcggcagccaggagatcatccagaactgcgtgaccagcggctgcaagatcctgagcgagaacatcgtggacctggtgctgagagaggtggccagcaaccagctgcagagctacttctgcggcgagctgaccccccaccagtgcgtggaggtggagaacatcgtggagaagatcctgaaggacgtgttccagaccaccgacgtgcccctgcccaagcccagccacgccgacaagctgagctacaacatcatcgaggagatcgccgtgaagttcctgagcaagctgctgagcatcttccccaaggtgcacaaggagagaaccaagagcctggagaccgacatgcagaagatcaccagcaaggtgctgaacagcgtgcaggagttcatcagcaagagcaagatcaagctggtgccccccaccaaggagagccccaccgtgcccgtggccgacaacgccaccatcgagaacatcgtgaacagcatctacaccagcgtgctgaagcacagcggcagctacaccagcgtgttcaaggacctgatgggcaagagcaacgtgctgagcgacaccatcggcttcctgatggtgaacgccatcagcaacagcgagttccagccccaggtggaggaggaggtgagcaacagcgagctggtgctggaggccgtgaagatcatggagaaggtgatcaagatcatcgacgagctgaagagcaaggagaagagcagcagcagaaagggcctgaccctggacgccaagctgctggaggaggtgctggccctgttcctggccaagctgatcagactgcccagcagcagcagcaaggacgagaagaacctgagcaagaccgagctgaacaagatcgccagccagctgagcaagctggtgaccgccgagatcagcagaagcagcatcagcctgatcgccagcgaccccgaggagcactgcctgaaccccgagaacaccgagagaatctaccaggtggtggacagcgtgtacagcaacatcctgcagcagagcggcaccaacaaggagttctactacgacatcaaggacaccaacaccgccttccccaagaaggtggccagcctgatcatcgacggcgtgagcagcttccccctggacaccatcaacagcaccatcagcaacgccgacctgagcggcgagctggacgtgaacagaatcgtgcagaaggcccaggagcacgccttcaacgtgatccccgagctggagcaggagaagctggaccagaacctgagcgaggaggagagccccatcaagatcgtgccccacgtgggcaagaagcccgtgaagatcgaccccaagatcatcagcgagcacctggccgtgatcagcatcaagacccagcccctggagaagctgaagcaggagtgcctgaagagaaccggccacagcatcgccgagctgagaagagccagcatcagcggcagaaactacagcctgggcagccccgacctggagaagagaaagaccgagagaagaaccagcctggacaagaccggcagactggacgtgaagcccctggaggccgtggccagaaacagcttccagaacatcagaaagcccgacatcaccaaggtggagctgctgaaggacgtgcagagcaagaacgacctgatcgtgagactggtggcccacgacatcgaccaggtgtacctggagaactacatcaaggaggagagagacagcgacgaggacgaggtggtgctgacccagaccttcgccaaggaggagggcatcaaggtgttcgaggaccaggtgaaggaggtgaagaagcccatccagagcaagctgagccccaagagcaccctgagcaccagcagcctgaagaagttcctgagcctgagcaagtgctgccagaccaccgccagcgccaacatcgagagcaccgaggccatcagcaaccaggtgatcgagagcaaggagacccacgtgaagagagccgtggccgagctggacatggccacccccaagaccatgcccgagaccgccagcagcagctgggaggagaagccccagtgcaagaaggaggagaagaacctggtgaccgagcccacccactacttcatccacagaatcatgagcagcagcagctacaaccaggaggacctgatcagcagcaccggcgaggccgaggactgccacagcgaccccagcgccaagatcctggaggagagcagccaggagcagaagcccgagcacggcaacagcgtgaagttcatcaccatcttcgagagaagcaaggacgtgctgggcagcgccaaccccagcaaggaggtgatcagcgagacccccaagcccgacgtgagcaagcagggcagcaagatgctgaccaagatgagcagcaccctgagcaaggtgttcagccagtgcaacaccaacatcagcagaagcagcagccccgcccaccaggacgagcactag

SEQ ID NO: 18381 - DNA, 411 bp, Artificial Sequence
  Description of Artificial Sequence: Synthetic coding sequence
aaggaccaggagagactgatgagacacagatacctggacatgatcagcagaaagctggagcagctggagagaaccgccgaggagcagagactgttcctgatggacagagaggagagaagacagagagagcacaccagaagaaagctgaccctgagaagaaagatcgaggaggagtggaagaccaaggagatgctgctgctgaccagaatggccgaggacgtgaagagagaggagagaatcgaggagcagcagcacagaaacagagaggagagcgacagaaagaagcaggacctgctggagaagaagatggcctaccacctgcagaagatgcaggacaccggcttcaacggcgaggacatcggcaagaacaccttcaagtacagaggccaggacggcacccacggcgagtag

SEQ ID NO: 18382 - DNA, 393 bp, Artificial Sequence
  Description of Artificial Sequence: Synthetic coding sequence
atgagacacagatacctggacatgatcagcagaaagctggagcagctggagagaaccgccgaggagcagagactgttcctgatggacagagaggagagaagacagagagagcacaccagaagaaagctgaccctgagaagaaagatcgaggaggagtggaagaccaaggagatgctgctgctgaccagaatggccgaggacgtgaagagagaggagagaatcgaggagcagcagcacagaaacagagaggagagcgacagaaagaagcaggacctgctggagaagaagatggcctaccacctgcagaagatgcaggacaccggcttcaacggcgaggacatcggcaagaacaccttcaagtacagaggccaggacggcacccacggcgagtag

SEQ ID NO: 18383 - DNA, 1377 bp, Artificial Sequence
  Description of Artificial Sequence: Synthetic coding sequence
atgatgctgatccccatggccagcgtgatggccgtgaccgagcccaagtgggtgagcgtgtggagcagattcctgtgggtgaccctgctgagcatggtgctgggcagcctgctggccctgctgctgcccctgggcgccgtggaggagcagtgcctggccgtgctgaagggcctgtacctgctgagaagcaagcccgacagagcccagcacgccgccaccaagtgcaccagccccagcaccgagctgagcatcaccagcagaggcgccaccctgctggtggccaagaccaaggccagccccgccggcaagctggaggccagagccgccctgaaccaggccctggagatgaagagacagggcaagagagagaaggcccagaagctgttcatgcacgccctgaagatggaccccgacttcgtggacgccctgaccgagttcggcatcttcagcgaggaggacaaggacatcatccaggccgactacctgtacaccagagccctgaccatcagcccctaccacgagaaggccctggtgaacagagacagaaccctgcccctggtggaggagatcgaccagagatacttcagcatcatcgacagcaaggtgaagaaggtgatgagcatccccaagggcaacagcgccctgagaagagtgatggaggagacctactaccaccacatctaccacaccgtggccatcgagggcaacaccctgaccctgagcgagatcagacacatcctggagaccagatacgccgtgcccggcaagagcctggaggagcagaacgaggtgatcggcatgcacgccgccatgaagtacatcaacaccaccctggtgagcagaatcggcagcgtgaccatcagcgacgtgctggagatccacagaagagtgctgggctacgtggaccccgtggaggccggcagattcagaaccacccaggtgctggtgggccaccacatccccccccacccccaggacgtggagaagcagatgcaggagttcgtgcagtggctgaacagcgaggaggccatgaacctgcaccccgtggagttcgccgccctggcccactacaagctggtgtacatccaccccttcatcgacggcaacggcagaaccagcagactgctgatgaacctgatcctgatgcaggccggctacccccccatcaccatcagaaaggagcagagaagcgactactaccacgtgctggaggccgccaacgagggcgacgtgagacccttcatcagattcatcgccaagtgcaccgagaccaccctggacaccctgctgttcgccaccaccgagtacagcgtggccctgcccgaggcccagcccaaccacagcggcttcaaggagaccctgcccgtgaagccctag

SEQ ID NO: 18384 - DNA, 831 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcgacatctgcgccttctgccacaagaccgtgagccccagagagctggccgtggaggccatgaagagacagtaccacgcccagtgcttcacctgcagaacctgcagaagacagctggccggccagagcttctaccagaaggacggcagacccctgtgcgagccctgctaccaggacaccctggagagatgcggcaagtgcggcgaggtggtgagagaccacatcatcagagccctgggccaggccttccaccccagctgcttcacctgcgtgacctgcgccagatgcatcggcgacgagagcttcgccctgggcagccagaacgaggtgtactgcctggacgacttctacagaaagttcgcccccgtgtgcagcatctgcgagaaccccatcatccccagagacggcaaggacgccttcaagatcgagtgcatgggcagaaacttccacgagaactgctacagatgcgaggactgcagaatcctgctgagcgtggagcccaccgaccagggctgctaccccctgaacaaccacctgttctgcaagccctgccacgtgaagagaagcgccgccggctgctgctag

SEQ ID NO: 18385 - DNA, 1122 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcggctgccccccccccccccccgtgctggacggcgaggacgtgctgcccgacctggacctgctgccccccccccccccccccccccccgtgctgctgcccagcgaggaggaggcccccgcccccatgggcgccagcctgatcgccgacctggagcagctgcacctgagccccccccccccccccccccaggcccccgccgagggccccagcgtgcagcccggccccctgagacccatggaggaggagctgccccccccccccgccgagcccgtggagaagggcgccagcaccgacatctgcgccttctgccacaagaccgtgagccccagagagctggccgtggaggccatgaagagacagtaccacgcccagtgcttcacctgcagaacctgcagaagacagctggccggccagagcttctaccagaaggacggcagacccctgtgcgagccctgctaccaggacaccctggagagatgcggcaagtgcggcgaggtggtgagagaccacatcatcagagccctgggccaggccttccaccccagctgcttcacctgcgtgacctgcgccagatgcatcggcgacgagagcttcgccctgggcagccagaacgaggtgtactgcctggacgacttctacagaaagttcgcccccgtgtgcagcatctgcgagaaccccatcatccccagagacggcaaggacgccttcaagatcgagtgcatgggcagaaacttccacgagaactgctacagatgcgaggactgcagaatcctgctgagcgtggagcccaccgaccagggctgctaccccctgaacaaccacctgttctgcaagccctgccacgtgaagagaagcgccgccggctgctgctag

SEQ ID NO: 18386 - DNA, 1122 bp, Artificial Sequence; identical to SEQ ID NO: 18385
  Description of Artificial Sequence: Synthetic coding sequence

SEQ ID NO: 18387 - DNA, 831 bp, Artificial Sequence; identical to SEQ ID NO: 18384
  Description of Artificial Sequence: Synthetic coding sequence

SEQ ID NO: 18388 - DNA, 54 bp, Artificial Sequence
  Description of Artificial Sequence: Synthetic coding sequence
atggccagcaagcccgagaagagagtggccagcagcgtgttcatcaccctgtag

SEQ ID NO: 18389 - DNA, 315 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcggctgccccccccccccccccgtgctggacggcgaggacgtgctgcccgacctggacctgctgtag

SEQ ID NO: 18390 - DNA, 1125 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcggctgccccccccccccccccgtgctggacggcgaggacgtgctgcccgacctggacctgctgccccccccccccccccccccccccgtgctgctgcccagcgaggaggaggcccccgcccccatgggcgccagcctgatcgccgacctggagcagctgcacctgagccccccccccccccccccccaggcccccgccgagggccccagcgtgcagcccggccccctgagacccatggaggaggagctgccccccccccccgccgagcccgtggagaagggcgccagcaccgacatctgcgccttctgccacaagaccgtgagccccagagagctggccgtggaggccatgaagagacagtaccacgcccagtgcttcacctgcagaacctgcagaagacagctggccggccagagcttctaccagaaggacggcagacccctgtgcgagccctgctaccaggacaccctggagagatgcggcaagtgcggcgaggtggtgagagaccacatcatcagagccctgggccaggccttccaccccagctgcttcacctgcgtgacctgcgccagatgcatcggcgacgagagcttcgccctgggcagccagaacgaggtgtactgcctggacgacttctacagatacgagaagggcctgtgcaccggctggggcgccggcaccggcagagaccccagcagagtgaaggagctgagcctgagccccggctgctgggccagagtgagctgcctgctggtgtactacaaggagtactacagagccggcctgggcgccgtggcccacgcctgcaaccccagcaccctgggcggcagaggcggctggatcaccagaagcggcgacagagaccaccccggctag

SEQ ID NO: 18391 - DNA, 438 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcggctgccccccccccccccccgtgctggacggcgaggacgtgctgcccgacctggacctgctgccccccccccccccccccccccccgtgctgctgcccagcgaggaggaggcccccgcccccatgggcgccagcctgatcgccgacctggagcagctgcacctgagccccccccccccccccccctag

SEQ ID NO: 18392 - DNA, 93 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgtag

SEQ ID NO: 18393 - DNA, 96 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagatag

SEQ ID NO: 18394 - DNA, 435 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgcagctgttcaacggcgacatctgcgccttctgccacaagaccgtgagccccagagagctggccgtggaggccatgaagagacagtaccacgcccagtgcttcacctgcagaacctgcagaagacagctggccggccagagcttctaccagaaggacggcagacccctgtgcgagccctgctaccaggacaccctggagtag

SEQ ID NO: 18395 - DNA, 105 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtag

SEQ ID NO: 18396 - DNA, 237 bp, Artificial Sequence
  Description of Artificial Sequence: Synthetic coding sequence
atggccagcaagcccgagaagagagtggccagcagcgtgttcatcaccctggccccccccagaagagacgtggccgtggccgaggaggtgagacaggccgtgtgcgaggccagaagaggcagaccctgggaggcccccgcccccatgaagacccccgaggccggcctggccggcagacccagcccctggaccacccccggcagagccgccgccaccgtgcccgccgcccccatgtag

SEQ ID NO: 18397 - DNA, 45 bp, Artificial Sequence
  Description of Artificial Sequence: Synthetic coding sequence
atggccagcaagcccgagaagagagtggccagcagcgtgttctag

SEQ ID NO: 18398 - DNA, 300 bp, Artificial Sequence
  Description of Artificial Sequence: Synthetic coding sequence
atgtgcgtgggcgagaagagaagagccatcatccccagccacctggcctacggcaagagaggcttcccccccagcgtgcccgccgacgccgtggtgcagtacgacgtggagctgatcgccctgatcagagccaactactggctgaagctggtgaagggcatcctgcccctggtgggcatggccatggtgcccgccctgctgggcctgatcggctaccacctgtacagaaaggccaacagacccaaggtgagcaagaagaagctgaaggaggagaagagaaacaagagcaagaagaagtag

SEQ ID NO: 18399 - DNA, 441 bp, Artificial Sequence
  Description of Artificial Sequence: Synthetic coding sequence
atgaccctgagacccagcctgctgcccctgcacctgctgctgctgctgctgctgagcgccgccgtgtgcagagccgaggccggcctggagaccgagagccccgtgagaaccctgcaggtggagaccctggtggagccccccgagccctgcgccgagcccgccgccttcggcgacaccctgcacatccactacaccggcagcctggtggacggcagaatcatcgacaccagcctgaccagagaccccctggtgatcgagctgggccagaagcaggtgatccccggcctggagcagagcctgctggacatgtgcgtgggcgagaagagaagagccatcatccccagccacctggcctacggcaagagaggcttcccccccagcgtgcccggcaccaaggacaacctgatgagaccccccggcatgaccagcagcagccagtag

SEQ ID NO: 18400 - DNA, 606 bp, Artificial Sequence
  Description of Artificial Sequence: Synthetic coding sequence
atgaccctgagacccagcctgctgcccctgcacctgctgctgctgctgctgctgagcgccgccgtgtgcagagccgaggccggcctggagaccgagagccccgtgagaaccctgcaggtggagaccctggtggagccccccgagccctgcgccgagcccgccgccttcggcgacaccctgcacatccactacaccggcagcctggtggacggcagaatcatcgacaccagcctgaccagagaccccctggtgatcgagctgggccagaagcaggtgatccccggcctggagcagagcctgctggacatgtgcgtgggcgagaagagaagagccatcatccccagccacctggcctacggcaagagaggcttcccccccagcgtgcccgccgacgccgtggtgcagtacgacgtggagctgatcgccctgatcagagccaactactggctgaagctggtgaagggcatcctgcccctggtgggcatggccatggtgcccgccctgctgggcctgatcggctaccacctgtacagaaaggccaacagacccaaggtgagcaagaagaagctgaaggaggagaagagaaacaagagcaagaagaagtag

SEQ ID NO: 18401 - DNA, 948 bp, Artificial Sequence
  Description of Artificial Sequence: Synthetic coding sequence
atgagagccggccagcagctggccagcatgctgagatggaccagagcctggagactgcccagagagggcctgggcccccacggccccagcttcgccagagtgcccgtggcccccagcagcagcagcggcggcagaggcggcgccgagcccagacccctgcccctgagctacagactgctggacggcgaggccgccctgcccgccgtggtgttcctgcacggcctgttcggcagcaagaccaacttcaacagcatcgccaagatcctggcccagcagaccggcagaagagtgctgaccgtggacgccagaaaccacggcgacagcccccacagccccgacatgagctacgagatcatgagccaggacctgcaggacctgctgccccagctgggcctggtgccctgcgtggtggtgggccacagcatgggcggcaagaccgccatgctgctggccctgcagagacccgagctggtggagagactgatcgccgtggacatcagccccgtggagagcaccggcgtgagccacttcgccacctacgtggccgccatgagagccatcaacatcgccgacgagctgcccagaagcagagccagaaagctggccgacgagcagctgagcagcgtgatccaggacatggccgtgagacagcacctgctgaccaacctggtggaggtggacggcagattcgtgtggagagtgaacctggacgccctgacccagcacctggacaagatcctggccttcccccagagacaggagagctacctgggccccaccctgttcctgctgggcggcaacagccagttcgtgcaccccagccaccaccccgagatcatgagactgttccccagagcccagatgcagaccgtgcccaacgccggccactggatccacgccgacagaccccaggacttcatcgccgccatcagaggcttcctggtgtag

SEQ ID NO: 18402 - DNA, 1713 bp, Artificial Sequence
  Description of Artificial Sequence: Synthetic coding sequence
atggccttcagaggctggagacccccccccccccccctgctgctgctgctgctgtgggtgaccggccaggccgcccccgtggccggcctgggcagcgacgccgagctgcagatcgagagaagattcgtgcccgacgagtgccccagaaccgtgagaagcggcgacttcgtgagataccactacgtgggcaccttccccgacggccagaagttcgacagcagctacgacagagacagcaccttcaacgtgttcgtgggcaagggccagctgatcaccggcatggaccaggccctggtgggcatgtgcgtgaacgagagaagattcgtgaagatcccccccaagctggcctacggcaacgagggcgtgagcggcgtgatcccccccaacagcgtgctgcacttcgacgtgctgctgatggacatctggaacagcgaggaccaggtgcagatccacacctacttcaagccccccagctgccccagaaccatccaggtgagcgacttcgtgagataccactacaacggcaccttcctggacggcaccctgttcgacagcagccacaacagaatgaagacctacgacacctacgtgggcatcggctggctgatccccggcatggacaagggcctgctgggcatgtgcgtgggcgagaagagaatcatcaccatcccccccttcctggcctacggcgaggacggcgacggcaaggacatccccggccaggccagcctggtgttcgacgtggccctgctggacctgcacaaccccaaggacagcatcagcatcgagaacaaggtggtgcccgagaactgcgagagaatcagccagagcggcgacttcctgagataccactacaacggcaccctgctggacggcaccctgttcgacagcagctacagcagaaacagaaccttcgacacctacatcggccagggctacgtgatccccggcatggacgagggcctgctgggcgtgtgcatcggcgagaagagaagaatcgtggtgcccccccacctgggctacggcgaggagggcagaggcaacatccccggcagcgccgtgctggtgttcgacatccacgtgatcgacttccacaaccccagcgacagcatcagcatcaccagccactacaagccccccgactgcagcgtgctgagcaagaagggcgactacctgaagtaccactacaacgccagcctgctggacggcaccctgctggacagcacctggaacctgggcaagacctacaacatcgtgctgggcagcggccaggtggtgctgggcatggacatgggcctgagagagatgtgcgtgggcgagaagagaaccgtgatcatccccccccacctgggctacggcgaggccggcgtggacggcgaggtgcccggcagcgccgtgctggtgttcgacatcgagctgctggagctggtggccggcctgcccgagggctacatgttcatctggaacggcgaggtgagccccaacctgttcgaggagatcgacaaggacggcaacggcgaggtgctgctggaggagttcagcgagtacatccacgcccaggtggccagcggcaagggcaagctggcccccggcttcgacgccgagctgatcgtgaagaacatgttcaccaaccaggacagaaacggcgacggcaaggtgaccgccgaggagttcaagctgaaggaccaggaggccaagcacgacgagctgtag

SEQ ID NO: 18403 - DNA, 1017 bp, Artificial Sequence
  Description of Artificial Sequence: Synthetic coding sequence
atggccggcaaggacatccccggccaggccagcctggtgttcgacgtggccctgctggacctgcacaaccccaaggacagcatcagcatcgagaacaaggtggtgcccgagaactgcgagagaatcagccagagcggcgacttcctgagataccactacaacggcaccctgctggacggcaccctgttcgacagcagctacagcagaaacagaaccttcgacacctacatcggccagggctacgtgatccccggcatggacgagggcctgctgggcgtgtgcatcggcgagaagagaagaatcgtggtgcccccccacctgggctacggcgaggagggcagaggcaacatccccggcagcgccgtgctggtgttcgacatccacgtgatcgacttccacaaccccagcgacagcatcagcatcaccagccactacaagccccccgactgcagcgtgctgagcaagaagggcgactacctgaagtaccactacaacgccagcctgctggacggcaccctgctggacagcacctggaacctgggcaagacctacaacatcgtgctgggcagcggccaggtggtgctgggcatggacatgggcctgagagagatgtgcgtgggcgagaagagaaccgtgatcatccccccccacctgggctacggcgaggccggcgtggacggcgaggtgcccggcagcgccgtgctggtgttcgacatcgagctgctggagctggtggccggcctgcccgagggctacatgttcatctggaacggcgaggtgagccccaacctgttcgaggagatcgacaaggacggcaacggcgaggtgctgctggaggagttcagcgagtacatccacgcccaggtggccagcggcaagggcaagctggcccccggcttcgacgccgagctgatcgtgaagaacatgttcaccaaccaggacagaaacggcgacggcaaggtgaccgccgaggagttcaagctgaaggaccaggaggccaagcacgacgagctgtag

SEQ ID NO: 18404 - DNA, 1872 bp, Artificial Sequence
  Description of Artificial Sequence: Synthetic coding sequence
atggccttcagaggctggagacccccccccccccccctgctgctgctgctgctgtgggtgaccggccaggccgcccccgtggccggcctgggcagcgacgccgagctgcagatcgagagaagattcgtgcccgacgagtgccccagaaccgtgagaagcggcgacttcgtgagataccactacgtgggcaccttccccgacggccagaagttcgacagcagatactgggacaccgccgaggacaaggccgacaagagcccctgcccccaggtgagagtgggcgtgaacaccagccccagctgcagactgaagcagaagggcgtgggcatctactggaaggacctgcagttcctggtgagagtgcagaaccacggcctgagctacgacagagacagcaccttcaacgtgttcgtgggcaagggccagctgatcaccggcatggaccaggccctggtgggcatgtgcgtgaacgagagaagattcgtgaagatcccccccaagctggcctacggcaacgagggcgtgagcggcgtgatcccccccaacagcgtgctgcacttcgacgtgctgctgatggacatctggaacagcgaggaccaggtgcagatccacacctacttcaagccccccagctgccccagaaccatccaggtgagcgacttcgtgagataccactacaacggcaccttcctggacggcaccctgttcgacagcagccacaacagaatgaagacctacgacacctacgtgggcatcggctggctgatccccggcatggacaagggcctgctgggcatgtgcgtgggcgagaagagaatcatcaccatcccccccttcctggcctacggcgaggacggcgacggcaaggacatccccggccaggccagcctggtgttcgacgtggccctgctggacctgcacaaccccaaggacagcatcagcatcgagaacaaggtggtgcccgagaactgcgagagaatcagccagagcggcgacttcctgagataccactacaacggcaccctgctggacggcaccctgttcgacagcagctacagcagaaacagaaccttcgacacctacatcggccagggctacgtgatccccggcatggacgagggcctgctgggcgtgtgcatcggcgagaagagaagaatcgtggtgcccccccacctgggctacggcgaggagggcagaggcaacatccccggcagcgccgtgctggtgttcgacatccacgtgatcgacttccacaaccccagcgacagcatcagcatcaccagccactacaagccccccgactgcagcgtgctgagcaagaagggcgactacctgaagtaccactacaacgccagcctgctggacggcaccctgctggacagcacctggaacctgggcaagacctacaacatcgtgctgggcagcggccaggtggtgctgggcatggacatgggcctgagagagatgtgcgtgggcgagaagagaaccgtgatcatccccccccacctgggctacggcgaggccggcgtggacggcgaggtgcccggcagcgccgtgctggtgttcgacatcgagctgctggagctggtggccggcctgcccgagggctacatgttcatctggaacggcgaggtgagccccaacctgttcgaggagatcgacaaggacggcaacggcgaggtgctgctggaggagttcagcgagtacatccacgcccaggtggccagcggcaagggcaagctggcccccggcttcgacgccgagctgatcgtgaagaacatgttcaccaaccaggacagaaacggcgacggcaaggtgaccgccgaggagttcaagctgaaggaccaggaggccaagcacgacgagctgtag

SEQ ID NO: 18405 - DNA, 1299 bp, Artificial Sequence
  Description of Artificial Sequence: Synthetic coding sequence
atggacatctggaacagcgaggaccaggtgcagatccacacctacttcaagccccccagctgccccagaaccatccaggtgagcgacttcgtgagataccactacaacggcaccttcctggacggcaccctgttcgacagcagccacaacagaatgaagacctacgacacctacgtgggcatcggctggctgatccccggcatggacaagggcctgctgggcatgtgcgtgggcgagaagagaatcatcaccatcccccccttcctggcctacggcgaggacggcgacggcaaggacatccccggccaggccagcctggtgttcgacgtggccctgctggacctgcacaaccccaaggacagcatcagcatcgagaacaaggtggtgcccgagaactgcgagagaatcagccagagcggcgacttcctgagataccactacaacggcaccctgctggacggcaccctgttcgacagcagctacagcagaaacagaaccttcgacacctacatcggccagggctacgtgatccccggcatggacgagggcctgctgggcgtgtgcatcggcgagaagagaagaatcgtggtgcccccccacctgggctacggcgaggagggcagaggcaacatccccggcagcgccgtgctggtgttcgacatccacgtgatcgacttccacaaccccagcgacagcatcagcatcaccagccactacaagccccccgactgcagcgtgctgagcaagaagggcgactacctgaagtaccactacaacgccagcctgctggacggcaccctgctggacagcacctggaacctgggcaagacctacaacatcgtgctgggcagcggccaggtggtgctgggcatggacatgggcctgagagagatgtgcgtgggcgagaagagaaccgtgatcatccccccccacctgggctacggcgaggccggcgtggacggcgaggtgcccggcagcgccgtgctggtgttcgacatcgagctgctggagctggtggccggcctgcccgagggctacatgttcatctggaacggcgaggtgagccccaacctgttcgaggagatcgacaaggacggcaacggcgaggtgctgctggaggagttcagcgagtacatccacgcccaggtggccagcggcaagggcaagctggcccccggcttcgacgccgagctgatcgtgaagaacatgttcaccaaccaggacagaaacggcgacggcaaggtgaccgccgaggagttcaagctgaaggaccaggaggccaagcacgacgagctgtag

SEQ ID NO: 18406 - DNA, 1989 bp, Artificial Sequence
  Description of Artificial Sequence: Synthetic coding sequence
atggagggcacccactgcaccctgcagctgcacaagcccatcaccgagctgtgctacatcagcttctgcctgcccaagggcgaggtgagaggcttcagctacaagggcaccgtgaccctggacagaagcaacaagggcttccacaactgctaccaggtgagagaggagagcgacatcatcagcctgagccaggagcccgacgagcaccccggcgacatcttcttcaagcagacccccaccaaggacatcctgaccgagctgtacaagctgaccaccgagagagagagactgctgaccaacctgctgagcagcgaccacatcctgggcatcaccatgggcaaccaggagggcaagctgcaggagctgagcgtgagcctggcccccgaggacgactgcttccagagcgccggcgactggcagggcgagctgcccgtgggccccctgaacaagagaagcacccacggcaacaagaagcccagaagaagcagcggcagaagagagagcttcggcgccctgccccagaagagaaccaagagaaagggcagaggcggcagagagagcgcccccctgatgggcaaggacaagatctgcagcagccacagcctgcccctgagcagaaccagacccaacctgtgggtgctggaggagaagggcaacctgctgcccaacggcgccctggcctgcagcctgcagagaagagagagctgcccccccgacatccccaagacccccgacaccgacctgggcttcggcagcttcgagaccgccttcaaggacaccggcctgggcagagaggtgctgccccccgactgcagcagcaccgaggccggcggcgacggcatcagaagaccccccagcggcctggagcaccagcagaccggcctgagcgagagccaccaggaccccgagaagcaccccgaggccgagaaggacgagatggagaagcccgccaagagaacctgcaagcagaagcccgtgagcaaggtggtggccaaggtgcaggacctgagcagccaggtgcagagagtggtgaagacccacagcaagggcaaggagaccatcgccatcagacccgccgcccacgccgagttcgtgcccaaggccgacctgctgaccctgcccggcgccgaggccggcgcccacggcagcagaagacagggcaaggagagacagggcgacagaagcagccagagccccgccggcgagaccgccagcatcagcagcgtgagcgccagcgccgagggcgccgtgaacaaggtgcccctgaaggtgatcgagagcgagaagctggacgaggcccccgagggcaagagactgggcttccccgtgcacaccagcgtgccccacaccagacccgagaccagaaacaagagaagagccggcctgcccctgggcggccacaagagcctgttcctggacctgccccacaaggtgggccccgacagcagccagcccagaggcgacaagaagaagcccagcccccccgcccccgccgccctgggcaaggtgttcaacaacagcgccagccagagcagcacccacaagcagaccagccccgtgcccagccccctgagccccagactgcccagcccccagcagcaccacagaatcctgagactgcccgccctgcccggcgagagagaggccgccctgaacgacagcccctgcagaaagagcagagtgttcagcggctgcgtgagcgccgacaccctggagccccccagcagcgccaaggtgaccgagaccaagggcgccagccccgccttcctgagagccggccagcccagactggtgcccggcgagaccctggagaagagcctgggccccggcaagaccaccgccgagccccagcaccagagcccccccgccttccactgggacctgcagcagcacttccaggagcccgtgatcagaaccgtgagcatcagctgcgccagcaacctgatcaaggaggaggccggcaagggcaaggagagcagaagcggctag

SEQ ID NO: 18407 - DNA, 3591 bp, Artificial Sequence
  Description of Artificial Sequence: Synthetic coding sequence
atggagaacgtggacaacagcctggacggcagcgacgtgagcgagcccgccaagcccgaggccggcctggaggtggcccagagcatcctgagcaagttcagcatgaagagcctgttcggcttcaccagcaagctggagagcgtgaaccccgaggaggaggacgccgtgctgaaggccttccacagcctggacgtgaaccccaccagccagcaggacgacagcagcaacggcctggacccccaggaggccggcagcagagtgagccccgacctgggcaacgacgagaagatcgccagcgtggagaccgagagcgagggcagccagagaaaggaggccggcaccagcctgctggcccaggagctgctgcccctgagcaccctgaagggcaccaaggacgacgtgatctgcgtgagaggcaccctggtgcacaccaccagcgacagcgacagcgacgacggcggccaggagcccgaggagggcagcagcaccaacggccccaagagccccagcggcgtgctgagcgagcccagccaggagagcaaggagaaccccggcggcttcagagagaacaccgtgaccggcgagatgaacggcgccgagctgtgcgccgaggacccccagagaatcccccccgagatgagcagcaagctggaggccggcaacggcggcctgcagaccgagagaagacccagccaggaccaggtgggcgaggagggcagccaggacctgcccgccgtgaccaaccagaacagcagcgtgggcatcaccgagagcgccagcagcaagaaggaggtgagcggcgagaagagcttccagctgcccgccttcttcagcggcctgagagtgctgaagaagggcgccaccgccgagggcggcgagaccatcaccgagatcaagcccaaggacggcgacctggccctgctgaagctgacccagcccgtgcagaagagcctggtgcaggccggcctgcagaccgtgaagagcgagaagaaggccaccgaccccaaggccacccccaccctgctggagcagctgagcctgctgctgaacatcgacatgcccaagaccgagcccaagggcgccgaccccgagagccccagaagagaggagatgggctgcaacgccgaccaggagagccagagcggccccggcgtgccccagacccagggcggcgaggtgaagcccaagagccccgagaccgccctggaggccttcaaggccctgttcatcagaccccccagaaagggcaccaccgccgacaccagcgagctggaggccctgaagagaaagatgagacacgagaaggagagcctgagagccgtgttcgagagaagcaacagcaagcccgccgacggccccagcgacagcaagagccccgaccacagcctgaccgagcaggacgacagaacccccggcagactgcaggccgtgtggcccccccccaagaccaaggacaccgaggagaaggtgggcctgaagtacaccgaggccgagtaccaggccgccatcctgcacctgaagagagagcacaaggaggagatcgagaacctgcaggcccagttcgagctgagagccttccacatcagaggcgagcacgccatgatcaccgccagactggaggagaccatcgagaacctgaagcacgagctggagcacagatggagaggcggctgcgaggagagaaaggacgtgtgcatcagcaccgacgacgactgcccccccaagaccttcagaaacgtgtgcgtgcagaccgacagagagaccttcctgaagccctgcgagagcgagagcaagaccaccagaagcaaccagctggtgcccaagaagctgaacatcagcagcctgagccagctgagcccccccaacgaccacaaggacatccacgccgccctgcagcccatggagggcatggccagcaaccagcagaaggccctgccccccccccccgccagcatccccccccccccccccctgcccagcggcctgggcagcctgagccccgccccccccatgccccccgtgagcgccggcccccccctgcccccccccccccccccccccccccccctgcccccccccagcagcgccggccccccccccccccccccccccccccccctgcccaacagccccgccccccccaaccccggcggccccccccccgccccccccccccccggcctggcccccccccccccccccggcctgttcttcggcctgggcagcagcagcagccagtgccccagaaagcccgccatcgagcccagctgccccatgaagcccctgtactggaccagaatccagatcagcgacagaagccagaacgccacccccaccctgtgggacagcctggaggagcccgacatcagagaccccagcgagttcgagtacctgttcagcaaggacaccacccagcagaagaagaagcccctgagcgagacctacgagaagaagaacaaggtgaagaagatcatcaagctgctggacggcaagagaagccagaccgtgggcatcctgatcagcagcctgcacctggagatgaaggacatccagcaggccatcttcaacgtggacgacagcgtggtggacctggagaccctggccgccctgtacgagaacagagcccaggaggacgagctggtgaagatcagaaagtactacgagaccagcaaggaggaggagctgaagctgctggacaagcccgagcagttcctgcacgagctggcccagatccccaacttcgccgagagagcccagtgcatcatcttcagaagcgtgttcagcgagggcatcaccagcctgcacagaaaggtggagatcatcaccagagccagcaaggacctgctgcacgtgaagagcgtgaaggacatcctggccctgatcctggccttcggcaactacatgaacggcggcaacagaaccagaggccaggccgacggctacagcctggagatcctgcccaagctgaaggacgtgaagagcagagacaacggcatcaacctggtggactacgtggtgaagtactacctgagatactacgaccaggaggccggcaccgagaagagcgtgttccccctgcccgagccccaggacttcttcctggccagccaggtgaagttcgaggacctgatcaaggacctgagaaagctgaagagacagctggaggccagcgagaagcagatggtggtggtgtgcaaggagagccccaaggagtacctgcagcccttcaaggacaagctggaggagttcttccagaaggccaagaaggagcacaagatggaggagagccacctggagaacgcccagaagagcttcgagaccaccgtgagatacttcggcatgaagcccaagagcggcgagaaggagatcacccccagctacgtgttcatggtgtggtacgagttctgcagcgacttcaagaccatctggaagagagagagcaagaacatcagcaaggagagactgaagatggcccaggagagcgtgagcaagctgaccagcgagaagaaggtggagaccaagaagatcaaccccaccgccagcctgaaggagagactgagacagaaggaggccagcgtgaccaccaactag

SEQ ID NO: 18408 - DNA, 1512 bp, Artificial Sequence
  Description of Artificial Sequence: Synthetic coding sequence
atggagaacgtggacaacagcctggacggcagcgacgtgagcgagcccgccaagcccgaggccggcctggaggtggcccagagcatcctgagcaagttcagcatgaagagcctgttcggcttcaccagcaagctggagagcgtgaaccccgaggaggaggacgccgtgctgaaggccttccacagcctggacgtgaaccccaccagccagcaggacgacagcagcaacggcctggacccccaggaggccggcagcagagtgagccccgacctgggcaacgacgagaagatcgccagcgtggagaccgagagcgagggcagccagagaaaggaggccggcaccagcctgctggcccaggagctgctgcccctgagcaccctgaagggcaccaaggacgacgtgatctgcgtgagaggcaccctggtgcacaccaccagcgacagcgacagcgacgacggcggccaggagcccgaggagggcagcagcaccaacggccccaagagccccagcggcgtgctgagcgagcccagccaggagagcaaggagaaccccggcggcttcagagagaacaccgtgaccggcgagatgaacggcgccgagctgtgcgccgaggacccccagagaatcccccccgagatgagcagcaagctggaggccggcaacggcggcctgcagaccgagagaagacccagccaggaccaggtgggcgaggagggcagccaggacctgcccgccgtgaccaaccagaacagcagcgtgggcatcaccgagagcgccagcagcaagaaggaggtgagcggcgagaagagcttccagctgcccgccttcttcagcggcctgagagtgctgaagaagggcgccaccgccgagggcggcgagaccatcaccgagatcaagcccaaggacggcgacctggccctgctgaagctgacccagcccgtgcagaagagcctggtgcaggccggcctgcagaccgtgaagagcgagaagaaggccaccgaccccaaggccacccccaccctgctggagcagctgagcctgctgctgaacatcgacatgcccaagaccgagcccaagggcgccgaccccgagagccccagaagagaggagatgggctgcaacgccgaccaggagagccagagcggccccggcgtgccccagacccagggcggcgaggtgaagcccaagagccccgagaccgccctggaggccttcaaggccctgttcatcagaccccccagaaagggcaccaccgccgacaccagcgagctggaggccctgaagagaaagatgagacacgagaaggagagcctgagagccgtgttcgagagaagcaacagcaagcccgccgacggccccagcgacagcaagagccccgaccacagcctgaccgagcaggacgacagaacccccggcagactgcaggccgtgtggcccccccccaagaccaaggacaccgaggagaaggtgggcctgaagtacaccgaggccggcaacgtgaagggcagctag

SEQ ID NO: 18409 - DNA, 4260 bp, Artificial Sequence
  Description of Artificial Sequence: Synthetic coding sequence
atggagggcacccactgcaccctgcagctgcacaagcccatcaccgagctgtgctacatcagcttctgcctgcccaagggcgaggtgagaggcttcagctacaagggcaccgtgaccctggacagaagcaacaagggcttccacaactgctaccaggtgagagaggagagcgacatcatcagcctgagccaggagcccgacgagcaccccggcgacatcttcttcaagcagacccccaccaaggacatcctgaccgagctgtacaagctgaccaccgagagagagagactgctgaccaacctgctgagcagcgaccacatcctgggcatcaccatgggcaaccaggagggcaagctgcaggagctgagcgtgagcctggcccccgaggacgactgcttccagagcgccggcgactggcagggcgagctgcccgtgggccccctgaacaagagaagcacccacggcaacaagaagcccagaagaagcagcggcagaagagagagcttcggcgccctgccccagaagagaaccaagagaaagggcagaggcggcagagagagcgcccccctgatgggcaaggacaagatctgcagcagccacagcctgcccctgagcagaaccagacccaacctgtgggtgctggaggagaagggcaacctgctgcccaacggcgccctggcctgcagcctgcagagaagagagagctgcccccccgacatccccaagacccccgacaccgacctgggcttcggcagcttcgagaccgccttcaaggacaccggcctgggcagagaggtgctgccccccgactgcagcagcaccgaggccggcggcgacggcatcagaagaccccccagcggcctggagcaccagcagaccggcctgagcgagagccaccaggaccccgagaagcaccccgaggccgagaaggacgagatggagaagcccgccaagagaacctgcaagcagaagcccgtgagcaaggtggtggccaaggtgcaggacctgagcagccaggtgcagagagtggtgaagacccacagcaagggcaaggagaccatcgccatcagacccgccgcccacgccgagttcgtgcccaaggccgacctgctgaccctgcccggcgccgaggccggcgcccacggcagcagaagacagggcaaggagagacagggcgacagaagcagccagagccccgccggcgagaccgccagcatcagcagcgtgagcgccagcgccgagggcgccgtgaacaaggtgcccctgaaggtgatcgagagcgagaagctggacgaggcccccgagggcaagagactgggcttccccgtgcacaccagcgtgccccacaccagacccgagaccagaaacaagagaagagccggcctgcccctgggcggccacaagagcctgttcctggacctgccccacaaggtgggccccgacagcagccagcccagaggcgacaagaagaagcccagcccccccgcccccgccgccctgggcaaggtgttcaacaacagcgccagccagagcagcacccacaagcagaccagccccgtgcccagccccctgagccccagactgcccagcccccagcagcaccacagaatcctgagactgcccgccctgcccggcgagagagaggccgccctgaacgacagcccctgcagaaagagcagagtgttcagcggctgcgtgagcgccgacaccctggagccccccagcagcgccaaggtgaccgagaccaagggcgccagccccgccttcctgagagccggccagcccagactggtgcccggcgagaccctggagaagagcctgggccccggcaagaccaccgccgagccccagcaccagagcccccccggcatcagcagcgagggcttcccctgggacggcttcaacgagcagacccccaaggacctgcccaacagagacggcggcgcctgggtgctgggctacagagccggccccgcctgccccttcctgctgcacgaggagagagagaagagcaacagaagcgagctgtacctggacctgcaccccgaccacagcctgaccgagcaggacgacagaacccccggcagactgcaggccgtgtggcccccccccaagaccaaggacaccgaggagaaggtgggcctgaagtacaccgaggccgagtaccaggccgccatcctgcacctgaagagagagcacaaggaggagatcgagaacctgcaggcccagttcgagctgagagccttccacatcagaggcgagcacgccatgatcaccgccagactggaggagaccatcgagaacctgaagcacgagctggagcacagatggagaggcggctgcgaggagagaaaggacgtgtgcatcagcaccgacgacgactgcccccccaagaccttcagaaacgtgtgcgtgcagaccgacagagagaccttcctgaagccctgcgagagcgagagcaagaccaccagaagcaaccagctggtgcccaagaagctgaacatcagcagcctgagccagctgagcccccccaacgaccacaaggacatccacgccgccctgcagcccatggagggcatggccagcaaccagcagaaggccctgccccccccccccgccagcatccccccccccccccccctgcccagcggcctgggcagcctgagccccgccccccccatgccccccgtgagcgccggcccccccctgcccccccccccccccccccccccccccctgcccccccccagcagcgccggccccccccccccccccccccccccccccctgcccaacagccccgccccccccaaccccggcggccccccccccgccccccccccccccggcctggcccccccccccccccccggcctgttcttcggcctgggcagcagcagcagccagtgccccagaaagcccgccatcgagcccagctgccccatgaagcccctgtactggaccagaatccagatcagcgacagaagccagaacgccacccccaccctgtgggacagcctggaggagcccgacatcagagaccccagcgagttcgagtacctgttcagcaaggacaccacccagcagaagaagaagcccctgagcgagacctacgagaagaagaacaaggtgaagaagatcatcaagctgctggacggcaagagaagccagaccgtgggcatcctgatcagcagcctgcacctggagatgaaggacatccagcaggccatcttcaacgtggacgacagcgtggtggacctggagaccctggccgccctgtacgagaacagagcccaggaggacgagctggtgaagatcagaaagtactacgagaccagcaaggaggaggagctgaagctgctggacaagcccgagcagttcctgcacgagctggcccagatccccaacttcgccgagagagcccagtgcatcatcttcagaagcgtgttcagcgagggcatcaccagcctgcacagaaaggtggagatcatcaccagagccagcaaggacctgctgcacgtgaagagcgtgaaggacatcctggccctgatcctggccttcggcaactacatgaacggcggcaacagaaccagaggccaggccgacggctacagcctggagatcctgcccaagctgaaggacgtgaagagcagagacaacggcatcaacctggtggactacgtggtgaagtactacctgagatactacgaccaggaggccggcaccgagaagagcgtgttccccctgcccgagccccaggacttcttcctggccagccaggtgaagttcgaggacctgatcaaggacctgagaaagctgaagagacagctggaggccagcgagaagcagatggtggtggtgtgcaaggagagccccaaggagtacctgcagcccttcaaggacaagctggaggagttcttccagaaggccaagaaggagcacaagatggaggagagccacctggagaacgcccagaagagcttcgagaccaccgtgagatacttcggcatgaagcccaagagcggcgagaaggagatcacccccagctacgtgttcatggtgtggtacgagttctgcagcgacttcaagaccatctggaagagagagagcaagaacatcagcaaggagagactgaagatggcccaggagagcgtgagcaagctgaccagcgagaagaaggtggagaccaagaagatcaaccccaccgccagcctgaaggagagactgagacagaaggaggccagcgtgaccaccaactag

SEQ ID NO: 18410 - DNA, 768 bp, Artificial Sequence
  Description of Artificial Sequence: Synthetic coding sequence
atgagcagccacagaagaaaggccaagggcagaaacagaagaagccacagagccatgagagtggcccacctggagctggccacctacgagctggccgccaccgagagcaaccccgagagcagccaccccggctacgaggccgccatggccgacagaccccagcccggctggagagagagcctgaagatgagagtgagcaagcccttcggcatgctgatgctgagcatctggatcctgctgttcgtgtgctactacctgagctactacctgtgcagcggcagcagctacttcgtgctggccaacggccacatcctgcccaacagcgagaacgcccacggccagagcctggaggaggacagcgccctggaggccctgctgaacttcttcttccccaccacctgcaacctgagagagaaccaggtggccaagccctgcaacgagctgcaggacctgagcgagagcgagtgcctgagacacaagtgctgcttcagcagcagcggcaccaccagcttcaagtgcttcgcccccttcagagacgtgcccaagcagatgatgcagatgttcggcctgggcgccatcagcctgatcctggtgtgcctgcccatctactgcagaagcctgttctggagaagcgagcccgccgacgacctgcagagacaggacaacagagtggtgaccggcctgaagaagcagagaagaaagagaaagagaaagagcgagatgctgcagaaggccgccagaggcagagaggagcacggcgacgagtag

SEQ ID NO: 18411 - DNA, 903 bp, Artificial Sequence
  Description of Artificial Sequence: Synthetic coding sequence
atggacctgcccccccagctgagcttcggcctgtacgtggccgccttcgccctgggcttccccctgaacgtgctggccatcagaggcgccaccgcccacgccagactgagactgacccccagcctggtgtacgccctgaacctgggctgcagcgacctgctgctgaccgtgagcctgcccctgaaggccgtggaggccctggccagcggcgcctggcccctgcccgccagcctgtgccccgtgttcgccgtggcccacttcttccccctgtacgccggcggcggcttcctggccgccctgagcgccggcagatacctgggcgccgccttccccctgggctaccaggccttcagaagaccctgctacagctggggcgtgtgcgccgccatctgggccctggtgctgtgccacctgggcctggtgttcggcctggaggcccccggcggctggctggaccacagcaacaccagcctgggcatcaacacccccgtgaacggcagccccgtgtgcctggaggcctgggaccccgccagcgccggccccgccagattcagcctgagcctgctgctgttcttcctgcccctggccatcaccgccttctgctacgtgggctgcctgagagccctggccagaagcggcctgacccacagaagaaagctgagagccgcctgggtggccggcggcgccctgctgaccctgctgctgtgcgtgggcccctacaacgccagcaacgtggccagcttcctgtaccccaacctgggcggcagctggagaaagctgggcctgatcaccggcgcctggagcgtggtgctgaaccccctggtgaccggctacctgggcagaggccccggcctgaagaccgtgtgcgccgccagaacccagggcggcaagagccagaagtag

SEQ ID NO: 18412 - DNA, 993 bp, Artificial Sequence
  Description of Artificial Sequence: Synthetic coding sequence
atgctgcccgactggaagagcagcctgatcctgatggcctacatcatcatcttcctgaccggcctgcccgccaacctgctggccctgagagccttcgtgggcagaatcagacagccccagcccgcccccgtgcacatcctgctgctgagcctgaccctggccgacctgctgctgctgctgctgctgcccttcaagatcatcgaggccgccagcaacttcagatggtacctgcccaaggtggtgtgcgccctgaccagcttcggcttctacagcagcatctactgcagcacctggctgctggccggcatcagcatcgagagatacctgggcgtggccttccccgtgcagtacaagctgagcagaagacccctgtacggcgtgatcgccgccctggtggcctgggtgatgagcttcggccactgcaccatcgtgatcatcgtgcagtacctgaacaccaccgagcaggtgagaagcggcaacgagatcacctgctacgagaacttcaccgacaaccagctggacgtggtgctgcccgtgagactggagctgtgcctggtgctgttcttcatccccatggccgtgaccatcttctgctactggagattcgtgtggatcatgctgagccagcccctggtgggcgcccagagaagaagaagagccgtgggcctggccgtggtgaccctgctgaacttcctggtgtgcttcggcccctacaacgtgagccacctggtgggctaccaccagagaaagagcccctggtggagaagcatcgccgtggtgttcagcagcctgaacgccagcctggaccccctgctgttctacttcagcagcagcgtggtgagaagagccttcggcagaggcctgcaggtgctgagaaaccagggcagcagcctgctgggcagaagaggcaaggacaccgccgagggcaccaacgaggacagaggcgtgggccagggcgagggcatgcccagcagcgacttcaccaccgagtag

SEQ ID NO: 18413 - DNA, 1041 bp, Artificial Sequence
  Description of Artificial Sequence: Synthetic coding sequence
atggacaccggccccgaccagagctacttcagcggcaaccactggttcgtgttcagcgtgtacctgctgaccttcctggtgggcctgcccctgaacctgctggccctggtggtgttcgtgggcaagctgcagagaagacccgtggccgtggacgtgctgctgctgaacctgaccgccagcgacctgctgctgctgctgttcctgcccttcagaatggtggaggccgccaacggcatgcactggcccctgcccttcatcctgtgccccctgagcggcttcatcttcttcaccaccatctacctgaccgccctgttcctggccgccgtgagcatcgagagattcctgagcgtggcccaccccctgtggtacaagaccagacccagactgggccaggccggcctggtgagcgtggcctgctggctgctggccagcgcccactgcagcgtggtgtacgtgatcgagttcagcggcgacatcagccacagccagggcaccaacggcacctgctacctggagttcagaaaggaccagctggccatcctgctgcccgtgagactggagatggccgtggtgctgttcgtggtgcccctgatcatcaccagctactgctacagcagactggtgtggatcctgggcagaggcggcagccacagaagacagagaagagtggccggcctgctggccgccaccctgctgaacttcctggtgtgcttcggcccctacaacgtgagccacgtggtgggctacatctgcggcgagagccccgcctggagaatctacgtgaccctgctgagcaccctgaacagctgcgtggaccccttcgtgtactacttcagcagcagcggcttccaggccgacttccacgagctgctgagaagactgtgcggcctgtggggccagtggcagcaggagagcagcatggagctgaaggagcagaagggcggcgaggagcagagagccgacagacccgccgagagaaagaccagcgagcacagccagggctgcggcaccggcggccaggtggcctgcgccgagagctag

SEQ ID NO: 18414 - DNA, 1758 bp, Artificial Sequence
  Description of Artificial Sequence: Synthetic coding sequence
atggccagacccgaccccagcgccccccccagcctgctgctgctgctgctggcccagctggtgggcagagccgccgccgccagcaaggcccccgtgtgccaggagatcaccgtgcccatgtgcagaggcatcggctacaacctgacccacatgcccaaccagttcaaccacgacacccaggacgaggccggcctggaggtgcaccagttctggcccctggtggagatccagtgcagccccgacctgagattcttcctgtgcagcatgtacacccccatctgcctgcccgactaccacaagcccctgcccccctgcagaagcgtgtgcgagagagccaaggccggctgcagccccctgatgagacagtacggcttcgcctggcccgagagaatgagctgcgacagactgcccgtgctgggcagagacgccgaggtgctgtgcatggactacaacagaagcgaggccaccaccgccccccccagacccttccccgccaagcccaccctgcccggcccccccggcgcccccgccagcggcggcgagtgccccgccggcggccccttcgtgtgcaagtgcagagagcccttcgtgcccatcctgaaggagagccaccccctgtacaacaaggtgagaaccggccaggtgcccaactgcgccgtgccctgctaccagcccagcttcagcgccgacgagagaaccttcgccaccttctggatcggcctgtggagcgtgctgtgcttcatcagcaccagcaccaccgtggccaccttcctgatcgacatggagagattcagataccccgagagacccatcatcttcctgagcgcctgctacctgtgcgtgagcctgggcttcctggtgagactggtggtgggccacgccagcgtggcctgcagcagagagcacaaccacatccactacgagaccaccggccccgccctgtgcaccatcgtgttcctgctggtgtacttcttcggcatggccagcagcatctggtgggtgatcctgagcctgacctggttcctggccgccggcatgaagtggggcaacgaggccatcgccggctacgcccagtacttccacctggccgcctggctgatccccagcgtgaagagcatcaccgccctggccctgagcagcgtggacggcgaccccgtggccggcatctgctacgtgggcaaccagaacctgaacagcctgagaggcttcgtgctgggccccctggtgctgtacctgctggtgggcaccctgttcctgctggccggcttcgtgagcctgttcagaatcagaagcgtgatcaagcagggcggcaccaagaccgacaagctggagaagctgatgatcagaatcggcatcttcaccctgctgtacaccgtgcccgccagcatcgtggtggcctgctacctgtacgagcagcactacagagagagctgggaggccgccctgacctgcgcctgccccggccacgacaccggccagcccagagccaagcccgagtactgggtgctgatgctgaagtacttcatgtgcctggtggtgggcatcaccagcggcgtgtggatctggagcggcaagaccgtggagagctggagaagattcaccagcagatgctgctgcagacccagaagaggccacaagagcggcggcgccatggccgccggcgactaccccgaggccagcgccgccctgaccggcagaaccggcccccccggccccgccgccacctaccacaagcaggtgagcctgagccacgtgtag

SEQ ID NO: 18415 - DNA, 2313 bp, Artificial Sequence
  Description of Artificial Sequence: Synthetic coding sequence
atgagcaagtgcagaaagacccccgtgcagcagctggccagccccgccagcttcagccccgacatcctggccgacatcttcgagctgttcgccaagaacttcagctacggcaagcccctgaacaacgagtggcagctgcccgaccccagcgagatcttcacctgcgaccacaccgagctgaacgccttcctggacctgaagaacagcctgaacgaggtgaagaacctgctgagcgacaagaagctggacgagtggcacgagcacaccgccttcaccaacaaggccggcaagatcatcagccacgtgagaaagagcgtgaacgccgagctgtgcacccaggcctggtgcaagttccacgagatcctgtgcagcttccccctgatcccccaggaggccttccagaacggcaagctgaacagcctgcacctgtgcgaggcccccggcgccttcatcgccagcctgaaccactacctgaagagccacagattcccctgccactggagctgggtggccaacaccctgaacccctaccacgaggccaacgacgacctgatgatgatcatggacgacagactgatcgccaacaccctgcactggtggtacttcggccccgacaacaccggcgacatcatgaccctgaagttcctgaccggcctgcagaacttcatcagcagcatggccaccgtgcacctggtgaccgccgacggcagcttcgactgccagggcaaccccggcgagcaggaggccctggtgagcagcctgcactactgcgaggtggtgaccgccctgaccaccctgggcaacggcggcagcttcgtgctgaagatgttcaccatgttcgagcactgcagcatcaacctgatgtacctgctgaactgctgcttcgaccaggtgcacgtgttcaagcccgccaccagcaaggccggcaacagcgaggtgtacgtggtgtgcctgcactacaagggcagagaggccatccaccccctgctgagcaagatgaccctgaacttcggcaccgagatgaagagaaaggccctgttcccccaccacgtgatccccgacagcttcctgaagagacacgaggagtgctgcgtgttcttccacaagtaccagctggagaccatcagcgagaacatcagactgttcgagtgcatgggcaaggccgagcaggagaagctgaacaacctgagagactgcgccatccagtacttcatgcagaagttccagctgaagcacctgagcagaaacaactggctggtgaagaagagcagcatcggctgcagcaccaacaccaagtggttcggccagagaaacaagtacttcaagacctacaacgagagaaagatgctggaggccctgagctggaaggacaaggtggccaagggctacttcaacagctgggccgaggagcacggcgtgtaccaccccggccagagcagcatcctggagggcaccgccagcaacctggagtgccacctgtggcacatcctggagggcaagaagctgcccaaggtgaagtgcagccccttctgcaacggcgagatcctgaagaccctgaacgaggccatcgagaagagcctgggcggcgccttcaacctggacagcaagttcagacccaagcagcagtacagctgcagctgccacgtgttcagcgaggagctgatcttcagcgagctgtgcagcctgaccgagtgcctgcaggacgagcaggtggtggtgcccagcaaccagatcaagtgcctgctggtgggcttcagcaccctgagaaacatcaagatgcacatccccctggaggtgagactgctggagagcgccgagctgaccaccttcagctgcagcctgctgcacgacggcgaccccacctaccagagactgttcctggactgcctgctgcacagcctgagagagctgcacaccggcgacgtgatgatcctgcccgtgctgagctgcttcaccagattcatggccggcctgatcttcgtgctgcacagctgcttcagattcatcaccttcgtgtgccccaccagcagcgaccccctgagaacctgcgccgtgctgctgtgcgtgggctaccaggacctgcccaaccccgtgttcagatacctgcagagcgtgaacgagctgctgagcaccctgctgaacagcgacagcccccagcaggtgctgcagttcgtgcccatggaggtgctgctgaagggcgccctgctggacttcctgtgggacctgaacgccgccatcgccaagagacacctgcacttcatcatccagagagagagagaggagatcatcaacagcctgcagctgcagaactag

SEQ ID NO: 18416 - DNA, 2313 bp, Artificial Sequence; identical to SEQ ID NO: 18415
  Description of Artificial Sequence: Synthetic coding sequence

SEQ ID NO: 18417 - DNA, 1440 bp, Artificial Sequence
  Description of Artificial Sequence: Synthetic coding sequence
atggtgagaatccagagaagaaagctgctggccagctgcctgtgcgtgaccgccaccgtgttcctgctggtgaccctgcaggtgatggtggagctgggcaagttcgagagaaaggagttcaagagcagcagcctgcaggacggccacaccaagatggaggaggcccccacccacctgaacagcttcctgaagaaggagggcctgaccttcaacagaaagagaaagtgggagctggacagctaccccatcatgctgtggtggagccccctgaccggcgagaccggcagactgggccagtgcggcgccgacgcctgcttcttcaccatcaacagaacctacctgcaccaccacatgaccaaggccttcctgttctacggcaccgacttcaacatcgacagcctgcccctgcccagaaaggcccaccacgactgggccgtgttccacgaggagagccccaagaacaactacaagctgttccacaagcccgtgatcaccctgttcaactacaccgccaccttcagcagacacagccacctgcccctgaccacccagtacctggagagcatcgaggtgctgaagagcctgagatacctggtgcccctgcagagcaagaacaagctgagaaagagactggcccccctggtgtacgtgcagagcgactgcgacccccccagcgacagagacagctacgtgagagagctgatgacctacatcgaggtggacagctacggcgagtgcctgagaaacaaggacctgccccagcagctgaagaaccccgccagcatggacgccgacggcttctacagaatcatcgcccagtacaagttcatcctggccttcgagaacgccgtgtgcgacgactacatcaccgagaagttctggagacccctgaagctgggcgtggtgcccgtgtactacggcagccccagcatcaccgactggctgcccagcaacaagagcgccatcctggtgagcgagttcagccaccccagagagctggccagctacatcagaagactggacagcgacgacagactgtacgaggcctacgtggagtggaagctgaagggcgagatcagcaaccagagactgctgaccgccctgagagagagaaagtggggcgtgcaggacgtgaaccaggacaactacatcgacgccttcgagtgcatggtgtgcaccaaggtgtgggccaacatcagactgcaggagaagggcctgccccccaagagatgggaggccgaggacacccacctgagctgccccgagcccaccgtgttcgccttcagccccctgagaaccccccccctgagcagcctgagagagatgtggatcagcagcttcgagcagagcaagaaggaggcccaggccctgagatggctggtggacagaaaccagaacttcagcagccaggagttctggggcctggtgttcaaggactag

SEQ ID NO: 18418 - DNA, 1074 bp, Artificial Sequence
  Description of Artificial Sequence: Synthetic coding sequence
atgggcatcggccagctgccccactacgccctggtggtgcccgccgacggcggcgactgggaggtgagacccatgtggagcagatgcctgttcctgcaccaccagcccgacctgccccccagcagccacgaccagagcatccccctgctgtggagccaggaggagagcccccccctggccgagaacgacggcaccgacttcaacatcgacagcctgcccctgcccagaaaggcccaccacgactgggccgtgttccacgaggagagccccaagaacaactacaagctgttccacaagcccgtgatcaccctgttcaactacaccgccaccttcagcagacacagccacctgcccctgaccacccagtacctggagagcatcgaggtgctgaagagcctgagatacctggtgcccctgcagagcaagaacaagctgagaaagagactggcccccctggtgtacgtgcagagcgactgcgacccccccagcgacagagacagctacgtgagagagctgatgacctacatcgaggtggacagctacggcgagtgcctgagaaacaaggacctgccccagcagctgaagaaccccgccagcatggacgccgacggcttctacagaatcatcgcccagtacaagttcatcctggccttcgagaacgccgtgtgcgacgactacatcaccgagaagttctggagacccctgaagctgggcgtggtgcccgtgtactacggcagccccagcatcaccgactggctgcccagcaacaagagcgccatcctggtgagcgagttcagccaccccagagagctggccagctacatcagaagactggacagcgacgacagactgtacgaggcctacgtggagtggaagctgaagggcgagatcagcaaccagagactgctgaccgccctgagagagagaaagtggggcgtgcaggacgtgaaccaggacaactacatcgacgccttcgagtgcatggtgtgcaccaaggtgtgggccaacatcagactgcaggagaaggtgagcaagagcaaggtgggcatcgagcccgccggctggcccagctag

SEQ ID NO: 18419 - DNA, 1566 bp, Artificial Sequence
  Description of Artificial Sequence: Synthetic coding sequence
atggtgagaatccagagaagaaagctgctggccagctgcctgtgcgtgaccgccaccgtgttcctgctggtgaccctgcaggccctggacaccgtggagaacctgatgaaggtgaccggccccccccagggcgtgaccgacagcatgcagtgcttcaacgaccagagacccctgagcaacaccagaagcagcgagcacatcaaggaggtgatggtggagctgggcaagttcgagagaaaggagttcaagagcagcagcctgcaggacggccacaccaagatggaggaggcccccacccacctgaacagcttcctgaagaaggagggcctgaccttcaacagaaagagaaagtgggagctggacagctaccccatcatgctgtggtggagccccctgaccggcgagaccggcagactgggccagtgcggcgccgacgcctgcttcttcaccatcaacagaacctacctgcaccaccacatgaccaaggccttcctgttctacggcaccgacttcaacatcgacagcctgcccctgcccagaaaggcccaccacgactgggccgtgttccacgaggagagccccaagaacaactacaagctgttccacaagcccgtgatcaccctgttcaactacaccgccaccttcagcagacacagccacctgcccctgaccacccagtacctggagagcatcgaggtgctgaagagcctgagatacctggtgcccctgcagagcaagaacaagctgagaaagagactggcccccctggtgtacgtgcagagcgactgcgacccccccagcgacagagacagctacgtgagagagctgatgacctacatcgaggtggacagctacggcgagtgcctgagaaacaaggacctgccccagcagctgaagaaccccgccagcatggacgccgacggcttctacagaatcatcgcccagtacaagttcatcctggccttcgagaacgccgtgtgcgacgactacatcaccgagaagttctggagacccctgaagctgggcgtggtgcccgtgtactacggcagccccagcatcaccgactggctgcccagcaacaagagcgccatcctggtgagcgagttcagccaccccagagagctggccagctacatcagaagactggacagcgacgacagactgtacgaggcctacgtggagtggaagctgaagggcgagatcagcaaccagagactgctgaccgccctgagagagagaaagtggggcgtgcaggacgtgaaccaggacaactacatcgacgccttcgagtgcatggtgtgcaccaaggtgtgggccaacatcagactgcaggagaagggcctgccccccaagagatgggaggccgaggacacccacctgagctgccccgagcccaccgtgttcgccttcagccccctgagaaccccccccctgagcagcctgagagagatgtggatcagcagcttcgagcagagcaagaaggaggcccaggccctgagatggctggtggacagaaaccagaacttcagcagccaggagttctggggcctggtgttcaaggactag

SEQ ID NO: 18420 - DNA, 1479 bp, Artificial Sequence
  Description of Artificial Sequence: Synthetic coding sequence
atggccgccggccccatcagagtggtgctggtgctgctgggcgtgctgagcgtgtgcgccgccagcggccacggcagcgtggccgagagagaggccggcggcgaggccgagtgggccgagccctgggacggcgccgtgttcagaccccccagcgccctgggcgccgtgggcgtgaccagaagcagcggcacccccagacccggcagagaggaggccggcgacctgcccgtgctgctgtggtggagccccggcctgttcccccacttccccggcgacagcgagagaatcgagtgcgccagaggcgcctgcgtggccagcagaaacagaagagccctgagagacagcagaaccagagccctgctgttctacggcaccgacttcagagccagcgccgcccccctgcccagactggcccaccagagctgggccctgctgcacgaggagagccccctgaacaacttcctgctgagccacggccccggcatcagactgttcaacctgaccagcaccttcagcagacacagcgactaccccctgagcctgcagtggctgcccggcaccgcctacctgagaagacccgtgcccccccccatggagagagccgagtggagaagaagaggctacgcccccctgctgtacctgcagagccactgcgacgtgcccgccgacagagacagatacgtgagagagctgatgagacacatccccgtggacagctacggcaagtgcctgcagaacagagagctgcccaccgccagactgcaggacaccgccaccgccaccaccgaggaccccgagctgctggccttcctgagcagatacaagttccacctggccctggagaacgccatctgcaacgactacatgaccgagaagctgtggagacccatgcacctgggcgccgtgcccgtgtacagaggcagccccagcgtgagagactggatgcccaacaaccacagcgtgatcctgatcgacgacttcgagagcccccagaagctggccgagttcatcgacttcctggacaagaacgacgaggagtacatgaagtacctggcctacaagcagcccggcggcatcaccaaccagttcctgctggacagcctgaagcacagagagtggggcgtgaacgaccccctgctgcccaactacctgaacggcttcgagtgcttcgtgtgcgactacgagctggccagactggacgccgagaaggcccacgccgccagccccggcgacagccccgtgttcgagccccacatcgcccagcccagccacatggactgccccgtgcccacccccggcttcggcaacgtggaggagatccccgagaacgacagctggaaggagatgtggctgcaggactactggcagggcctggaccagggcgaggccctgaccgccatgatccacaacaacgagaccgagcagaccaagttctgggactacctgcacgagatcttcatgaagagacagcacctgtag

SEQ ID NO: 18421 - DNA, 1431 bp, Artificial Sequence
  Description of Artificial Sequence: Synthetic coding sequence
atggccgccggccccatcagagtggtgctggtgctgctgggcgtgctgagcgtgtgcgccgccagcggccacggcagcgtggccgagagagaggccggcggcgaggccgagtgggccgagccctgggacggcgccgtgttcagaccccccagcgccctgggcgccgtgggcgtgaccagaagcagcggcacccccagacccggcagagaggaggccggcgacctgcccgtgctgctgtggtggagccccggcctgttcccccacttccccggcgacagcgagagaatcgagtgcgccagaggcgcctgcgtggccagcagaaacagaagagccctgagagacagcagaaccagagccctgctgttctacggcaccgacttcagagccagcgccgcccccctgcccagactggcccaccagagctgggccctgctgcacgaggagagccccctgaacaacttcctgctgagccacggccccggcatcagactgttcaacctgaccagcaccttcagcagacacagcgactaccccctgagcctgcagtggctgcccggcaccgcctacctgagaagacccgtgcccccccccatggagagagccgagtggagaagaagaggctacgcccccctgctgtacctgcagagccactgcgacgtgcccgccgacagagacagatacgtgagagagctgatgagacacatccccgtggacagctacggcaagtgcctgcagaacagagagctgcccaccgccagactgcaggacaccgccaccgccaccaccgaggaccccgagctgctggccttcctgagcagatacaagttccacctggccctggagaacgccatctgcaacgactacatgaccgagaagctgtggagacccatgcacctgggcgccgtgcccgtgtacagaggcagccccagcgtgagagactggatgcccaacaaccacagcgtgatcctgatcgacgacttcgagagcccccagaagctggccgagttcatcgacttcctggacaagaacgacgaggagtacatgaagtacctggcctacaagcagcccggcggcatcaccaaccagttcctgctggacagcctgaagcacagagagtggggcgtgaacgaccccctgctgcccaactacctgaacggcttcgagtgcttcgtgtgcgactacgagctggccagactggacgccgagaaggcccacgccgccagccccggcgacagccccgtgttcgagccccacatcgcccagcccagccacatggactgccccgtgcccacccccggcttcggcaacgtggaggagatccccgagaacgacagcagcctggtgcaggtgagagaccactgcatctgcctgagattcctgtggccccacagcgagaagggcagaacccacaactacgccgccgtgccctag

SEQ ID NO: 18422 - DNA, 570 bp, Artificial Sequence
  Description of Artificial Sequence: Synthetic coding sequence
atggagaccagcgcccccagagccggcagccaggtggtggccaccaccgccagacacagcgccgcctacagagccgaccccctgagagtgagcagcagagacaagctgaccgagatggccgccagcagccagggcaacttcgagggcaacttcgagagcctggacctggccgagttcgccaagaagcagccctggtggagaaagctgttcggccaggagagcggccccagcgccgagaagtacagcgtggccacccagctgttcatcggcggcgtgaccggctggtgcaccggcttcatcttccagaaggtgggcaagctggccgccaccgccgtgggcggcggcttcttcctgctgcagctggccaaccacaccggctacatcaaggtggactggcagagagtggagaaggacatgaagaaggccaaggagcagctgaagatcagaaagagcaaccagatccccaccgaggtgagaagcaaggccgaggaggtggtgagcttcgtgaagaagaacgtgctggtgaccggcggcttcttcggcggcttcctgctgggcatggccagctag

SEQ ID NO: 18423 - DNA, 1569 bp, Artificial Sequence
  Description of Artificial Sequence: Synthetic coding sequence
atggccctgaccgagacccagccccagctgctgagcgccgacctggtgctggccctgcaggtgctgatgctgtgggagatgaccgaggccaacaaggtgctgaagagaagacagcacccccagagaagccactgcatcagcagcaagatcctggagagctaccccggcgagaagcccctgaccaagagcctgcagagaggcgaggacccccagttcgaccaggtgatcagcagcatgagcagcctgagcgagtactgcctgcccagcatcctgagaaccctgttcgactgcgacgagcagcagagagactacctgatggagagaagagacctggccatcgacttcatcttcagcctggtgctgatcgaggtgctgaagcagggcagcctgacctgcctgatcatcccctacctgggcaccctggtgcccaccctggccatctgcatcctgtggcagacctgcatgcagaagagcctggagtgctggcacaagcccagcaagttccccgccgtgaagaagaagttcatggccgagctgaaggagctgagacacaaggagcagaacccctacgtggtgcagagcatcatcagcctgatcatgggcatgaagttcttcagaatcaagatgtaccccgtggaggacttcgaggccagcctgcagttcatgcaggagtgcgcccactacttcctggaggtgaaggacaaggacatcaagcacgccctggccggcctgttcgtggagatcctggtgcccgtggccgccgccgtgaagaacgaggtgaacgtgccctgcctgagaaacttcgtggagagcctgtacgacaccaccctggagctgagcagcagaaagaagcacagcctggccctgtaccccctggtgacctgcctgctgtgcgtgagccagaagcagctgttcctgaacagatggcacatcttcctgaacaactgcctgagcaacctgaagaacaaggaccccaagatggccagagtggccctggagagcctgtacagactgctgtgggtgtacatgatcagaatcaagtgcgagagcaacaccgccacccagagcagactgatcaccatcatcaccaccctgttccccaagggcagcagaggcgtggtgcccagagacatgcccctgaacatcttcgtgaagatcatccagttcatcgcccaggagagactggacttcgccatgaaggagatcatcttcgacttcctgtgcgtgggcaagcccgccaaggccttcagcctgaaccccgagagaatgaacatcggcctgagagccttcctggtgatcgccgacagcctgcagcagaaggacggcgagccccccatgcccgtgaccggcgccgtgctgcccagcggcaacaccctgagagtgaagaagacctacctgagcaagaccctgaccgaggaggaggccaagatgatcggcatgagcctgtactacagccaggtgagaaaggccgtggacaacatcctgagacacctggacaaggaggtgggcagatgcatgatgctgaccaacgtgcagatgctgaacaaggagcccgaggacatgatctag

SEQ ID NO: 18424 - DNA, 588 bp, Artificial Sequence
  Description of Artificial Sequence: Synthetic coding sequence
atggagagcctggcccagctggagctgtgccagagactgtacaagctgcacttccagctgctgctgctgttccagagctactgcaagctgatcggccaggtgcacgaggtgagcagcatgcccgagctgctgaacatgagcagagagctgagcgacctgaagaagcacctgaaggaggccagcgccgtgatcgccgccgaccccctgtacagcgacggcgcctggagcgagcccaccttcaccagcaccgaggccgccatccagagcatgctggagtgcctgaagaacaacgagctgggcaaggccctgagacagatcagagagtgcagaagcctgtggcccaacgacatcttcggcagcagcagcgacgacgaggtgcagaccctgctgaacatctacttcagacaccagaccctgggccagaccggcacctacgccctggtgggcagcaaccagagcctgaccgagatctgcaccaagctgatggagctgaacatggagatcagagacatgatcagaagagcccagagctacagagtgctgaccaccttcctgcccgacagcagcgtgagcggcaccagcctgtag

SEQ ID NO: 18425 - DNA, 1278 bp, Artificial Sequence
  Description of Artificial Sequence: Synthetic coding sequence
atggccgtgaccagaagcaccagcagcaccagcagcggcagcaacagcaacgtgctggtgcccgtgagctggaagagaccccagtacagccagaagagaaccaaggagaagctggtgcacgtgctgagcctgtgcggccaggaggtgggcctgagcaagaaccccagcgtgatcttcagcagctgcggcgacctggacctgctggagcaccagaccagcctggtgagcagcgaggacggcgccagagagcaggagaacatggacgacaccaacagcgagcagcagttcagagtgttcagagacttcgacttcctggacgtggagctggaggacggcgagggcctgagaggcgagagcatggacaacttcaactggggcgtgagaagaagaagcctggacagcctggacaagtgcgacatgcagatcctggaggagagacagctgagcggcagcacccccagcctgaacaagatgcaccacgaggacagcgacgagagcagcgaggaggaggacctgaccgccagccagatcctggagcacagcgacctgatcatgaccctgagccccagcgaggagaccaaccccatggagctgctgaccaccgcctgcgacagcacccccgccgagccccacagcttcaacaccagaatgagcagcttcgacgccagcctgcccgacatgaacaacctgcagatcagcgagggcagcaaggccgaggccgtgagagaggaggaggacaccaccgtgcacgaggacgacctgagcagcagcatcaacgagctgcccgccgccttcgagtgcagcgacagcttcagcctggacatgaccgagggcgaggagaagggcaacagagccctggaccagttcaccctggccagcttcggcgagggcgacagaggcgtgagccccccccccagccccttcttcagcgccatcctggccgccttccagcccgccgcctgcgacgacgccgaggaggcctggagaagccacatcaaccagctgatgtgcgacagcgacggcagctgcgccgtgtacaccttccacgtgttcagcagcctgttcaagaacatccagaagagattctgcttcctgacctgcgacgccgccagctacctgggcgacaacctgagaggcatcggcagcaagttcgtgagcagcagccagatgctgaccagctgcagcgagtgcagagcccaggtgcagtgcgtgagaaccgccagaatcttcggctacctgcagcagcaggagagaggccacaccctgtgcaagctgtag

SEQ ID NO: 18426 - DNA, 9042 bp, Artificial Sequence
  Description of Artificial Sequence: Synthetic coding sequence
atggccagccagcaggacagcggcttcttcgagatcagcatcaagtacctgctgaagagctggagcaacaccagccccgtgggcaacggctacatcaagccccccgtgccccccgccagcggcacccacagagagaagggcccccccaccatgctgcccatcaacgtggaccccgacagcaagcccggcgagtacgtgctgaagagcctgttcgtgaacttcaccacccaggccgagagaaagatcagaatcatcatggccgagcccctggagaagcccctgaccaagagcctgcagagaggcgaggacccccagttcgaccaggtgatcagcagcatgagcagcctgagcgagtactgcctgcccagcatcctgagaaccctgttcgactggtacaagagacagaacggcatcgaggacgagagccacgagtacagacccagaaccagcaacaagagcaagagcgacgagcagcagagagactacctgatggagagaagagacctggccatcgacttcatcttcagcctggtgctgatcgaggtgctgaagcagatccccctgcaccccgtgatcgacagcctgatccacgacgtgatcaacctggccttcaagcacttcaagtacaaggagggctacctgggccccaacaccggcaacatgcacatcgtggccgacctgtacgccgaggtgatcggcgtgctggcccaggccaagttccccgccgtgaagaagaagttcatggccgagctgaaggagctgagacacaaggagcagaacccctacgtggtgcagagcatcatcagcctgatcatgggcatgaagttcttcagaatcaagatgtaccccgtggaggacttcgaggccagcctgcagttcatgcaggagtgcgcccactacttcctggaggtgaaggacaaggacatcaagcacgccctggccggcctgttcgtggagatcctggtgcccgtggccgccgccgtgaagaacgaggtgaacgtgccctgcctgagaaacttcgtggagagcctgtacgacaccaccctggagctgagcagcagaaagaagcacagcctggccctgtaccccctggtgacctgcctgctgtgcgtgagccagaagcagctgttcctgaacagatggcacatcttcctgaacaactgcctgagcaacctgaagaacaaggaccccaagatggccagagtggccctggagagcctgtacagactgctgtgggtgtacatgatcagaatcaagtgcgagagcaacaccgccacccagagcagactgatcaccatcatcaccaccctgttccccaagggcagcagaggcgtggtgcccagagacatgcccctgaacatcttcgtgaagatcatccagttcatcgcccaggagagactggacttcgccatgaaggagatcatcttcgacttcctgtgcgtgggcaagcccgccaaggccttcagcctgaaccccgagagaatgaacatcggcctgagagccttcctggtgatcgccgacagcctgcagcagaaggacggcgagccccccatgcccgtgaccggcgccgtgctgcccagcggcaacaccctgagagtgaagaagacctacctgagcaagaccctgaccgaggaggaggccaagatgatcggcatgagcctgtactacagccaggtgagaaaggccgtggacaacatcctgagacacctggacaaggaggtgggcagatgcatgatgctgaccaacgtgcagatgctgaacaaggagcccgaggacatgatcaccggcgagagaaagcccaagatcgacctgttcagaacctgcgtggccgccatccccagactgctgcccgacggcatgagcaagctggagctgatcgacctgctggccagactgagcatccacatggacgacgagctgagacacatcgcccagaacagcctgcagggcctgctggtggacttcagcgactggagagaggacgtgctgttcggcttcaccaacttcctgctgagagaggtgaacgacatgcaccacaccctgctggacagcagcctgaagctgctgctgcagctgctgacccagtggaagctggtgatccagacccagggcaaggtgtacgagcaggccaacaagatcagaaacagcgagctgatcgccaacggcagcagccacagaatccagagcgagagaggcccccactgcagcgtgctgcacgccgtggagggcttcgccctggtgctgctgtgcagcttccaggtggccaccagaaagctgagcgtgctgatcctgaaggagatcagagccctgttcatcgccctgggccagcccgaggacgacgacagacccatgatcgacgtgatggaccagctgagcagcagcatcctggagagcttcatccacgtggccgtgagcgacagcgccaccctgcccctgacccacaacgtggacctgcagtggctggtggagtggaacgccgtgctggtgaacagccactacgacgtgaagagccccagccacgtgtggatcttcgcccagagcgtgaaggacccctgggtgctgtgcctgttcagcttcctgagacaggagaacctgcccaagcactgccccaccgccctgagctacgcctggccctacgccttcaccagactgcagagcgtgatgcccctggtggaccccaacagccccatcaacgccaagaagaccagcaccgccggcagcggcgacaactacgtgaccctgtggagaaactacctgatcctgtgcttcggcgtggccaagcccagcatcatgagccccggccacctgagagccagcacccccgagatcatggccaccacccccgacggcaccgtgagctacgacaacaaggccatcggcacccccagcgtgggcgtgctgctgaagcagctggtgcccctgatgagactggagagcatcgagatcaccgagagcctggtgctgggcttcggcagaaccaacagcctggtgttcagagagctggtggaggagctgcaccccctgatgaaggaggccctggagagaagacccgagaacaagaagagaagagagagaagagacctgctgagactgcagctgctgagaatcttcgagctgctggccgacgccggcgtgatcagcgacagcaccaacggcgccctggagagagacaccctggccctgggcgccctgttcctggagtacgtggacctgaccagaatgctgctggaggccgagaacgacaaggaggtggagatcctgaaggacatcagagcccacttcagcgccatggtggccaacctgatccagtgcgtgcccgtgcaccacagaagattcctgttcccccagcagagcctgagacaccacctgttcatcctgttcagccagtgggccggccccttcagcatcatgttcacccccctggacagatacagcgacagaaaccaccagatcaccagataccagtactgcgccctgaaggccatgagcgccgtgctgtgctgcggccccgtgttcgacaacgtgggcctgagccccgacggctacctgtacaagtggctggacaacatcctggcctgccaggacctgagagtgcaccagctgggctgcgaggtggtggtgctgctgctggagctgaaccccgaccagatcaacctgttcaactgggccatcgacagatgctacaccggcagctaccagctggccagcggctgcttcaaggccatcgccaccgtgtgcggcagcagaaactaccccttcgacatcgtgaccctgctgaacctggtgctgttcaaggccagcgacaccaacagagagatctacgagatcagcatgcagctgatgcagatcctggaggccaagctgttcgtgtacagcaagaaggtggccgagcagagacccggcagcatcctgtacggcacccacggccccctgccccccctgtacagcgtgagcctggccctgctgagctgcgagctggccagaatgtaccccgagctgaccctgcccctgttcagcgaggtgagccagagattccccaccacccaccccaacggcagacagatcatgctgacctacctgctgccctggctgcacaacatcgagctggtggacagcagactgctgctgcccggcagcagccccagcagccccgaggacgaggtgaaggacagagagggcgacgtgaccgccagccacggcctgagaggcaacggctggggcagccccgaggccaccagcctggtgctgaacaacctgatgtacatgaccgccaagtacggcgacgaggtgcccggccccgagatggagaacgcctggaacgccctggccaacaacgagaagtggagcaacaacctgagaatcaccctgcagttcctgatcagcctgtgcggcgtgagcagcgacaccgtgctgctgccctacatcaagaaggtggccatctacctgtgcagaaacaacaccatccagaccatggaggagctgctgttcgagctgcagcagaccgagcccgtgaaccccatcgtgcagcactgcgacaacccccccttctacagattcaccgccagcagcaaggccagcgccgccgccagcggcaccaccagcagcagcaacaccgtggtggccggccaggagaacttccccgacgccgaggagaacaagatcctgaaggagagcgacgagagattcagcaacgtgatcagagcccacaccagactggagagcagatacagcaacagcagcggcggcagctacgacgaggacaagaacgaccccatcagcccctacaccggctggctgctgaccatcaccgagaccaagcagccccagcccctgcccatgccctgcaccggcggctgctgggcccccctggtggactacctgcccgagaccatcacccccagaggccccctgcacagatgcaacatcgccgtgatcttcatgaccgagatggtggtggaccacagcgtgagagaggactgggccctgcacctgcccctgctgctgcacgccgtgttcctgggcctggaccactacagacccgaggtgttcgagcacagcaagaagctgctgctgcacctgctgatcgccctgagctgcaacagcaacttccacagcatcgccagcgtgctgctgcagaccagagagatgggcgaggccaagaccctgaccgtgcagcccgcctaccagcccgagtacctgtacaccggcggcttcgacttcctgagagaggaccagagcagccccgtgcccgacagcggcctgagcagcagcagcaccagcagcagcatcagcctgggcggcagcagcggcaacctgccccagatgacccaggaggtggaggacgtggacaccgccgccgagaccgacgagaaggccaacaagctgatcgagttcctgaccaccagagccttcggccccctgtggtgccacgaggacatcacccccaagaaccagaacagcaagagcgccgagcagctgaccaacttcctgagacacgtggtgagcgtgttcaaggacagcaagagcggcttccacctggagcaccagctgagcgaggtggccctgcagaccgccctggccagcagcagcagacactacgccggcagaagcttccagatcttcagagccctgaagcagcccctgagcgcccacgccctgagcgacctgctgagcagactggtggaggtgatcggcgagcacggcgacgagatccagggctacgtgatggaggccctgctgaccctggaggccgccgtggacaacctgagcgactgcctgaagaacagcgacctgctgaccgtgctgagcagaagcagcagccccgacctgagcagcagcagcaagctgaccgccagcagaaagagcaccggccagctgaacatgaaccccggcaccaccagcggcaacaccgccaccgccgagagaagcagacaccagagaagcttcagcgtgcccaagaagttcggcgtgatcgacagaagcagcgacccccccagaagcgccaccctggacagaatccaggcctgcacccagcagggcctgagcagcaagaccagaagcagcagcagcctgaaggacagcctgaccgaccccagccacatcaaccaccccaccaacctgctggccaccatcttctgggtgaccgtggccctgatggagagcgacttcgagttcgagtacctgatggccctgagactgctgagcagactgctggcccacatgcccctggacaaggccgagaacagagagaagctggagaagctgcaggcccagctgaagtgggccgacttcagcggcctgcagcagctgctgctgaagggcttcaccagcctgaccaccaccgacctgaccctgcagctgttcagcctgctgacccccgtgagcaagatcagcatggtggacgccagccacgccatcggcttccccctgaacgtgctgtgcctgctgccccagctgatccagcacttcgagaaccccaaccagttctgcaaggacatcgccgagagaatcgcccaggtgtgcctggaggagaagaaccccaagctgagcaacctggcccacgtgatgaccctgtacaagacccacagctacaccagagactgcgccacctgggtgaacgtggtgtgcagatacctgcacgaggcctacgccgacatcaccctgaacatggtgacctacctggccgagctgctggagaagggcctgcccagcgtgcagcagcccctgctgcaggtgatctacagcctgctgagctacatggacctgagcgtggtgcccgtgaagcagttcaacgtggaggtgctgaagaccatcgagaagtacgtgcagagcgtgcactggagagaggccctgaacatcctgaagctggtggtgagcagaagcgccagcctggtgctgcccagctaccagcacagcgacctgagcaagatcgagatccacagagtgtggaccagcgccagcaaggagctgcccggcaagaccctggacttccacttcgacatcagcgagacccccatcatcggcagaagatacgacgagctgcagaacagcagcggcagagacggcaagcccagagccatggccgtgaccagaagcaccagcagcaccagcagcggcagcaacagcaacgtgctggtgcccgtgagctggaagagaccccagtacagccagaagagaaccaaggagaagctggtgcacgtgctgagcctgtgcggccaggaggtgggcctgagcaagaaccccagcgtgatcttcagcagctgcggcgacctggacctgctggagcaccagaccagcctggtgagcagcgaggacggcgccagagagcaggagaacatggacgacaccaacagcgagcagcagttcagagtgttcagagacttcgacttcctggacgtggagctggaggacggcgagggcgagagcatggacaacttcaactggggcgtgagaagaagaagcctggacagcctggacaagtgcgacatgcagatcctggaggagagacagctgagcggcagcacccccagcctgaacaagatgcaccacgaggacagcgacgagagcagcgaggaggaggacctgaccgccagccagatcctggagcacagcgacctgatcatgaccctgagccccagcgaggagaccaaccccatggagctgctgaccaccgcctgcgacagcacccccgccgagccccacagcttcaacaccagaatgagcagcttcgacgccagcctgcccgacatgaacaacctgcagatcagcgagggcagcaaggccgaggccgtgagagaggaggaggacaccaccgtgcacgaggacgacctgagcagcagcatcaacgagctgcccgccgccttcgagtgcagcgacagcttcagcctggacatgaccgagggcgaggagaagggcaacagagccctggaccagttcaccctggccagcttcggcgagggcgacagaggcgtgagccccccccccagccccttcttcagcgccatcctggccgccttccagcccgccgcctgcgacgacgccgaggaggcctggagaagccacatcaaccagctgatgtgcgacagcgacggcagctgcgccgtgtacaccttccacgtgttcagcagcctgttcaagaacatccagaagagattctgcttcctgacctgcgacgccgccagctacctgggcgacaacctgagaggcatcggcagcaagttcgtgagcagcagccagatgctgaccagctgcagcgagtgccccaccctgttcgtggacgccgagaccctgctgagctgcggcctgctggacaagctgaagttcagcgtgctggagctgcaggagtacctggacacctacaacaacagaaaggaggccaccctgagctggctggccaactgcaaggccaccttcgccggcggcagcagagacggcgtgatcacctgccagcccggcgacagcgaggagaagcagctggagctgtgccagagactgtacaagctgcacttccagctgctgctgctgttccagagctactgcaagctgatcggccaggtgcacgaggtgagcagcatgcccgagctgctgaacatgagcagagagctgagcgacctgaagaagcacctgaaggaggccagcgccgtgatcgccgccgaccccctgtacagcgacggcgcctggagcgagcccaccttcaccagcaccgaggccgccatccagagcatgctggagtgcctgaagaacaacgagctgggcaaggccctgagacagatcagagagtgcagaagcctgtggcccaacgacatcttcggcagcagcagcgacgacgaggtgcagaccctgctgaacatctacttcagacaccagaccctgggccagaccggcacctacgccctggtgggcagcaaccagagcctgaccgagatctgcaccaagctgatggagctgaacatggagatcagagacatgatcagaagagcccagagctacagagtgctgaccaccttcctgcccgacagcagcgtgagcggcaccagcctgtag

SEQ ID NO: 18427 - DNA, 3849 bp, Artificial Sequence
  Description of Artificial Sequence: Synthetic coding sequence
atgagcgccgtgctgtgctgcggccccgtgttcgacaacgtgggcctgagccccgacggctacctgtacaagtggctggacaacatcctggcctgccaggacctgagagtgcaccagctgggctgcgaggtggtggtgctgctgctggagctgaaccccgaccagatcaacctgttcaactgggccatcgacagatgctacaccggcagctaccagctggccagcggctgcttcaaggccatcgccaccgtgtgcggcagcagaaactaccccttcgacatcgtgaccctgctgaacctggtgctgttcaaggccagcgacaccaacagagagatctacgagatcagcatgcagctgatgcagatcctggaggccaagctgttcgtgtacagcaagaaggtggccgagcagagacccggcagcatcctgtacggcacccacggccccctgccccccctgtacagcgtgagcctggccctgctgagctgcgagctggccagaatgtaccccgagctgaccctgcccctgttcagcggcaagcccgccatcccccacaacaccccccagagagcccccgaccacgcctacctgcccgccgccctggccgcccagcacagagccggcggccagcaggcccccccccccggcagccccagcagccccgaggacgaggtgaaggacagagagggcgacgtgaccgccagccacggcctgagaggcaacggctggggcagccccgaggccaccagcctggtgctgaacaacctgatgtacatgaccgccaagtacggcgacgaggtgcccggccccgagatggagaacgcctggaacgccctggccaacaacgagaagtggagcaacaacctgagaatcaccctgcagttcctgatcagcctgtgcggcgtgagcagcgacaccgtgctgctgccctacatcaagaaggtggccatctacctgtgcagaaacaacaccatccagaccatggaggagctgctgttcgagctgcagcagaccgagcccgtgaaccccatcgtgcagcactgcgacaacccccccttctacagattcaccgccagcagcaaggccagcgccgccgccagcggcaccaccagcagcagcaacaccgtggtggccggccaggagaacttccccgacgccgaggagaacaagatcctgaaggagagcgacgagagattcagcaacgtgatcagagcccacaccagactggagagcagatacagcaacagcagcggcggcagctacgacgaggacaagaacgaccccatcagcccctacaccggctggctgctgaccatcaccgagaccaagcagccccagcccctgcccatgccctgcaccggcggctgctgggcccccctggtggactacctgcccgagaccatcacccccagaggccccctgcacagatgcaacatcgccgtgatcttcatgaccgagatggtggtggaccacagcgtgagagaggactgggccctgcacctgcccctgctgctgcacgccgtgttcctgggcctggaccactacagacccgaggtgttcgagcacagcaagaagctgctgctgcacctgctgatcgccctgagctgcaacagcaacttccacagcatcgccagcgtgctgctgcagaccagagagatgggcgaggccaagaccctgaccgtgcagcccgcctaccagcccgagtacctgtacaccggcggcttcgacttcctgagagaggaccagagcagccccgtgcccgacagcggcctgagcagcagcagcaccagcagcagcatcagcctgggcggcagcagcggcaacctgccccagatgacccaggaggtggaggacgtggacaccgccgccgagaccgacgagaaggccaacaagctgatcgagttcctgaccaccagagccttcggccccctgtggtgccacgaggacatcacccccaagaaccagaacagcaagagcgccgagcagctgaccaacttcctgagacacgtggtgagcgtgttcaaggacagcaagagcggcttccacctggagcaccagctgagcgaggtggccctgcagaccgccctggccagcagcagcagacactacgccggcagaagcttccagatcttcagagccctgaagcagcccctgagcgcccacgccctgagcgacctgctgagcagactggtggaggtgatcggcgagcacggcgacgagatccagggctacgtgatggaggccctgctgaccctggaggccgccgtggacaacctgagcgactgcctgaagaacagcgacctgctgaccgtgctgagcagaagcagcagccccgacctgagcagcagcagcaagctgaccgccagcagaaagagcaccggccagctgaacatgaaccccggcaccaccagcggcaacaccgccaccgccgagagaagcagacaccagagaagcttcagcgtgcccaagaagttcggcgtgatcgacagaagcagcgacccccccagaagcgccaccctggacagaatccaggcctgcacccagcagggcctgagcagcaagaccagaagcagcagcagcctgaaggacagcctgaccgaccccagccacatcaaccaccccaccaacctgctggccaccatcttctgggtgaccgtggccctgatggagagcgacttcgagttcgagtacctgatggccctgagactgctgagcagactgctggcccacatgcccctggacaaggccgagaacagagagaagctggagaagctgcaggcccagctgaagtgggccgacttcagcggcctgcagcagctgctgctgaagggcttcaccagcctgaccaccaccgacctgaccctgcagctgttcagcctgctgacccccgtgagcaagatcagcatggtggacgccagccacgccatcggcttccccctgaacgtgctgtgcctgctgccccagctgatccagcacttcgagaaccccaaccagttctgcaaggacatcgccgagagaatcgcccaggtgtgcctggaggagaagaaccccaagctgagcaacctggcccacgtgatgaccctgtacaagacccacagctacaccagagactgcgccacctgggtgaacgtggtgtgcagatacctgcacgaggcctacgccgacatcaccctgaacatggtgacctacctggccgagctgctggagaagggcctgcccagcgtgcagcagcccctgctgcaggtgatctacagcctgctgagctacatggacctgagcgtggtgcccgtgaagcagttcaacgtggaggtgctgaagaccatcgagaagtacgtgcagcacagcgacctgagcaagatcgagatccacagagtgtggaccagcgccagcaaggagctgcccggcaagaccctggacttccacttcgacatcagcgagacccccatcatcggcagaagatacgacgagctgcagaacagcagcggcagagacggcaagcccagagccatggccgtgaccagaagcaccagcagcaccagcagcggcagcaacagcaacgtgctggtgcccgtgagctggaagagaccccagtacagccagaagagaaccaaggagaagctggtgcacgtgctgagcctgtgcggccaggaggtgggcctgagcaagaaccccagcgtgatcttcagcagctgcggcgacctggacctgctggagcaccagaccagcctggtgagcagcgaggacggcgccagagagcaggagaacatggacgacaccaacagcgagcagcagttcagagtgttcagagacttcgacttcctggacgtggagctggaggacggcgagtag

SEQ ID NO: 18428 - DNA, 453 bp, Artificial Sequence
  Description of Artificial Sequence: Synthetic coding sequence
atggagatcaccaccgcctgctggagaagaagctgcgtgatcagcttcatcaagggcctggccagccccgtgggcaacggctacatcaagccccccgtgccccccgccagcggcacccacagagagaagggcccccccaccatgctgcccatcaacgtggaccccgacagcaagcccggcgagtacgtgctgaagagcctgttcgtgaacttcaccacccaggccgagagaaagatcagaatcatcatggccgagcccctggagaagcccctgaccaagagcctgcagagaggcgaggacccccagttcgaccaggtgatcagcagcatgagcagcctgagcgagtactgcctgcccagcatcctgagaaccctgttcgactggtacaagagacagaacggcatcgaggacgagagccacgagtacagacccagaaccagcaacaagagctag

SEQ ID NO: 18429 - DNA, 1152 bp, Artificial Sequence
  Description of Artificial Sequence: Synthetic coding sequence
atgaccgagggcgaggagaagggcaacagagccctggaccagttcaccctggccagcttcggcgagggcgacagaggcgtgagccccccccccagccccttcttcagcgccatcctggccgccttccagcccgccgcctgcgacgacgccgaggaggcctggagaagccacatcaaccagctgatgtgcgacagcgacggcagctgcgccgtgtacaccttccacgtgttcagcagcctgttcaagaacatccagaagagattctgcttcctgacctgcgacgccgccagctacctgggcgacaacctgagaggcatcggcagcaagttcgtgagcagcagccagatgctgaccagctgcagcgagtgccccaccctgttcgtggacgccgagaccctgctgagctgcggcctgctggacaagctgaagttcagcgtgctggagctgcaggagtacctggacacctacaacaacagaaaggaggccaccctgagctggctggccaactgcaaggccaccttcgccggcggcagcagagacggcgtgatcacctgccagcccggcgacagcgaggagaagcagctggagctgtgccagagactgtacaagctgcacttccagctgctgctgctgttccagagctactgcaagctgatcggccaggtgcacgaggtgagcagcatgcccgagctgctgaacatgagcagagagctgagcgacctgaagaagcacctgaaggaggccagcgccgtgatcgccgccgaccccctgtacagcgacggcgcctggagcgagcccaccttcaccagcaccgaggccgccatccagagcatgctggagtgcctgaagaacaacgagctgggcaaggccctgagacagatcagagagtgcagaagcctgtggcccaacgacatcttcggcagcagcagcgacgacgaggtgcagaccctgctgaacatctacttcagacaccagaccctgggccagaccggcacctacgccctggtgggcagcaaccagagcctgaccgagatctgcaccaagctgatggagctgaacatggagatcagagacatgatcagaagagcccagagctacagagtgctgaccaccttcctgcccgacagcagcgtgagcggcaccagcctgtag

SEQ ID NO: 18430 - DNA, 270 bp, Artificial Sequence
  Description of Artificial Sequence: Synthetic coding sequence
atggagagagtgaccctggccctgctgctgctggccggcctgaccgccctggaggccaacgaccccttcgccaacaaggacgaccccttctactacgactggaagaacctgcagctgagcggcctgatctgcggcggcctgctggccatcgccggcatcgccgccgtgctgagcggcaagtgcaagtgcaagagcagccagaagcagcacagccccgtgcccgagaaggccatccccctgatcacccccggcagcgccaccacctgctag

SEQ ID NO: 18431 - DNA, 270 bp, Artificial Sequence; identical to SEQ ID NO: 18430
  Description of Artificial Sequence: Synthetic coding sequence

SEQ ID NO: 18432 - DNA, 2340 bp, Artificial Sequence
  Description of Artificial Sequence: Synthetic coding sequence
atgctgaccaacctgagaatcttcgccatgagccaccagaccatccccagcgtgtacatcaacaacatctgctgctacaagatcagagccagcctgaagagactgaagccccacgtgcccctgggcagaaactgcagcagcctgcccggcctgatcggcaacgacatcaagagcctgcacagcatcatcaacccccccatcgccaagatcagaaacatcggcatcatggcccacatcgacgccggcaagaccaccaccaccgagagaatcctgtactacagcggctacaccagaagcctgggcgacgtggacgacggcgacaccgtgaccgacttcatggcccaggagagagagagaggcatcaccatccagagcgccgccgtgaccttcgactggaagggctacagagtgaacctgatcgacacccccggccacgtggacttcaccctggaggtggagagatgcctgagagtgctggacggcgccgtggccgtgttcgacgccagcgccggcgtggaggcccagaccctgaccgtgtggagacaggccgacaagcacaacatccccagaatctgcttcctgaacaagatggacaagaccggcgccagcttcaagtacgccgtggagagcatcagagagaagctgaaggccaagcccctgctgctgcagctgcccatcggcgaggccaagaccttcaagggcgtggtggacgtggtgatgaaggagaagctgctgtggaactgcaacagcaacgacggcaaggacttcgagagaaagcccctgctggagatgaacgaccccgagctgctgaaggagaccaccgaggccagaaacgccctgatcgagcaggtggccgacctggacgacgagttcgccgacctggtgctggaggagttcagcgagaacttcgacctgctgcccgccgagaagctgcagaccgccatccacagagtgaccctggcccagaccgccgtgcccgtgctgtgcggcagcgccctgaagaacaagggcatccagcccctgctggacgccgtgaccatgtacctgcccagccccgaggagagaaactacgagttcctgcagtggtacaaggacgacctgtgcgccctggccttcaaggtgctgcacgacaagcagagaggccccctggtgttcatgagaatctacagcggcaccatcaagccccagctggccatccacaacatcaacggcaactgcaccgagagaatcagcagactgctgctgcccttcgccgaccagcacgtggagatccccagcctgaccgccggcaacatcgccctgaccgtgggcctgaagcacaccgccaccggcgacaccatcgtgagcagcaagagcagcgccctggccgccgccagaagagccgagagagagggcgagaagaagcacagacagaacaacgaggccgagagactgctgctggccggcgtggagatccccgagcccgtgttcttctgcaccatcgagccccccagcctgagcaagcagcccgacctggagcacgccctgaagtgcctgcagagagaggaccccagcctgaaggtgagactggaccccgacagcggccagaccgtgctgtgcggcatgggcgagctgcacatcgagatcatccacgacagaatcaagagagagtacggcctggagacctacctgggccccctgcaggtggcctacagagagaccatcctgaacagcgtgagagccaccgacaccctggacagaaccctgggcgacaagagacacctggtgaccgtggaggtggaggccagacccatcgagaccagcagcgtgatgcccgtgatcgagttcgagtacgccgagagcatcaacgagggcctgctgaaggtgagccaggaggccatcgagaacggcatccacagcgcctgcctgcagggccccctgctgggcagccccatccaggacgtggccatcaccctgcacagcctgaccatccaccccggcaccagcaccaccatgatcagcgcctgcgtgagcagatgcgtgcagaaggccctgaagaaggccgacaagcaggtgctggagcccctgatgaacctggaggtgaccgtggccagagactacctgagccccgtgctggccgacctggcccagagaagaggcaacatccaggagatccagaccagacaggacaacaaggtggtgatcggcttcgtgcccctggccgagatcatgggctacagcaccgtgctgagaaccctgaccagcggcagcgccaccttcgccctggagctgagcacctaccaggccatgaacccccaggaccagaacaccctgctgaacagaagaagcggcctgacctag

SEQ ID NO: 18433 - DNA, 2199 bp, Artificial Sequence
  Description of Artificial Sequence: Synthetic coding sequence
atgctgaccaacctgagaatcttcgccatgagccaccagaccatccccagcgtgtacatcaacaacatctgctgctacaagatcagagccagcctgaagagactgaagccccacgtgcccctgggcagaaactgcagcagcctgcccggcctgatcggcaacgacatcaagagcctgcacagcatcatcaacccccccatcgccaagatcagaaacatcggcatcatggcccacatcgacgccggcaagaccaccaccaccgagagaatcctgtactacagcggctacaccagaagcctgggcgacgtggacgacggcgacaccgtgaccgacttcatggcccaggagagagagagaggcatcaccatccagagcgccgccgtgaccttcgactggaagggctacagagtgaacctgatcgacacccccggccacgtggacttcaccctggaggtggagagatgcctgagagtgctggacggcgccgtggccgtgttcgacgccagcgccggcgtggaggcccagaccctgaccgtgtggagacaggccgacaagcacaacatccccagaatctgcttcctgaacaagatggacaagaccggcgccagcttcaagtacgccgtggagagcatcagagagaagctgaaggccaagcccctgctgctgcagctgcccatcggcgaggccaagaccttcaagggcgtggtggacgtggtgatgaaggagaagctgctgtggaactgcaacagcaacgacggcaaggacttcgagagaaagcccctgctggagatgaacgaccccgagctgctgaaggagaccaccgaggccagaaacgccctgatcgagcaggtggccgacctggacgacgagttcgccgacctggtgctggaggagttcagcgagaacttcgacctgctgcccgccgagaagctgcagaccgccatccacagagtgaccctggcccagaccgccgtgcccgtgctgtgcggcagcgccctgaagaacaagggcatccagcccctgctggacgccgtgaccatgtacctgcccagccccgaggagagaaactacgagttcctggagagaatcagcagactgctgctgcccttcgccgaccagcacgtggagatccccagcctgaccgccggcaacatcgccctgaccgtgggcctgaagcacaccgccaccggcgacaccatcgtgagcagcaagagcagcgccctggccgccgccagaagagccgagagagagggcgagaagaagcacagacagaacaacgaggccgagagactgctgctggccggcgtggagatccccgagcccgtgttcttctgcaccatcgagccccccagcctgagcaagcagcccgacctggagcacgccctgaagtgcctgcagagagaggaccccagcctgaaggtgagactggaccccgacagcggccagaccgtgctgtgcggcatgggcgagctgcacatcgagatcatccacgacagaatcaagagagagtacggcctggagacctacctgggccccctgcaggtggcctacagagagaccatcctgaacagcgtgagagccaccgacaccctggacagaaccctgggcgacaagagacacctggtgaccgtggaggtggaggccagacccatcgagaccagcagcgtgatgcccgtgatcgagttcgagtacgccgagagcatcaacgagggcctgctgaaggtgagccaggaggccatcgagaacggcatccacagcgcctgcctgcagggccccctgctgggcagccccatccaggacgtggccatcaccctgcacagcctgaccatccaccccggcaccagcaccaccatgatcagcgcctgcgtgagcagatgcgtgcagaaggccctgaagaaggccgacaagcaggtgctggagcccctgatgaacctggaggtgaccgtggccagagactacctgagccccgtgctggccgacctggcccagagaagaggcaacatccaggagatccagaccagacaggacaacaaggtggtgatcggcttcgtgcccctggccgagatcatgggctacagcaccgtgctgagaaccctgaccagcggcagcgccaccttcgccctggagctgagcacctaccaggccatgaacccccaggaccagaacaccctgctgaacagaagaagcggcctgacctag

SEQ ID NO: 18434 - DNA, 1542 bp, Artificial Sequence
  Description of Artificial Sequence: Synthetic coding sequence
atgctgaccaacctgagaatcttcgccatgagccaccagaccatccccagcgtgtacatcaacaacatctgctgctacaagatcagagccagcctgaagagactgaagccccacgtgcccctgggcagaaactgcagcagcctgcccggcctgatcggcaacgacatcaagagcctgcacagcatcatcaacccccccatcgccaagatcagaaacatcggcatcatggcccacatcgacgccggcaagaccaccaccaccgagagaatcctgtactacagcggctacaccagaagcctgggcgacgtggacgacggcgacaccgtgaccgacttcatggcccaggagagagagagaggcatcaccatccagagcgccgccgtgaccttcgactggaagggctacagagtgaacctgatcgacacccccggccacgtggacttcaccctggaggtggagagatgcctgagagtgctggacggcgccgtggccgtgttcgacgccagcgccggcgtggaggcccagaccctgaccgtgtggagacaggccgacaagcacaacatccccagaatctgcttcctgaacaagatggacaagaccggcgccagcttcaagtacgccgtggagagcatcagagagaagctgaaggccaagcccctgctgctgcagctgcccatcggcgaggccaagaccttcaagggcgtggtggacgtggtgatgaaggagaagctgctgtggaactgcaacagcaacgacggcaaggacttcgagagaaagcccctgctggagatgaacgaccccgagctgctgaaggagaccaccgaggccagaaacgccctgatcgagcaggtggccgacctggacgacgagttcgccgacctggtgctggaggagttcagcgagaacttcgacctgctgcccgccgagaagctgcagaccgccatccacagagtgaccctggcccagaccgccgtgcccgtgctgtgcggcagcgccctgaagaacaagggcatccagcccctgctggacgccgtgaccatgtacctgcccagccccgaggagagaaactacgagttcctgcagtggtacaaggacgacctgtgcgccctggccttcaaggtgctgcacgacaagcagagaggccccctggtgttcatgagaatctacagcggcaccatcaagccccagctggccatccacaacatcaacggcaactgcaccgagagaatcagcagactgctgctgcccttcgccgaccagcacgtggagatccccagcctgaccgccggcaacatcgccctgaccgtgggcctgaagcacaccgccaccggcgacaccatcgtgagcagcaagagcagcgccctggccgccgccagaagagccgagagagagggcgagaagaagcacagacagaacaacgaggccgagagactgctgctggccggcgtggagatccccgagcccgtgttcttctgcaccatcgagccccccagcctgagcaagcagcccggcatcaacggcctgagcgtgagcaccaactag

SEQ ID NO: 18435 - DNA, 2340 bp, Artificial Sequence; identical to SEQ ID NO: 18432
  Description of Artificial Sequence: Synthetic coding sequence

SEQ ID NO: 18436 - DNA, 1806 bp, Artificial Sequence
  Description of Artificial Sequence: Synthetic coding sequence
atgctgaccaacctgagaatcttcgccatgagccaccagaccatccccagcgtgtacatcaacaacatctgctgctacaagatcagagccagcctgaagagactgaagccccacgtgcccctgggcagaaactgcagcagcctgcccggcctgatcggcaacgacatcaagagcctgcacagcatcatcaacccccccatcgccaagatcagaaacatcggcatcatggcccacatcgacgccggcaagaccaccaccaccgagagaatcctgtactacagcggctacaccagaagcctgggcgacgtggacgacggcgacaccgtgaccgacttcatggcccaggagagagagagaggcatcaccatccagagcgccgccgtgaccttcgactggaagggctacagagtgaacctgatcgacacccccggccacgtggacttcaccctggaggtggagagatgcctgagagtgctggacggcgccgtggccgtgttcgacgccagcgccggcgtggaggcccagaccctgaccgtgtggagacaggccgacaagcacaacatccccagaatctgcttcctgaacaagatggacaagaccggcgccagcttcaagtacgccgtggagagcatcagagagaagctgaaggccaagcccctgctgctgcagctgcccatcggcgaggccaagaccttcaagggcgtggtggacgtggtgatgaaggagaagctgctgtggaactgcaacagcaacgacggcaaggacttcgagagaaagcccctgctggagatgaacgaccccgagctgctgaaggagaccaccgaggccagaaacgccctgatcgagcaggtggccgacctggacgacgagttcgccgacctggtgctggaggagttcagcgagaacttcgacctgctgcccgccgagaagctgcagaccgccatccacagagtgaccctggcccagaccgccgtgcccgtgctgtgcggcagcgccctgaagaacaagggcatccagcccctgctggacgccgtgaccatgtacctgcccagccccgaggagagaaactacgagttcctgcagtggtacaaggacgacctgtgcgccctggccttcaaggtgctgcacgacaagcagagaggccccctggtgttcatgagaatctacagcggcaccatcaagccccagctggccatccacaacatcaacggcaactgcaccgagagaatcagcagactgctgctgcccttcgccgaccagcacgtggagatccccagcctgaccgccggcaacatcgccctgaccgtgggcctgaagcacaccgccaccggcgacaccatcgtgagcagcaagagcagcgccctggccgccgccagaagagccgagagagagggcgagaagaagcacagacagaacaacgaggccgagagactgctgctggccggcgtggagatccccgagcccgtgttcttctgcaccatcgagccccccagcctgagcaagcagcccgacctggagcacgccctgaagtgcctgcagagagaggaccccagcctgaaggtgagactggaccccgacagcggccaggtggcccagagaagaggcaacatccaggagatccagaccagacaggacaacaaggtggtgatcggcttcgtgcccctggccgagatcatgggctacagcaccgtgctgagaaccctgaccagcggcagcgccaccttcgccctggagctgagcacctaccaggccatgaacccccaggaccagaacaccctgctgaacagaagaagcggcctgacctag

SEQ ID NO: 18437 - DNA, 948 bp, Artificial Sequence
  Description of Artificial Sequence: Synthetic coding sequence
atggccagcgccgtgctgagcagcgtgcccaccaccgccagcagattcgccctgctgcaggtggacagcggcagcggcagcgacagcgagcccggcaagggcaagggcagaaacaccggcaagagccagaccctgggcagcaagagcaccaccaacgagaagaagagagagaagagaagaaagaagaaggagcagcagcagagcgaggccaacgagctgagaaacctggccttcaagaagatcccccagaagagcagccacgccgtgtgcaacgcccagcacgacctgcccctgagcaaccccgtgcagaaggacagcagagaggagaactggcaggagtggagacagagagacgagcagctgaccagcgagatgttcgaggccgacctggagaaggccctgctgctgagcaagctggagtacgaggagcacaagaaggagtacgaggacgccgagaacaccagcacccagagcaaggtgatgaacaagaaggacaagagaaagaaccaccagggcaaggacagacccctgaccgtgagcctgaaggacttccacagcgaggaccacatcagcaagaagaccgaggaggtggtgctgaaggacggcagaatcgagagactgaagctggagctggagagaaaggacgccgagatccagaagctgaagaacgtgatcacccagtgggaggccaagtacaaggaggtgaaggccagaaacgcccagctgctgaagatgctgcaggagggcgagatgaaggacaaggccgagatcctgctgcaggtggacgagagccagagcatcaagaacgagctgaccatccaggtgaccagcctgcacgccgccctggagcaggagagaagcaaggtgaaggtgctgcaggccgagctggccaagtaccagggcggcagaaagggcaagagaaacagcgagagcgaccagtgcagatag

SEQ ID NO: 18438 - DNA, 1101 bp, Artificial Sequence
  Description of Artificial Sequence: Synthetic coding sequence
atggccagcgccgtgctgagcagcgtgcccaccaccgccagcagattcgccctgctgcaggtggacagcggcagcggcagcgacagcgagcccggcaagggcaagggcagaaacaccggcaagagccagaccctgggcagcaagagcaccaccaacgagaagaagagagagaagagaagaaagaagaaggagcagcagcagagcgaggccaacgagctgagaaacctggccttcaagaagatcccccagaagagcagccacgccgtgtgcaacgcccagcacgacctgcccctgagcaaccccgtgcagaaggacagcagagaggagaactggcaggagtggagacagagagacgagcagctgaccagcgagatgttcgaggccgacctggagaaggccctgctgctgagcaagctggagtacgaggagcacaagaaggagtacgaggacgccgagaacaccagcacccagagcaaggtgatgaacaagaaggacaagagaaagaaccaccagggcaaggacagacccctgaccgtgagcctgaaggacttccacagcgaggaccacatcagcaagaagaccgaggagctgagcagcagccagaccctgagccacgacggcggcttcttcaacagactggaggacgacgtgcacaagatcctgatcagagagaagagaagagagcagctgaccgagtacaacggcaccgacaactgcaccgcccacgagcacaaccaggaggtggtgctgaaggacggcagaatcgagagactgaagctggagctggagagaaaggacgccgagatccagaagctgaagaacgtgatcacccagtgggaggccaagtacaaggaggtgaaggccagaaacgcccagctgctgaagatgctgcaggagggcgagatgaaggacaaggccgagatcctgctgcaggtggacgagagccagagcatcaagaacgagctgaccatccaggtgaccagcctgcacgccgccctggagcaggagagaagcaaggtgaaggtgctgcaggccgagctggccaagtaccagggcggcagaaagggcaagagaaacagcgagagcgaccagtgcagatag

SEQ ID NO: 18439 - DNA, 381 bp, Artificial Sequence
  Description of Artificial Sequence: Synthetic coding sequence
atggccagcgccgtgctgagcagcgtgcccaccaccgccagcagattcgccctgctgcaggtggacagcggcagcggcagcgacagcgagcccggcaagggcaagggcagaaacaccggcaagagccagaccctgggcagcaagagcaccaccaacgagaagaagagagagaagagaagaaagaagaaggagcagcagcagagcgaggccaacgagctgagaaacctggccttcaagaagatcccccagaagagcagccacgccgtgtgcaacgcccagcacgacctgcccctgagcaaccccgtgcagaaggacagcagagaggagaactggcaggagtggagacagagagacgagcagatgggcagcagaagacagtag

SEQ ID NO: 18440 - DNA, 165 bp, Artificial Sequence
  Description of Artificial Sequence: Synthetic coding sequence
atggccagcgccgtgctgagcagcgtgcccaccaccgccagcagattcgccctgctgcaggtggacagcggcagcggcagcgacagcgagcccggcaagggcaagggcagaaacaccggcaagagccagaccctgggcagcaagagcaccaccaacgagaagtag

SEQ ID NO: 18441 - DNA, 3027 bp, Artificial Sequence
  Description of Artificial Sequence: Synthetic coding sequence
atggacaccgccgaggaccccgcctggctgcagctgctgcagaaggacagcagcccccccggccccagacccaccgccttcttctgcccccaggacggcagcctgggcgccggcagcagcgccatgagagactactgccccagccagcagaaggccagccccgccccccccagacacacccccgaccagagccccggcatggagagcagacacagaagccccagcggcgccggcgagggcgccagctgcagcgacggccccagaggcagcctggcctgccccagccccacctgcttcagcccccaggagagccccagcaaggagaccctggaggcccacggcgccagcatcagcggcacccccgaggccaccaccagcggcaagcccgagcccgtgagcagcgtgaagaccgagcccaagagcagcgacgacagaaaccccatgttcctggagaagatggacttcaagagcagcaagcaggccgacagcaccagcatcggcaaggaggaccccggcagcagcagaaaggccgaccccatgttcaccggcaaggccgagcccgagatcctgggcaagggcgaccccgtggcccccggcagaatggaccccatgaccgtgagaaaggaggacctgggcagcctgggcaaggtggaccccctgtgcagcagcaagacctacaccgtgagccccagaaaggaggaccccggcagcctgagaaaggtggaccccgtgagcagcgacaaggtggaccccgtgttccccagaaaggaggagcccagatacagcggcaaggagcaccccgtgagcagcgagaaggtggcccccaccagcgccgagaaggtggacctggtgctgagcggcaagagagaccccggccccagcggcaaggccgaccccatgcccctggagagcatggacagcgccagcaccggcaagaccgagcccggcctgctgggcaagctgatccccggcagcagcggcaagaacggccccgtgagcagcggcaccggcgcccccggcagcctgggcagactggaccccacctgcctgggcatggccgaccccgccagcgtgggcaacgtggagaccgtgcccgccaccaaggaggacagcagattcctgggcaagatggaccccgccagcagcggcgagggcagacccgtgagcggccacaccgacaccaccgccagcgccaagaccgacctgaccagcctgaagaacgtggaccccatgagcagcggcaaggtggaccccgtgagcctgggcaagatggaccccatgtgcagcggcaagcccgagctgctgagccccggccaggccgagagagtgagcgtgggcaaggccggcaccgtgagccccggcaaggaggaccccgtgagcagcagaagagaggaccccatcagcgccggcagcagaaagaccagcagcgagaaggtgaaccccgagagcagcggcaagaccaaccccgtgagcagcggccccggcgaccccagaagcctgggcaccgccggcccccccagcgccgtgaaggccgagcccgccaccggcggcaagggcgaccccctgagcagcgagaaggccggcctggtggccagcggcaaggccgcccccaccgccagcggcaaggccgagcccctggccgtgggcaaggaggaccccgtgagcaagggcaaggccgacgccggccccagcggccagggcgacagcgtgagcatcggcaaggtggtgagcacccccggcaagaccgtgcccgtgcccagcggcaaggtggaccccgtgagcctgggcaaggccgaggccatccccgagggcaaggtgggcagcctgcccctggagaagggcagccccgtgaccaccaccaaggccgaccccagagccagcggcaaggcccagccccagagcggcggcaaggccgagaccaagctgcccggccaggagggcgccgccgcccccggcgaggccggcgccgtgtgcctgaagaaggagaccccccaggccagcgagaaggtggaccccggcagctgcagaaaggccgagcccctggccagcggcaagggcgagcccgtgagcctgggcaaggccgacagcgcccccagcagaaagaccgagagccccagcctgggcaaggtggtgcccctgagcctggagaagaccaagcccagcagcagcagcagacagctggacagaaaggccctgggcagcgccagaagccccgagggcgccagaggcagcgagggcagagtggagcccaaggccgagcccgtgagcagcaccgaggccagcagcctgggccagaaggacctggaggccgccggcgccgagagaagcccctgccccgaggccgccgcccccccccccggccccagaaccagagacaacttcaccaaggcccccagctgggaggccagcgccccccccccccccagagaggacgccggcacccaggccggcgcccaggcctgcgtgagcgtggccgtgagccccatgagcccccaggacggcgccggcggcagcgccttcagcttccaggccgcccccagagcccccagcccccccagcagaagagacgccggcctgcaggtgagcctgggcgccgccgagaccagaagcgtggccaccggccccatgaccccccaggccgccgccccccccgccttccccgaggtgagagtgagacccggcagcgccctggccgccgccgtggccccccccgagcccgccgagcccgtgagagacgtgagctgggacgagaagggcatgacctgggaggtgtacggcgccgccatggaggtggaggtgctgggcatggccatccagaagcacctggagagacagatcgaggagcacggcagacagggcgcccccgcccccccccccgccgccagagccggccccggcagaagcggcagcgtgagaaccgccccccccgacggcgccgccaagagaccccccggcctgttcagagccctgctgcagagcgtgagaagacccagatgctgcagcagagccggccccaccgccgagtag

SEQ ID NO: 18442 - DNA, 2397 bp, Artificial Sequence
  Description of Artificial Sequence: Synthetic coding sequence
atggacaccgccgaggaccccgcctggctgcagctgctgcagaaggacagcagcccccccggccccagacccaccgccttcttctgcccccaggacggcagcctgggcgccggcagcagcgccatgagagactactgccccagccagcagaaggccagccccgccccccccagacacacccccgaccagagccccggcatggagagcagacacagaagccccagcggcgccggcgagggcgccagctgcagcgacggccccagaggcagcctggcctgccccagccccacctgcttcagcccccaggagagccccagcaaggagaccctggaggcccacggcgccagcatcagcggcacccccgaggccaccaccagcggcaagcccgagcccgtgagcagcgtgaagaccgagcccaagagcagcgacgacagaaaccccatgttcctggagaagatggacttcaagagcagcaagcaggccgacagcaccagcatcggcaaggaggaccccggcagcagcagaaaggccgaccccatgttcaccggcaaggccgagcccgagatcctgggcaagggcgaccccgtggcccccggcagaatggaccccatgaccgtgagaaaggaggacctgggcagcctgggcaaggtggaccccctgtgcagcagcaagacctacaccgtgagccccagaaaggaggaccccggcagcctgagaaaggtggaccccgtgagcagcgacaaggtggaccccgtgttccccagaaaggaggagcccagatacagcggcaaggagcaccccgtgagcagcgagaaggtggcccccaccagcgccgagaaggtggacctggtgctgagcggcaagagagaccccggccccagcggcaaggccgaccccatgcccctggagagcatggacagcgccagcaccggcaagaccgagcccggcctgctgggcaagctgatccccggcagcagcggcaagaacggccccgtgagcagcggcaccggcgcccccggcagcctgggcagactggaccccacctgcctgggcatggccgaccccgccagcgtgggcaacgtggagaccgtgcccgccaccaaggaggacagcagattcctgggcaagatggaccccgccagcagcggcgagggcagacccgtgagcggccacaccgacaccaccgccagcgccaagaccgacctgaccagcctgaagaacgtggaccccatgagcagcggcaaggtggaccccgtgagcctgggcaagatggaccccatgtgcagcggcaagcccgagctgctgagccccggccaggccgagagagtgagcgtgggcaaggccggcaccgtgagccccggcaaggaggaccccgtgagcagcagaagagaggaccccatcagcgccggcagcagaaagaccagcagcgagaaggtgaaccccgagagcagcggcaagaccaaccccgtgagcagcggccccggcgaccccagaagcctgggcaccgccggcccccccagcgccgtgaaggccgagcccgccaccggcggcaagggcgaccccctgagcagcgagaaggccggcctggtggccagcggcaaggccgcccccaccgccagcggcaaggccgagcccctggccgtgggcaaggaggaccccgtgagcaagggcaaggccgacgccggccccagcggccagggcgacagcgtgagcatcggcaaggtggtgagcacccccggcaagaccgtgcccgtgcccagcggcaaggtggaccccgtgagcctgggcaaggccgaggccatccccgagggcaaggtgggcagcctgcccctggagaagggcagccccgtgaccaccaccaaggccgaccccagagccagcggcaaggcccagccccagagcggcggcaaggccgagaccaagctgcccggccaggagggcgccgccgcccccggcgaggccggcgccgtgtgcctgaagaaggagaccccccaggccagcgagaaggtggaccccggcagctgcagaaaggccgagcccctggccagcggcaagggcgagcccgtgagcctgggcaaggccgacagcgcccccagcagaaagaccgagagccccagcctgggcaaggtggtgcccctgagcctggagaagaccaagcccagcagcagcagcagacagctggacagaaaggccctgggcagcgccagaagccccgagggcgccagaggcagcgagggcagacaggccagcgccagacccgtgcccagagccgccgccgagtgcgcccccgccgccgtgctgctggccggcggcacccacggcagagtgatctgcccccacttcgtgagacccagcttcagacccagccaggcccccttcctgatcaccggcccctag

SEQ ID NO: 18443 - DNA, 1659 bp, Artificial Sequence
  Description of Artificial Sequence: Synthetic coding sequence
atggccgccctggcccccgtgggcagccccgccagcagaggccccagactggccgccggcctgagactgctgcccatgctgggcctgctgcagctgctggccgagcccggcctgggcagagtgcaccacctggccctgaaggacgacgtgagacacaaggtgcacctgaacaccttcggcttcttcaaggacggctacatggtggtgaacgtgagcagcctgagcctgaacgagcccgaggacaaggacgtgaccatcggcttcagcctggacagaaccaagaacgacggcttcagcagctacctggacgaggacgtgaactactgcatcctgaagaagcagagcgtgagcgtgaccctgctgatcctggacatcagcagaagcgaggtgagagtgaagagcccccccgaggccggcacccagctgcccaagatcatcttcagcagagacgagaaggtgctgggccagagccaggagcccaacgtgaaccccgccagcgccggcaaccagacccagaagacccaggacggcggcaagagcaagagaagcaccgtggacagcaaggccatgggcgagaagagcttcagcgtgcacaacaacggcggcgccgtgagcttccagttcttcttcaacatcagcaccgacgaccaggagggcctgtacagcctgtacttccacaagtgcctgggcaaggagctgcccagcgacaagttcaccttcagcctggacatcgagatcaccgagaagaaccccgacagctacctgagcgccggcgagatccccctgcccaagctgtacatcagcatggccttcttcttcttcctgagcggcaccatctggatccacatcctgagaaagagaagaaacgacgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggcgccctgctgttcatcaccatcgccctgatcggcaccggctgggccttcatcaagcacatcctgagcgacaaggacaagaagatcttcatgatcgtgatccccctgcaggtgctggccaacgtggcctacatcatcatcgagagcaccgaggagggcaccaccgagtacggcctgtggaaggacagcctgttcctggtggacctgctgtgctgcggcgccatcctgttccccgtggtgtggagcatcagacacctgcaggaggccagcgccaccgacggcaaggccgccatcaacctggccaagctgaagctgttcagacactactacgtgctgatcgtgtgctacatctacttcaccagaatcatcgccttcctgctgaagctggccgtgcccttccagtggaagtggctgtaccagctgctggacgagaccgccaccctggtgttcttcgtgctgaccggctacaagttcagacccgccagcgacaacccctacctgcagctgagccaggaggaggaggacctggagatggagagcgtggtgaccaccagcggcgtgatggagagcatgaagaaggtgaagaaggtgaccaacggcagcgtggagccccagggcgagtgggagggcgccgtgtag

SEQ ID NO: 18444 - DNA, 1803 bp, Artificial Sequence
  Description of Artificial Sequence: Synthetic coding sequence
atggccgccctggcccccgtgggcagccccgccagcagaggccccagactggccgccggcctgagactgctgcccatgctgggcctgctgcagctgctggccgagcccggcctgggcagagtgcaccacctggccctgaaggacgacgtgagacacaaggtgcacctgaacaccttcggcttcttcaaggacggctacatggtggtgaacgtgagcagcctgagcctgaacgagcccgaggacaaggacgtgaccatcggcttcagcctggacagaaccaagaacgacggcttcagcagctacctggacgaggacgtgaactactgcatcctgaagaagcagagcgtgagcgtgaccctgctgatcctggacatcagcagaagcgaggtgagagtgaagagcccccccgaggccggcacccagctgcccaagatcatcttcagcagagacgagaaggtgctgggccagagccaggagcccaacgtgaaccccgccagcgccggcaaccagacccagaagacccaggacggcggcaagagcaagagaagcaccgtggacagcaaggccatgggcgagaagagcttcagcgtgcacaacaacggcggcgccgtgagcttccagttcttcttcaacatcagcaccgacgaccaggagggcctgtacagcctgtacttccacaagtgcctgggcaaggagctgcccagcgacaagttcaccttcagcctggacatcgagatcaccgagaagaaccccgacagctacctgagcgccggcgagatccccctgcccaagctgtacatcagcatggccttcttcttcttcctgagcggcaccatctggatccacatcctgagaaagagaagaaacgacgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggcgccctgctgttcatcaccatcgccctgatcggcaccggctgggccttcatcaagcacatcctgagcgacaaggacaagaagatcttcatgatcgtgatccccctgcaggtgctggccaacgtggcctacatcatcatcgagagcaccgaggagggcaccaccgagtacggcctgtggaaggacagcctgttcctggtggacctgctgtgctgcggcgccatcctgttccccgtggtgtggagcatcagacacctgcaggaggccagcgccaccgacggcaagggcgacagcatgggccccctgcagcagagagccaacctgagagccggcagcagaatcgagagccaccacttcgcccaggccgacctggagctgctggccagcagctgcccccccgccagcgtgagccagagagccggcatcaccgccgccatcaacctggccaagctgaagctgttcagacactactacgtgctgatcgtgtgctacatctacttcaccagaatcatcgccttcctgctgaagctggccgtgcccttccagtggaagtggctgtaccagctgctggacgagaccgccaccctggtgttcttcgtgctgaccggctacaagttcagacccgccagcgacaacccctacctgcagctgagccaggaggaggaggacctggagatggagagcgtggtgaccaccagcggcgtgatggagagcatgaagaaggtgaagaaggtgaccaacggcagcgtggagccccagggcgagtgggagggcgccgtgtag

SEQ ID NO: 18445 - DNA, 1716 bp, Artificial Sequence
  Description of Artificial Sequence: Synthetic coding sequence
atggccgccctggcccccgtgggcagccccgccagcagaggccccagactggccgccggcctgagactgctgcccatgctgggcctgctgcagctgctggccgagcccggcctgggcagagtgcaccacctggccctgaaggacgacgtgagacacaaggtgcacctgaacaccttcggcttcttcaaggacggctacatggtggtgaacgtgagcagcctgagcctgaacgagcccgaggacaaggacgtgaccatcggcttcagcctggacagaaccaagaacgacggcttcagcagctacctggacgaggacgtgaactactgcatcctgaagaagcagagcgtgagcgtgaccctgctgatcctggacatcagcagaagcgaggtgagagtgaagagcccccccgaggccggcacccagctgcccaagatcatcttcagcagagacgagaaggtgctgggccagagccaggagcccaacgtgaaccccgccagcgccggcaaccagacccagaagacccaggacggcggcaagagcaagagaagcaccgtggacagcaaggccatgggcgagaagagcttcagcgtgcacaacaacggcggcgccgtgagcttccagttcttcttcaacatcagcaccgacgaccaggagggcctgtacagcctgtacttccacaagtgcctgggcaaggagctgcccagcgacaagttcaccttcagcctggacatcgagatcaccgagaagaaccccgacagctacctgagcgccggcgagatccccctgcccaagctgtacatcagcatggccttcttcttcttcctgagcggcaccatctggatccacatcctgagaaagagaagaaacgacgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggcgccctgctgttcatcaccatcgccctgatcggcaccggctgggccttcatcaagcacatcctgagcgacaaggacaagaagatcttcatgatcgtgatccccctgcaggtgctggccaacgtggcctacatcatcatcgagagcaccgaggagggcaccaccgagtacggcctgtggaaggacagcctgttcctggtggacctgctgtgctgcggcgccatcctgttccccgtggtgtggagcatcagacacctgcaggaggccagcgccaccgacggcaagggcgacagcatgggccccctgcagcagagagccaacctgagagccggcagcagaatcgccgccatcaacctggccaagctgaagctgttcagacactactacgtgctgatcgtgtgctacatctacttcaccagaatcatcgccttcctgctgaagctggccgtgcccttccagtggaagtggctgtaccagctgctggacgagaccgccaccctggtgttcttcgtgctgaccggctacaagttcagacccgccagcgacaacccctacctgcagctgagccaggaggaggaggacctggagatggagagcgtggtgaccaccagcggcgtgatggagagcatgaagaaggtgaagaaggtgaccaacggcagcgtggagccccagggcgagtgggagggcgccgtgtag

SEQ ID NO: 18446 - DNA, 1140 bp, Artificial Sequence
  Description of Artificial Sequence: Synthetic coding sequence
atggccgccctggcccccgtgggcagccccgccagcagaggccccagactggccgccggcctgagactgctgcccatgctgggcctgctgcagctgctggccgagcccggcctgggcagagtgcaccacctggccctgaaggacgacgtgagacacaaggtgcacctgaacaccttcggcttcttcaaggacggctacatggtggtgaacgtgagcagcctgagcctgaacgagcccgaggacaaggacgtgaccatcggcttcagcctggacagaaccaagaacgacggcttcagcagctacctggacgaggacgtgaactactgcatcctgaagaagcagagcgtgagcgtgaccctgctgatcctggacatcagcagaagcgaggtgagagtgaagagcccccccgaggccggcacccagctgcccaagatcatcttcagcagagacgagaaggtgctgggccagagccaggagcccaacgtgaaccccgccagcgccggcaaccagacccagaagacccaggacggcggcaagagcaagagaagcaccgtggacagcaaggccatgggcgagaagagcttcagcgtgcacaacaacggcggcgccgtgagcttccagttcttcttcaacatcagcaccgacgaccaggagggcctgtacagcctgtacttccacaagtgcctgggcaaggagctgcccagcgacaagttcaccttcagcctggacatcgagatcaccgagaagaaccccgacagctacctgagcgccggcgagatccccctgcccaagctgtacatcagcatggccttcttcttcttcctgagcggcaccatctggatccacatcctgagaaagagaagaaacgacgtgttcaagatccactggctgatggccgccctgcccttcaccaagagcctgagcctggtgttccacgccatcgactaccactacatcagcagccagggcttccccatcgagggctgggccgtggtgtactacatcacccacctgctgaagggcgccctgctgttcatcaccatcgccctgatcggcaccggctgggccttcatcaagcacatcctgagcgacaaggacaagaagatcttcatgatcgtgatccccctgcaggtgctgtag

SEQ ID NO: 18447 - DNA, 1632 bp, Artificial Sequence
  Description of Artificial Sequence: Synthetic coding sequence
atggccgtgagcgagagaagaggcctgggcagaggcagccccgccgagtggggccagagactgctgctggtgctgctgctgggcggctgcagcggcagaatccaccagctggccctgaccggcgagaagagagccgacatccagctgaacagcttcggcttctacaccaacggcagcctggaggtggagctgagcgtgctgagactgggcctgagagaggccgaggagaagagcctgctggtgggcttcagcctgagcagagtgagaagcggcagagtgagaagctacagcaccagagacttccaggactgccccctgcagaagaacagcagcagcttcctggtgctgttcctgatcaacaccaaggacctgcaggtgcaggtgagaaagtacggcgagcagaagaccctgttcatcttccccggcctgctgcccgaggcccccagcaagcccggcctgcccaagccccaggccaccgtgcccagaaaggtggacggcggcggcaccagcgccgccagcaagcccaagagcacccccgccgtgatccagggccccagcggcaaggacaaggacctggtgctgggcctgagccacctgaacaacagctacaacttcagcttccacgtggtgatcggcagccaggccgaggagggccagtacagcctgaacttccacaactgcaacaacagcgtgcccggcaaggagcaccccttcgacatcaccgtgatgatcagagagaagaaccccgacggcttcctgagcgccgccgagatgcccctgttcaagctgtacatggtgatgagcgcctgcttcctggccgccggcatcttctgggtgagcatcctgtgcagaaacacctacagcgtgttcaagatccactggctgatggccgccctggccttcaccaagagcatcagcctgctgttccacagcatcaactactacttcatcaacagccagggccaccccatcgagggcctggccgtgatgtactacatcgcccacctgctgaagggcgccctgctgttcatcaccatcgccctgatcggcagcggctgggccttcatcaagtacgtgctgagcgacaaggagaagaaggtgttcggcatcgtgatccccatgcaggtgctggccaacgtggcctacatcatcatcgagagcagagaggagggcgccagcgactacgtgctgtggaaggagatcctgttcctggtggacctgatctgctgcggcgccatcctgttccccgtggtgtggagcatcagacacctgcaggacgccagcggcaccgacggcaaggtggccgtgaacctggccaagctgaagctgttcagacactactacgtgatggtgatctgctacgtgtacttcaccagaatcatcgccatcctgctgcaggtggccgtgcccttccagtggcagtggctgtaccagctgctggtggagggcagcaccctggccttcttcgtgctgaccggctacaagttccagcccaccggcaacaacccctacctgcagctgccccaggaggacgaggaggacgtgcagatggagcaggtgatgaccgacagcggcttcagagagggcctgagcaaggtgaacaagaccgccagcggcagagagctgctgtag

SEQ ID NO: 18448 - DNA, 906 bp, Artificial Sequence
  Description of Artificial Sequence: Synthetic coding sequence
atgatcagagagaagaaccccgacggcttcctgagcgccgccgagatgcccctgttcaagctgtacatggtgatgagcgcctgcttcctggccgccggcatcttctgggtgagcatcctgtgcagaaacacctacagcgtgttcaagatccactggctgatggccgccctggccttcaccaagagcatcagcctgctgttccacagcatcaactactacttcatcaacagccagggccaccccatcgagggcctggccgtgatgtactacatcgcccacctgctgaagggcgccctgctgttcatcaccatcgccctgatcggcagcggctgggccttcatcaagtacgtgctgagcgacaaggagaagaaggtgttcggcatcgtgatccccatgcaggtgctggccaacgtggcctacatcatcatcgagagcagagaggagggcgccagcgactacgtgctgtggaaggagatcctgttcctggtggacctgatctgctgcggcgccatcctgttccccgtggtgtggagcatcagacacctgcaggacgccagcggcaccgacggcaaggtggccgtgaacctggccaagctgaagctgttcagacactactacgtgatggtgatctgctacgtgtacttcaccagaatcatcgccatcctgctgcaggtggccgtgcccttccagtggcagtggctgtaccagctgctggtggagggcagcaccctggccttcttcgtgctgaccggctacaagttccagcccaccggcaacaacccctacctgcagctgccccaggaggacgaggaggacgtgcagatggagcaggtgatgaccgacagcggcttcagagagggcctgagcaaggtgaacaagaccgccagcggcagagagctgctgtag

SEQ ID NO: 18449 - DNA, 2142 bp, Artificial Sequence
  Description of Artificial Sequence: Synthetic coding sequence
atggacatcagcatccagagaaacggcagcatcgtggccggctacgaggtggtgggcagcagcagcgccagcgagctgctgagcgccatcgagcacgtggccgagaaggccaagaccgccctgcacaagctgttccccctggaggacggcagcttcagagtgttcggcaaggcccagtgcaacgacatcgtgttcggcttcggcagcaaggacgacgagtacaccctgccctgcagcagcggctacagaggcaacatcaccgccaagtgcgagagcagcggctggcaggtgatcagagagacctgcgtgctgagcctgctggaggagctgaacaagaacttcagcatgatcgtgggcaacgccaccgaggccgccgtgagcagcttcgtgcagaacctgagcgtgatcatcagacagaaccccagcaccaccgtgggcaacctggccagcgtggtgagcatcctgagcaacatcagcagcctgagcctggccagccacttcagagtgagcaacagcaccatggaggacgtgatcagcatcgccgacaacatcctgaacagcgccagcgtgaccaactggaccgtgctgctgagagaggagaagtacgccagcagcagactgctggagaccctggagaacatcagcaccctggtgccccccaccgccctgcccctgaacttcagcagaaagttcatcgactggaagggcatccccgtgaacaagagccagctgaagagaggctacagctaccagatcaagatgtgcccccagaacaccagcatccccatcagaggcagagtgctgatcggcagcgaccagttccagagaagcctgcccgagaccatcatcagcatggccagcctgaccctgggcaacatcctgcccgtgagcaagaacggcaacgcccaggtgaacggccccgtgatcagcaccgtgatccagaactacagcatcaacgaggtgttcctgttcttcagcaagatcgagagcaacctgagccagccccactgcgtgttctgggacttcagccacctgcagtggaacgacgccggctgccacctggtgaacgagacccaggacatcgtgacctgccagtgcacccacctgaccagcttcagcatcctgatgagccccttcgtgcccagcaccatcttccccgtggtgaagtggatcacctacgtgggcctgggcatcagcatcggcagcctgatcctgtgcctgatcatcgaggccctgttctggaagcagatcaagaagagccagaccagccacaccagaagaatctgcatggtgaacatcgccctgagcctgctgatcgccgacgtgtggttcatcgtgggcgccaccgtggacaccaccgtgaaccccagcggcgtgtgcaccgccgccgtgttcttcacccacttcttctacctgagcctgttcttctggatgctgatgctgggcatcctgctggcctacagaatcatcctggtgttccaccacatggcccagcacctgatgatggccgtgggcttctgcctgggctacggctgccccctgatcatcagcgtgatcaccatcgccgtgacccagcccagcaacacctacaagagaaaggacgtgtgctggctgaactggagcaacggcagcaagcccctgctggccttcgtggtgcccgccctggccatcgtggccgtgaacttcgtggtggtgctgctggtgctgaccaagctgtggagacccaccgtgggcgagagactgagcagagacgacaaggccaccatcatcagagtgggcaagagcctgctgatcctgacccccctgctgggcctgacctggggcttcggcatcggcaccatcgtggacagccagaacctggcctggcacgtgatcttcgccctgctgaacgccttccagggcttcttcatcctgtgcttcggcatcctgctggacagcaagctgagacagctgctgttcaacaagctgagcgccctgagcagctggaagcagaccgagaagcagaacagcagcgacctgagcgccaagcccaagttcagcaagcccttcaaccccctgcagaacaagggccactacgccttcagccacaccggcgacagcagcgacaacatcatgctgacccagttcgtgagcaacgagtag

SEQ ID NO: 18450 - DNA, 657 bp, Artificial Sequence
  Description of Artificial Sequence: Synthetic coding sequence
atgaaggtgggcgtgctgtggctgatcagcttcttcaccttcaccgacggccacggcggcttcctgggcaagaacgacggcatcaagaccaagaaggagctgatcgtgaacaagaagaagcacctgggccccgtggaggagtaccagctgctgctgcaggtgacctacagagacagcaaggagaagagagacctgagaaacttcctgaagctgctgaagccccccctgctgtggagccacggcctgatcagaatcatcagagccaaggccaccaccgactgcaacagcctgaacggcgtgctgcagtgcacctgcgaggacagctacacctggttcccccccagctgcctggacccccagaactgctacctgcacaccgccggcgccctgcccagctgcgagtgccacctgaacaacctgagccagagcgtgaacttctgcgagagaaccaagatctggggcaccttcaagatcaacgagagattcaccaacgacctgctgaacagcagcagcgccatctacagcaagtacgccaacggcatcgagatccagctgaagaaggcctacgagagaatccagggcttcgagagcgtgcaggtgacccagttcagaatgagcctgctgagccccaagctggagtgcaacggcaccatctag

SEQ ID NO: 18451 - DNA, 1890 bp, Artificial Sequence
  Description of Artificial Sequence: Synthetic coding sequence
atgaaggtgggcgtgctgtggctgatcagcttcttcaccttcaccgacggccacggcggcttcctgggcaagaacgacggcatcaagaccaagaaggagctgatcgtgaacaagaagaagcacctgggccccgtggaggagtaccagctgctgctgcaggtgacctacagagacagcaaggagaagagagacctgagaaacttcctgaagctgctgaagccccccctgctgtggagccacggcctgatcagaatcatcagagccaaggccaccaccgactgcaacagcctgaacggcgtgctgcagtgcacctgcgaggacagctacacctggttcccccccagctgcctggacccccagaactgctacctgcacaccgccggcgccctgcccagctgcgagtgccacctgaacaacctgagccagagcgtgaacttctgcgagagaaccaagatctggggcaccttcaagatcaacgagagattcaccaacgacctgctgaacagcagcagcgccatctacagcaagtacgccaacggcatcgagatccagctgaagaaggcctacgagagaatccagggcttcgagagcgtgcaggtgacccagttcagaaacggcagcatcgtggccggctacgaggtggtgggcagcagcagcgccagcgagctgctgagcgccatcgagcacgtggccgagaaggccaagaccgccctgcacaagctgttccccctggaggacggcagcttcagagtgttcggcaaggcccagtgcaacgacatcgtgttcggcttcggcagcaaggacgacgagtacaccctgccctgcagcagcggctacagaggcaacatcaccgccaagtgcgagagcagcggctggcaggtgatcagagagacctgcgtgctgagcctgctggaggagctgaacaagaacttcagcatgatcgtgggcaacgccaccgaggccgccgtgagcagcttcgtgcagaacctgagcgtgatcatcagacagaaccccagcaccaccgtgggcaacctggccagcgtggtgagcatcctgagcaacatcagcagcctgagcctggccagccacttcagagtgagcaacagcaccatggaggacgtgatcagcatcgccgacaacatcctgaacagcgccagcgtgaccaactggaccgtgctgctgagagaggagaagtacgccagcagcagactgctggagaccctggagaacatcagcaccctggtgccccccaccgccctgcccctgaacttcagcagaaagttcatcgactggaagggcatccccgtgaacaagagccagctgaagagaggctacagctaccagatcaagatgtgcccccagaacaccagcatccccatcagaggcagagtgctgatcggcagcgaccagttccagagaagcctgcccgagaccatcatcagcatggccagcctgaccctgggcaacatcctgcccgtgagcaagaacggcaacgcccaggtgaacggccccgtgatcagcaccgtgatccagaactacagcatcaacgaggtgttcctgttcttcagcaagatcgagagcaacctgagccagccccactgcgtgttctgggacttcagccacctgcagtggaacgacgccggctgccacctggtgaacgagacccaggacatcgtgacctgccagtgcacccacctgaccagcttcagcatcctgatgagccccttcgtgcccagcaccatcttccccgtggtgaagtggatcacctacgtgggcctgggcatcagcatcggcagcctgatcctgtgcctgatcatcgaggccctgttctggaagcagatcaagaagagccagaccagccacaccagacagagaaagaagaagcagtag

SEQ ID NO: 18452 - DNA, 2733 bp, Artificial Sequence
  Description of Artificial Sequence: Synthetic coding sequence
atgaaggtgggcgtgctgtggctgatcagcttcttcaccttcaccgacggccacggcggcttcctgggcaagaacgacggcatcaagaccaagaaggagctgatcgtgaacaagaagaagcacctgggccccgtggaggagtaccagctgctgctgcaggtgacctacagagacagcaaggagaagagagacctgagaaacttcctgaagctgctgaagccccccctgctgtggagccacggcctgatcagaatcatcagagccaaggccaccaccgactgcaacagcctgaacggcgtgctgcagtgcacctgcgaggacagctacacctggttcccccccagctgcctggacccccagaactgctacctgcacaccgccggcgccctgcccagctgcgagtgccacctgaacaacctgagccagagcgtgaacttctgcgagagaaccaagatctggggcaccttcaagatcaacgagagattcaccaacgacctgctgaacagcagcagcgccatctacagcaagtacgccaacggcatcgagatccagctgaagaaggcctacgagagaatccagggcttcgagagcgtgcaggtgacccagttcagaaacggcagcatcgtggccggctacgaggtggtgggcagcagcagcgccagcgagctgctgagcgccatcgagcacgtggccgagaaggccaagaccgccctgcacaagctgttccccctggaggacggcagcttcagagtgttcggcaaggcccagtgcaacgacatcgtgttcggcttcggcagcaaggacgacgagtacaccctgccctgcagcagcggctacagaggcaacatcaccgccaagtgcgagagcagcggctggcaggtgatcagagagacctgcgtgctgagcctgctggaggagctgaacaagaacttcagcatgatcgtgggcaacgccaccgaggccgccgtgagcagcttcgtgcagaacctgagcgtgatcatcagacagaaccccagcaccaccgtgggcaacctggccagcgtggtgagcatcctgagcaacatcagcagcctgagcctggccagccacttcagagtgagcaacagcaccatggaggacgtgatcagcatcgccgacaacatcctgaacagcgccagcgtgaccaactggaccgtgctgctgagagaggagaagtacgccagcagcagactgctggagaccctggagaacatcagcaccctggtgccccccaccgccctgcccctgaacttcagcagaaagttcatcgactggaagggcatccccgtgaacaagagccagctgaagagaggctacagctaccagatcaagatgtgcccccagaacaccagcatccccatcagaggcagagtgctgatcggcagcgaccagttccagagaagcctgcccgagaccatcatcagcatggccagcctgaccctgggcaacatcctgcccgtgagcaagaacggcaacgcccaggtgaacggccccgtgatcagcaccgtgatccagaactacagcatcaacgaggtgttcctgttcttcagcaagatcgagagcaacctgagccagccccactgcgtgttctgggacttcagccacctgcagtggaacgacgccggctgccacctggtgaacgagacccaggacatcgtgacctgccagtgcacccacctgaccagcttcagcatcctgatgagccccttcgtgcccagcaccatcttccccgtggtgaagtggatcacctacgtgggcctgggcatcagcatcggcagcctgatcctgtgcctgatcatcgaggccctgttctggaagcagatcaagaagagccagaccagccacaccagaagaatctgcatggtgaacatcgccctgagcctgctgatcgccgacgtgtggttcatcgtgggcgccaccgtggacaccaccgtgaaccccagcggcgtgtgcaccgccgccgtgttcttcacccacttcttctacctgagcctgttcttctggatgctgatgctgggcatcctgctggcctacagaatcatcctggtgttccaccacatggcccagcacctgatgatggccgtgggcttctgcctgggctacggctgccccctgatcatcagcgtgatcaccatcgccgtgacccagcccagcaacacctacaagagaaaggacgtgtgctggctgaactggagcaacggcagcaagcccctgctggccttcgtggtgcccgccctggccatcgtggccgtgaacttcgtggtggtgctgctggtgctgaccaagctgtggagacccaccgtgggcgagagactgagcagagacgacaaggccaccatcatcagagtgggcaagagcctgctgatcctgacccccctgctgggcctgacctggggcttcggcatcggcaccatcgtggacagccagaacctggcctggcacgtgatcttcgccctgctgaacgccttccagggcttcttcatcctgtgcttcggcatcctgctggacagcaagctgagacagctgctgttcaacaagctgagcgccctgagcagctggaagcagaccgagaagcagaacagcagcgacctgagcgccaagcccaagttcagcaagcccttcaaccccctgcagaacaagggccactacgccttcagccacaccggcgacagcagcgacaacatcatgctgacccagttcgtgagcaacgagtag

SEQ ID NO: 18453 - DNA, 2127 bp, Artificial Sequence
  Description of Artificial Sequence: Synthetic coding sequence
atgggcctgaccgcctacggcaacagaagagtgcagcccggcgagctgcccttcggcgccaacctgaccctgatccacaccagagcccagcccgtgatctgcagcaagctgctgctgaccaagagagtgagccccatcagcttcttcctgagcaagttccagaacagctggggcgaggacggctgggtgcagctggaccagctgcccagccccaacgccgtgagcagcgaccaggtgcactgcagcgccggctgcacccacagaaagtgcggctgggccgccagcaagagcaaggagaaggtgcccgccagaccccacggcgtgtgcgacggcgtgtgcaccgactacagccagtgcacccagccctgcccccccgacacccagggcaacatgggcttcagctgcagacagaagacctggcacaagatcaccgacacctgccagaccctgaacgccctgaacatcttcgaggaggacagcagactggtgcagcccttcgaggacaacatcaagatcagcgtgtacaccggcaagagcgagaccatcaccgacatgctgctgcagaagtgccccaccgacctgagctgcgtgatcagaaacatccagcagagcccctggatccccggcaacatcgccgtgatcgtgcagctgctgcacaacatcagcaccgccatctggaccggcgtggacgaggccaagatgcagagctacagcaccatcgccaaccacatcctgaacagcaagagcatcagcaactggaccttcatccccgacagaaacagcagctacatcctgctgcacagcgtgaacagcttcgccagaagactgttcatcgacaagcaccccgtggacatcagcgacgtgttcatccacaccatgggcaccaccatcagcggcgacaacatcggcaagaacttcaccttcagcatgagaatcaacgacaccagcaacgaggtgaccggcagagtgctgatcagcagagacgagctgagaaaggtgcccagccccagccaggtgatcagcatcgccttccccaccatcggcgccatcctggaggccagcctgctggagaacgtgaccgtgaacggcctggtgctgagcgccatcctgcccaaggagctgaagagaatcagcctgatcttcgagaagatcagcaagagcgaggagagaagaacccagtgcgtgggctggcacagcgtggagaacagatgggaccagcaggcctgcaagatgatccaggagaacagccagcaggccgtgtgcaagtgcagacccagcaagctgttcaccagcttcagcatcctgatgagcccccacatcctggagagcctgatcctgacctacatcacctacgtgggcctgggcatcagcatctgcagcctgatcctgtgcctgagcatcgaggtgctggtgtggagccaggtgaccaagaccgagatcacctacctgagacacgtgtgcatcgtgaacatcgccgccaccctgctgatggccgacgtgtggttcatcgtggccagcttcctgagcggccccatcacccaccacaagggctgcgtggccgccaccttcttcgtgcacttcttctacctgagcgtgttcttctggatgctggccaaggccctgctgatcctgtacggcatcatgatcgtgttccacaccctgcccaagagcgtgctggtggccagcctgttcagcgtgggctacggctgccccctggccatcgccgccatcaccgtggccgccaccgagcccggcaagggctacctgagacccgagatctgctggctgaactgggacatgaccaaggccctgctggccttcgtgatccccgccctggccatcgtggtggtgaacctgatcaccgtgaccctggtgatcgtgaagacccagagagccgccatcggcaacagcatgttccaggaggtgagagccatcgtgagaatcagcaagaacatcgccatcctgacccccctgctgggcctgacctggggcttcggcgtggccaccgtgatcgacgacagaagcctggccttccacatcatcttcagcctgctgaacgccttccaggtgagccccgacgccagcgaccaggtgcagagcgagagaatccacgaggacgtgctgtag

SEQ ID NO: 18454 - DNA, 1929 bp, Artificial Sequence
  Description of Artificial Sequence: Synthetic coding sequence
atgacccacatcctgctgctgtactacctggtgttcctgctgcccaccgagagctgcagaaccctgtaccaggccgccagcaagagcaaggagaaggtgcccgccagaccccacggcgtgtgcgacggcgtgtgcaccgactacagccagtgcacccagccctgcccccccgacacccagggcaacatgggcttcagctgcagacagaagacctggcacaagatcaccgacacctgccagaccctgaacgccctgaacatcttcgaggaggacagcagactggtgcagcccttcgaggacaacatcaagatcagcgtgtacaccggcaagagcgagaccatcaccgacatgctgctgcagaagtgccccaccgacctgagctgcgtgatcagaaacatccagcagagcccctggatccccggcaacatcgccgtgatcgtgcagctgctgcacaacatcagcaccgccatctggaccggcgtggacgaggccaagatgcagagctacagcaccatcgccaaccacatcctgaacagcaagagcatcagcaactggaccttcatccccgacagaaacagcagctacatcctgctgcacagcgtgaacagcttcgccagaagactgttcatcgacaagcaccccgtggacatcagcgacgtgttcatccacaccatgggcaccaccatcagcggcgacaacatcggcaagaacttcaccttcagcatgagaatcaacgacaccagcaacgaggtgaccggcagagtgctgatcagcagagacgagctgagaaaggtgcccagccccagccaggtgatcagcatcgccttccccaccatcggcgccatcctggaggccagcctgctggagaacgtgaccgtgaacggcctggtgctgagcgccatcctgcccaaggagctgaagagaatcagcctgatcttcgagaagatcagcaagagcgaggagagaagaacccagtgcgtgggctggcacagcgtggagaacagatgggaccagcaggcctgcaagatgatccaggagaacagccagcaggccgtgtgcaagtgcagacccagcaagctgttcaccagcttcagcatcctgatgagcccccacatcctggagagcctgatcctgacctacatcacctacgtgggcctgggcatcagcatctgcagcctgatcctgtgcctgagcatcgaggtgctggtgtggagccaggtgaccaagaccgagatcacctacctgagacacgtgtgcatcgtgaacatcgccgccaccctgctgatggccgacgtgtggttcatcgtggccagcttcctgagcggccccatcacccaccacaagggctgcgtggccgccaccttcttcgtgcacttcttctacctgagcgtgttcttctggatgctggccaaggccctgctgatcctgtacggcatcatgatcgtgttccacaccctgcccaagagcgtgctggtggccagcctgttcagcgtgggctacggctgccccctggccatcgccgccatcaccgtggccgccaccgagcccggcaagggctacctgagacccgagatctgctggctgaactgggacatgaccaaggccctgctggccttcgtgatccccgccctggccatcgtggtggtgaacctgatcaccgtgaccctggtgatcgtgaagacccagagagccgccatcggcaacagcatgttccaggaggtgagagccatcgtgagaatcagcaagaacatcgccatcctgacccccctgctgggcctgacctggggcttcggcgtggccaccgtgatcgacgacagaagcctggccttccacatcatcttcagcctgctgaacgccttccagggcttcttcatcctggtgttcggcaccatcctggaccccaagatcagagaggccctgaagggctag

SEQ ID NO: 18455 - DNA, 1929 bp, Artificial Sequence; identical to SEQ ID NO: 18454
  Description of Artificial Sequence: Synthetic coding sequence

SEQ ID NO: 18456 - DNA, 8415 bp, Artificial Sequence
  Description of Artificial Sequence: Synthetic coding sequence
atggacgacaacagcagatactggatggccttcagctacatcaccaacaacgccctgctgggcagagaggacatcgacctgggcctggccggcgaccaccagcagctgatcctgtacagactgggcaagaccttcagcatcagacaccacctggccagcttccagtggcacaccatctgcctgatctgggacggcgtgaagggcaagctggagctgttcctgaacaaggagagaatcctggaggtgaccgaccagccccacaacctgaccccccacggcaccctgttcctgggccacttcctgaagaacgagagcagcgaggtgaagagcatgatgagaagcttccccggcagcctgtactacttccagctgtgggaccacatcctggagaacgaggagttcatgaagtgcctggacggcaacatcgtgagctgggaggaggacgtgtggctggtgaacaagatcatccccaccgtggacagaaccctgagatgcttcgtgcccgagaacatgaccatccaggagaagagcaccaccgtgagccagcagatcgacatgaccacccccagccagatcaccggcgtgaagccccagaacaccgcccacagcagcaccctgctgagccagagcatccccatcttcgccaccgactacaccaccatcagctacagcaacaccaccagcccccccctggagaccatgaccgcccagaagatcctgaagaccctggtggacgagaccgccaccttcgccgtggacgtgctgagcaccagcagcgccatcagcctgcccacccagagcatcagcatcgacaacaccaccaacagcatgaagaagaccaagagccccagcagcgagagcaccaagaccaccaagatggtggaggccatggccaccgagatcttccagccccccacccccagcaacttcctgagcaccagcagattcaccaagaacagcgtggtgagcaccaccagcgccatcaagagccagagcgccgtgaccaagaccaccagcctgttcagcaccatcgagagcaccagcatgagcaccaccccctgcctgaagcagaagagcaccaacaccggcgccctgcccatcagcaccgccggccaggagttcatcgagagcaccgccgccggcaccgtgccctggttcaccgtggagaagaccagccccgccagcacccacgtgggcaccgccagcagcttcccccccgagcccgtgctgatcagcaccgccgcccccgtggacagcgtgttccccagaaaccagaccgccttccccctggccaccaccgacatgaagatcgccttcaccgtgcacagcctgaccctgcccaccagactgatcgagaccacccccgcccccagaaccgccgagaccgagctgaccagcaccaacttccaggacgtgagcctgcccagagtggaggacgccatgagcaccagcatgagcaaggagaccagcagcaagaccttcagcttcctgaccagcttcagcttcaccggcaccgagagcgtgcagaccgtgatcgacgccgaggccaccagaaccgccctgacccccgagatcaccctggccagcaccgtggccgagaccatgctgagcagcaccatcaccggcagagtgtacacccagaacacccccaccgccgacggccacctgctgaccctgatgagcaccagaagcgccagcaccagcaaggcccccgagagcggccccaccagcaccaccgacgaggccgcccacctgttcagcagcaacgagaccatctggaccagcagacccgaccaggccctgctggccagcatgaacaccaccaccatcctgaccttcgtgcccaacgagaacttcaccagcgccttccacgagaacaccacctacaccgagtacctgagcgccaccaccaacatcacccccctgaaggccagccccgagggcaagggcaccaccgccaacgacgccaccaccgccagatacaccaccgccgtgagcaagctgaccagcccctggttcgccaacttcagcatcgtgagcggcaccaccagcatcaccaacatgcccgagttcaagctgaccaccctgctgctgaagaccatccccatgagcaccaagcccgccaacgagctgcccctgacccccagagagaccgtggtgcccagcgtggacatcatcagcaccctggcctgcatccagcccaacttcagcaccgaggagagcgccagcgagaccacccagaccgagatcaacggcgccatcgtgttcggcggcaccaccacccccgtgcccaagagcgccaccacccagagactgaacgccaccgtgaccagaaaggaggccaccagccactacctgatgagaaagagcaccatcgccgccgtggccgaggtgagccccttcagcaccatgctggaggtgaccgacgagagcgcccagagagtgaccgccagcgtgaccgtgagcagcttccccgacatcgagaagctgagcacccccctggacaacaagaccgccaccaccgaggtgagagagagctggctgctgaccaagctggtgaagaccacccccagaagcagctacaacgagatgaccgagatgttcaacttcaaccacacctacgtggcccactggaccagcgagaccagcgagggcatcagcgccggcagccccaccagcggcagcacccacatcttcggcgagcccctgggcgccagcaccaccagaatcagcgagaccagcttcagcaccacccccaccgacagaaccgccaccagcctgagcgacggcatcctgcccccccagcccaccgccgcccacagcagcgccacccccgtgcccgtgacccacatgttcagcctgcccgtgaacggcagcagcgtggtggccgaggagaccgaggtgaccatgagcgagcccagcaccctggccagagccttcagcaccagcgtgctgagcgacgtgagcaacctgagcagcaccaccatgaccaccgccctggtgccccccctggaccagaccgccagcaccaccatcgtgatcgtgcccacccacggcgacctgatcagaaccaccagcgaggccaccgtgatcagcgtgagaaagaccagcatggccgtgcccagcctgaccgagacccccttccacagcctgagactgagcacccccgtgaccgccaaggccgagaccaccctgttcagcaccagcgtggacaccgtgacccccagcacccacaccctggtgtgcagcaagcccccccccgacaacatcccccccgccagcagcacccacgtgatcagcaccaccagcacccccgaggccacccagcccatcagccaggtggaggagaccagcacctacgccctgagcttcccctacaccttcagcggcggcggcgtggtggccagcctggccaccggcaccaccgagaccagcgtggtggacgagaccacccccagccacatcagcgccaacaagctgaccaccagcgtgaacagccacatcagcagcagcgccacctacagagtgcacacccccgtgagcatccagctggtgaccagcaccagcgtgctgagcagcgacaaggaccagatgaccatcagcctgggcaagacccccagaaccatggaggtgaccgagatgagccccagcaagaacagcttcatcagctacagcagaggcacccccagcctggagatgaccgacaccggcttccccgagaccaccaagatcagcagccaccagacccacagccccagcgagatccccctgggcacccccagcgacggcaacctggccagcagccccaccagcggcagcacccagatcacccccaccctgaccagcagcaacaccgtgggcgtgcacatccccgagatgagcaccagcctgggcaagaccgccctgcccagccaggccctgaccatcaccaccttcctgtgccccgagaaggagagcaccagcgccctgcccgcctacacccccagaaccgtggagatgatcgtgaacagcacctacgtgacccacagcgtgagctacggccaggacaccagcttcgtggacaccaccaccagcagcagcaccagaatcagcaaccccatggacatcaacaccaccttcagccacctgcacagcctgagaacccagcccgaggtgaccagcgtggccagcttcatcagcgagagcacccagaccttccccgagagcctgagcctgagcaccgccggcctgtacaacgacggcttcaccgtgctgagcgacagaatcaccaccgccttcagcgtgcccaacgtgcccaccatgctgcccagagagagcagcatggccaccagcacccccatctaccagatgagcagcctgcccgtgaacgtgaccgccttcaccagcaagaaggtgagcgacaccccccccatcgtgatcaccaagagcagcaagaccatgcaccccggctgcctgaagagcccctgcaccgccaccagcggccccatgagcgagatgagcagcatccccgtgaacaacagcgccttcacccccgccaccgtgagcagcgacaccagcaccagagtgggcctgttcagcaccctgctgagcagcgtgacccccagaaccaccatgaccatgcagaccagcaccctggacgtgacccccgtgatctacgccggcgccaccagcaagaacaagatggtgagcagcgccttcaccaccgagatgatcgaggcccccagcagaatcacccccaccaccttcctgagccccaccgagcccaccctgcccttcgtgaagaccgtgcccaccaccatcatggccggcatcgtgacccccttcgtgggcaccaccgccttcagccccctgagcagcaagagcaccggcgccatcagcagcatccccaagaccaccttcagccccttcctgagcgccacccagcagagcagccaggccgacgaggccaccaccctgggcatcctgagcggcatcaccaacagaagcctgagcaccgtgaacagcggcaccggcgtggccctgaccgacacctacagcagaatcaccgtgcccgagaacatgctgagccccacccacgccgacagcctgcacaccagcttcaacatccaggtgagccccagcctgaccagcttcaagagcgccagcggccccaccaagaacgtgaagaccaccaccaactgcttcagcagcaacaccagaaagatgaccagcctgctggagaagaccagcctgaccaactacgccaccagcctgaacacccccgtgagctaccccccctggacccccagcagcgccaccctgcccagcctgaccagcttcgtgtacagcccccacagcaccgaggccgagatcagcacccccaagaccagccccccccccaccagccagatggtggagttccccgtgctgggcaccagaatgaccagcagcaacacccagcccctgctgatgaccagctggaacatccccaccgccgagggcagccagttccccatcagcaccaccatcaacgtgcccaccagcaacgagatggagaccgagaccctgcacctggtgcccggccccctgagcaccttcaccgccagccagaccggcctggtgagcaaggacgtgatggccatgagcagcatccccatgagcggcatcctgcccaaccacggcctgagcgagaaccccagcctgagcaccagcctgagagccatcaccagcaccctggccgacgtgaagcacaccttcgagaagatgaccaccagcgtgacccccggcaccaccctgcccagcatcctgagcggcgccaccagcggcagcgtgatcagcaagagccccatcctgacctggctgctgagcagcctgcccagcggcagcccccccgccaccgtgagcaacgccccccacgtgatgaccagcagcaccgtggaggtgagcaagagcaccttcctgaccagcgacatgatcagcgcccaccccttcaccaacctgaccaccctgcccagcgccaccatgagcaccatcctgaccagaaccatccccacccccaccctgggcggcatcaccaccggcttccccaccagcctgcccatgagcatcaacgtgaccgacgacatcgtgtacatcagcacccaccccgaggccagcagcagaaccaccatcaccgccaaccccagaaccgtgagccaccccagcagcttcagcagaaagaccatgagccccagcaccaccgaccacaccctgagcgtgggcgccatgcccctgcccagcagcaccatcaccagcagctggaacagaatccccaccgccagcagccccagcaccctgatcatccccaagcccaccctggacagcctgctgaacatcatgaccaccaccagcaccgtgcccggcgccagcttccccctgatcagcaccggcgtgacctaccccttcaccgccaccgtgagcagccccatcagcagcttcttcgagaccacctggctggacagcacccccagcttcctgagcaccgaggccagcaccagccccaccgccaccaagagcaccgagcccggcaactgcaaggccgacgagaccgccagcaagtacaagggcacctacaagtggctgctgaccaaccccaccgagaccgcccagaccagatgcatcaagaacgaggacggcaacgccaccagattctgcagcatcagcatcaacaccggcaagagccagtgggagaagcccaagttcaagcagtgcaagctgctgcaggagctgcccgacaagatcgtggacctggccaacatcaccatcagcgacgagaacgccgaggacgtggccgagcacatcctgaacctgatcaacgagagccccgccctgggcaaggaggagaccaagatcatcgtgagcaagatcagcgacatcagccagtgcgacgagatcagcatgaacctgacccacgtgatgctgcagatcatcaacgtggtgctggagaagcagaacaacagcgccagcgacctgcacgagatcagcaacgagatcctgagaatcatcgagagaaccggccacaagatggagttcagcggccagatcgccaacctgaccgtggccggcctggccctggccgtgctgagaggcgaccacaccttcgacggcatggccttcagcatccacagctacgaggagggcaccgaccccgagaccaagaacgtgaccaaggccctgaccacctacgtggtgagcgccagcatcagcgacgacatgttcatccagaacctggccgaccccgtggtgatcaccctgcagcacatcggcggcaaccagaactacggccaggtgcactgcgccttctgggacttcgagaacaacaacggcctgggcggctggaacagcagcggctgcaaggtgaaggagaccaacgtgaactacaccatctgccagtgcgaccacctgacccacttcggcgtgctgatggacctgagcagaagcaccgtggacagcgtgaacgagcagatcctggccctgatcacctacaccggctgcggcatcagcagcatcttcctgggcgtggccgtggtgacctacatcgccttccacaagctgagaaaggactaccccgccaagatcctgatcaacctgtgcaccgccctgctgatgctgaacctggtgttcctgatcaacagctggctgagcagcttccagaaggtgggcgtgtgcatcaccgccgccgtggccctgcactacttcctgctggtgagcttcacctggatgggcctggaggccgtgcacatgtacctggccctggtgaaggtgttcaacatctacatccccaactacatcctgaagttctgcctggtgggctggggcatccccgccatcatggtggccatcaccgtgagcgtgaagaaggacctgtacggcaccctgagccccaccacccccttctgctggatcaaggacgacagcatcttctacatcagcgtggtggcctacttctgcctgatcttcctgatgaacctgagcatgttctgcaccgtgctggtgcagctgaacagcgtgaagagccagatccagaagaccagaagaaagatgatcctgcacgacctgaagggcaccatgagcctgaccttcctgctgggcctgacctggggcttcgccttcttcgcctggggccccatgagaaacttcttcctgtacctgttcgccatcttcaacaccctgcaggacggcagcagcagatgccagatcaaggtgggctacaagcaggagggcctgaagaagatcttcgagcacaagctgctgacccccagcctgaagagcaccgccaccagcagcaccttcaagagcctgggcagcgcccagggcacccccagcgagatcagcttccccaacgcccccgagctgagcgccctgcacgtggtggccagcgagcccaccaccggctag

SEQ ID NO: 18457 - DNA, 9243 bp, Artificial Sequence
  Description of Artificial Sequence: Synthetic coding sequence
atgaaggagcacatcatctaccagaagctgtacggcctgatcctgatgagcagcttcatcttcctgagcgacaccctgagcctgaagggcaagaagctggacttcttcggcagaggcgacacctacgtgagcctgatcgacaccatccccgagctgagcagattcaccgcctgcatcgacctggtgttcatggacgacaacagcagatactggatggccttcagctacatcaccaacaacgccctgctgggcagagaggacatcgacctgggcctggccggcgaccaccagcagctgatcctgtacagactgggcaagaccttcagcatcagacaccacctggccagcttccagtggcacaccatctgcctgatctgggacggcgtgaagggcaagctggagctgttcctgaacaaggagagaatcctggaggtgaccgaccagccccacaacctgaccccccacggcaccctgttcctgggccacttcctgaagaacgagagcagcgaggtgaagagcatgatgagaagcttccccggcagcctgtactacttccagctgtgggaccacatcctggagaacgaggagttcatgaagtgcctggacggcaacatcgtgagctgggaggaggacgtgtggctggtgaacaagatcatccccaccgtggacagaaccctgagatgcttcgtgcccgagaacatgaccatccaggagaagagcaccaccgtgagccagcagatcgacatgaccacccccagccagatcaccggcgtgaagccccagaacaccgcccacagcagcaccctgctgagccagagcatccccatcttcgccaccgactacaccaccatcagctacagcaacaccaccagcccccccctggagaccatgaccgcccagaagatcctgaagaccctggtggacgagaccgccaccttcgccgtggacgtgctgagcaccagcagcgccatcagcctgcccacccagagcatcagcatcgacaacaccaccaacagcatgaagaagaccaagagccccagcagcgagagcaccaagaccaccaagatggtggaggccatggccaccgagatcttccagccccccacccccagcaacttcctgagcaccagcagattcaccaagaacagcgtggtgagcaccaccagcgccatcaagagccagagcgccgtgaccaagaccaccagcctgttcagcaccatcgagagcaccagcatgagcaccaccccctgcctgaagcagaagagcaccaacaccggcgccctgcccatcagcaccgccggccaggagttcatcgagagcaccgccgccggcaccgtgccctggttcaccgtggagaagaccagccccgccagcacccacgtgggcaccgccagcagcttcccccccgagcccgtgctgatcagcaccgccgcccccgtggacagcgtgttccccagaaaccagaccgccttccccctggccaccaccgacatgaagatcgccttcaccgtgcacagcctgaccctgcccaccagactgatcgagaccacccccgcccccagaaccgccgagaccgagctgaccagcaccaacttccaggacgtgagcctgcccagagtggaggacgccatgagcaccagcatgagcaaggagaccagcagcaagaccttcagcttcctgaccagcttcagcttcaccggcaccgagagcgtgcagaccgtgatcgacgccgaggccaccagaaccgccctgacccccgagatcaccctggccagcaccgtggccgagaccatgctgagcagcaccatcaccggcagagtgtacacccagaacacccccaccgccgacggccacctgctgaccctgatgagcaccagaagcgccagcaccagcaaggcccccgagagcggccccaccagcaccaccgacgaggccgcccacctgttcagcagcaacgagaccatctggaccagcagacccgaccaggccctgctggccagcatgaacaccaccaccatcctgaccttcgtgcccaacgagaacttcaccagcgccttccacgagaacaccacctacaccgagtacctgagcgccaccaccaacatcacccccctgaaggccagccccgagggcaagggcaccaccgccaacgacgccaccaccgccagatacaccaccgccgtgagcaagctgaccagcccctggttcgccaacttcagcatcgtgagcggcaccaccagcatcaccaacatgcccgagttcaagctgaccaccctgctgctgaagaccatccccatgagcaccaagcccgccaacgagctgcccctgacccccagagagaccgtggtgcccagcgtggacatcatcagcaccctggcctgcatccagcccaacttcagcaccgaggagagcgccagcgagaccacccagaccgagatcaacggcgccatcgtgttcggcggcaccaccacccccgtgcccaagagcgccaccacccagagactgaacgccaccgtgaccagaaaggaggccaccagccactacctgatgagaaagagcaccatcgccgccgtggccgaggtgagccccttcagcaccatgctggaggtgaccgacgagagcgcccagagagtgaccgccagcgtgaccgtgagcagcttccccgacatcgagaagctgagcacccccctggacaacaagaccgccaccaccgaggtgagagagagctggctgctgaccaagctggtgaagaccacccccagaagcagctacaacgagatgaccgagatgttcaacttcaaccacacctacgtggcccactggaccagcgagaccagcgagggcatcagcgccggcagccccaccagcggcagcacccacatcttcggcgagcccctgggcgccagcaccaccagaatcagcgagaccagcttcagcaccacccccaccgacagaaccgccaccagcctgagcgacggcatcctgcccccccagcccaccgccgcccacagcagcgccacccccgtgcccgtgacccacatgttcagcctgcccgtgaacggcagcagcgtggtggccgaggagaccgaggtgaccatgagcgagcccagcaccctggccagagccttcagcaccagcgtgctgagcgacgtgagcaacctgagcagcaccaccatgaccaccgccctggtgccccccctggaccagaccgccagcaccaccatcgtgatcgtgcccacccacggcgacctgatcagaaccaccagcgaggccaccgtgatcagcgtgagaaagaccagcatggccgtgcccagcctgaccgagacccccttccacagcctgagactgagcacccccgtgaccgccaaggccgagaccaccctgttcagcaccagcgtggacaccgtgacccccagcacccacaccctggtgtgcagcaagcccccccccgacaacatcccccccgccagcagcacccacgtgatcagcaccaccagcacccccgaggccacccagcccatcagccaggtggaggagaccagcacctacgccctgagcttcccctacaccttcagcggcggcggcgtggtggccagcctggccaccggcaccaccgagaccagcgtggtggacgagaccacccccagccacatcagcgccaacaagctgaccaccagcgtgaacagccacatcagcagcagcgccacctacagagtgcacacccccgtgagcatccagctggtgaccagcaccagcgtgctgagcagcgacaaggaccagatgaccatcagcctgggcaagacccccagaaccatggaggtgaccgagatgagccccagcaagaacagcttcatcagctacagcagaggcacccccagcctggagatgaccgacaccggcttccccgagaccaccaagatcagcagccaccagacccacagccccagcgagatccccctgggcacccccagcgacggcaacctggccagcagccccaccagcggcagcacccagatcacccccaccctgaccagcagcaacaccgtgggcgtgcacatccccgagatgagcaccagcctgggcaagaccgccctgcccagccaggccctgaccatcaccaccttcctgtgccccgagaaggagagcaccagcgccctgcccgcctacacccccagaaccgtggagatgatcgtgaacagcacctacgtgacccacagcgtgagctacggccaggacaccagcttcgtggacaccaccaccagcagcagcaccagaatcagcaaccccatggacatcaacaccaccttcagccacctgcacagcctgagaacccagcccgaggtgaccagcgtggccagcttcatcagcgagagcacccagaccttccccgagagcctgagcctgagcaccgccggcctgtacaacgacggcttcaccgtgctgagcgacagaatcaccaccgccttcagcgtgcccaacgtgcccaccatgctgcccagagagagcagcatggccaccagcacccccatctaccagatgagcagcctgcccgtgaacgtgaccgccttcaccagcaagaaggtgagcgacaccccccccatcgtgatcaccaagagcagcaagaccatgcaccccggctgcctgaagagcccctgcaccgccaccagcggccccatgagcgagatgagcagcatccccgtgaacaacagcgccttcacccccgccaccgtgagcagcgacaccagcaccagagtgggcctgttcagcaccctgctgagcagcgtgacccccagaaccaccatgaccatgcagaccagcaccctggacgtgacccccgtgatctacgccggcgccaccagcaagaacaagatggtgagcagcgccttcaccaccgagatgatcgaggcccccagcagaatcacccccaccaccttcctgagccccaccgagcccaccctgcccttcgtgaagaccgtgcccaccaccatcatggccggcatcgtgacccccttcgtgggcaccaccgccttcagccccctgagcagcaagagcaccggcgccatcagcagcatccccaagaccaccttcagccccttcctgagcgccacccagcagagcagccaggccgacgaggccaccaccctgggcatcctgagcggcatcaccaacagaagcctgagcaccgtgaacagcggcaccggcgtggccctgaccgacacctacagcagaatcaccgtgcccgagaacatgctgagccccacccacgccgacagcctgcacaccagcttcaacatccaggtgagccccagcctgaccagcttcaagagcgccagcggccccaccaagaacgtgaagaccaccaccaactgcttcagcagcaacaccagaaagatgaccagcctgctggagaagaccagcctgaccaactacgccaccagcctgaacacccccgtgagctaccccccctggacccccagcagcgccaccctgcccagcctgaccagcttcgtgtacagcccccacagcaccgaggccgagatcagcacccccaagaccagccccccccccaccagccagatggtggagttccccgtgctgggcaccagaatgaccagcagcaacacccagcccctgctgatgaccagctggaacatccccaccgccgagggcagccagttccccatcagcaccaccatcaacgtgcccaccagcaacgagatggagaccgagaccctgcacctggtgcccggccccctgagcaccttcaccgccagccagaccggcctggtgagcaaggacgtgatggccatgagcagcatccccatgagcggcatcctgcccaaccacggcctgagcgagaaccccagcctgagcaccagcctgagagccatcaccagcaccctggccgacgtgaagcacaccttcgagaagatgaccaccagcgtgacccccggcaccaccctgcccagcatcctgagcggcgccaccagcggcagcgtgatcagcaagagccccatcctgacctggctgctgagcagcctgcccagcggcagcccccccgccaccgtgagcaacgccccccacgtgatgaccagcagcaccgtggaggtgagcaagagcaccttcctgaccagcgacatgatcagcgcccaccccttcaccaacctgaccaccctgcccagcgccaccatgagcaccatcctgaccagaaccatccccacccccaccctgggcggcatcaccaccggcttccccaccagcctgcccatgagcatcaacgtgaccgacgacatcgtgtacatcagcacccaccccgaggccagcagcagaaccaccatcaccgccaaccccagaaccgtgagccaccccagcagcttcagcagaaagaccatgagccccagcaccaccgaccacaccctgagcgtgggcgccatgcccctgcccagcagcaccatcaccagcagctggaacagaatccccaccgccagcagccccagcaccctgatcatccccaagcccaccctggacagcctgctgaacatcatgaccaccaccagcaccgtgcccggcgccagcttccccctgatcagcaccggcgtgacctaccccttcaccgccaccgtgagcagccccatcagcagcttcttcgagaccacctggctggacagcacccccagcttcctgagcaccgaggccagcaccagccccaccgccaccaagagcaccgtgagcttctacaacgtggagatgagcttcagcgtgttcgtggaggagcccagaatccccatcaccagcgtgatcaacgagttcaccgagaacagcctgaacagcatcttccagaacagcgagttcagcctggccaccctggagacccagatcaagagcagagacatcagcgaggaggagatggtgatggacagagccatcctggagcagagagagggccaggagatggccaccatcagctacgtgccctacagctgcgtgtgccaggtgatcatcaaggccagcagcagcctggccagcagcgagctgatgagaaagatcaagagcaagatccacggcaacttcacccacggcaacttcacccaggaccagctgaccctgctggtgaactgcgagcacgtggccgtgaagaagctggagcccggcaactgcaaggccgacgagaccgccagcaagtacaagggcacctacaagtggctgctgaccaaccccaccgagaccgcccagaccagatgcatcaagaacgaggacggcaacgccaccagattctgcagcatcagcatcaacaccggcaagagccagtgggagaagcccaagttcaagcagtgcaagctgctgcaggagctgcccgacaagatcgtggacctggccaacatcaccatcagcgacgagaacgccgaggacgtggccgagcacatcctgaacctgatcaacgagagccccgccctgggcaaggaggagaccaagatcatcgtgagcaagatcagcgacatcagccagtgcgacgagatcagcatgaacctgacccacgtgatgctgcagatcatcaacgtggtgctggagaagcagaacaacagcgccagcgacctgcacgagatcagcaacgagatcctgagaatcatcgagagaaccggccacaagatggagttcagcggccagatcgccaacctgaccgtggccggcctggccctggccgtgctgagaggcgaccacaccttcgacggcatggccttcagcatccacagctacgaggagggcaccgaccccgagatcttcctgggcaacgtgcccgtgggcggcatcctggccagcatctacctgcccaagagcctgaccgagagaatccccctgagcaacctgcagaccatcctgttcaacttcttcggccagaccagcctgttcaagaccaagaacgtgaccaaggccctgaccacctacgtggtgagcgccagcatcagcgacgacatgttcatccagaacctggccgaccccgtggtgatcaccctgcagcacatcggcggcaaccagaactacggccaggtgcactgcgccttctgggacttcgagaacaacaacggcctgggcggctggaacagcagcggctgcaaggtgaaggagaccaacgtgaactacaccatctgccagtgcgaccacctgacccacttcggcgtgctgatggacctgagcagaagcaccgtggacagcgtgaacgagcagatcctggccctgatcacctacaccggctgcggcatcagcagcatcttcctgggcgtggccgtggtgacctacatcgccttccacaagctgagaaaggactaccccgccaagatcctgatcaacctgtgcaccgccctgctgatgctgaacctggtgttcctgatcaacagctggctgagcagcttccagaaggtgggcgtgtgcatcaccgccgccgtggccctgcactacttcctgctggtgagcttcacctggatgggcctggaggccgtgcacatgtacctggccctggtgaaggtgttcaacatctacatccccaactacatcctgaagttctgcctggtgggctggggcatccccgccatcatggtggccatcaccgtgagcgtgaagaaggacctgtacggcaccctgagccccaccacccccttctgctggatcaaggacgacagcatcttctacatcagcgtggtggcctacttctgcctgatcttcctgatgaacctgagcatgttctgcaccgtgctggtgcagctgaacagcgtgaagagccagatccagaagaccagaagaaagatgatcctgcacgacctgaagggcaccatgagcctgaccttcctgctgggcctgacctggggcttcgccttcttcgcctggggccccatgagaaacttcttcctgtacctgttcgccatcttcaacaccctgcagggcttcttcatcttcgtgttccactgcgtgatgaaggagagcgtgagagagcagtggcagatccacctgtgctgcggctggctgagactggacaacagcagcgacggcagcagcagatgccagatcaaggtgggctacaagcaggagggcctgaagaagatcttcgagcacaagctgctgacccccagcctgaagagcaccgccaccagcagcaccttcaagagcctgggcagcgcccagggcacccccagcgagatcagcttccccaacgacgacttcgacaaggacccctactgcagcagcccctag

SEQ ID NO: 18458 - DNA, 9243 bp, Artificial Sequence; identical to SEQ ID NO: 18457
  Description of Artificial Sequence: Synthetic coding sequence

SEQ ID NO: 18459 - DNA, 8628 bp, Artificial Sequence
  Description of Artificial Sequence: Synthetic coding sequence
atgaaggagcacatcatctaccagaagctgtacggcctgatcctgatgagcagcttcatcttcctgagcgtggtgcccgagaacatgaccatccaggagaagagcaccaccgtgagccagcagatcgacatgaccacccccagccagatcaccggcgtgaagccccagaacaccgcccacagcagcaccctgctgagccagagcatccccatcttcgccaccgactacaccaccatcagctacagcaacaccaccagcccccccctggagaccatgaccgcccagaagatcctgaagaccctggtggacgagaccgccaccttcgccgtggacgtgctgagcaccagcagcgccatcagcctgcccacccagagcatcagcatcgacaacaccaccaacagcatgaagaagaccaagagccccagcagcgagagcaccaagaccaccaagatggtggaggccatggccaccgagatcttccagccccccacccccagcaacttcctgagcaccagcagattcaccaagaacagcgtggtgagcaccaccagcgccatcaagagccagagcgccgtgaccaagaccaccagcctgttcagcaccatcgagagcaccagcatgagcaccaccccctgcctgaagcagaagagcaccaacaccggcgccctgcccatcagcaccgccggccaggagttcatcgagagcaccgccgccggcaccgtgccctggttcaccgtggagaagaccagccccgccagcacccacgtgggcaccgccagcagcttcccccccgagcccgtgctgatcagcaccgccgcccccgtggacagcgtgttccccagaaaccagaccgccttccccctggccaccaccgacatgaagatcgccttcaccgtgcacagcctgaccctgcccaccagactgatcgagaccacccccgcccccagaaccgccgagaccgagctgaccagcaccaacttccaggacgtgagcctgcccagagtggaggacgccatgagcaccagcatgagcaaggagaccagcagcaagaccttcagcttcctgaccagcttcagcttcaccggcaccgagagcgtgcagaccgtgatcgacgccgaggccaccagaaccgccctgacccccgagatcaccctggccagcaccgtggccgagaccatgctgagcagcaccatcaccggcagagtgtacacccagaacacccccaccgccgacggccacctgctgaccctgatgagcaccagaagcgccagcaccagcaaggcccccgagagcggccccaccagcaccaccgacgaggccgcccacctgttcagcagcaacgagaccatctggaccagcagacccgaccaggccctgctggccagcatgaacaccaccaccatcctgaccttcgtgcccaacgagaacttcaccagcgccttccacgagaacaccacctacaccgagtacctgagcgccaccaccaacatcacccccctgaaggccagccccgagggcaagggcaccaccgccaacgacgccaccaccgccagatacaccaccgccgtgagcaagctgaccagcccctggttcgccaacttcagcatcgtgagcggcaccaccagcatcaccaacatgcccgagttcaagctgaccaccctgctgctgaagaccatccccatgagcaccaagcccgccaacgagctgcccctgacccccagagagaccgtggtgcccagcgtggacatcatcagcaccctggcctgcatccagcccaacttcagcaccgaggagagcgccagcgagaccacccagaccgagatcaacggcgccatcgtgttcggcggcaccaccacccccgtgcccaagagcgccaccacccagagactgaacgccaccgtgaccagaaaggaggccaccagccactacctgatgagaaagagcaccatcgccgccgtggccgaggtgagccccttcagcaccatgctggaggtgaccgacgagagcgcccagagagtgaccgccagcgtgaccgtgagcagcttccccgacatcgagaagctgagcacccccctggacaacaagaccgccaccaccgaggtgagagagagctggctgctgaccaagctggtgaagaccacccccagaagcagctacaacgagatgaccgagatgttcaacttcaaccacacctacgtggcccactggaccagcgagaccagcgagggcatcagcgccggcagccccaccagcggcagcacccacatcttcggcgagcccctgggcgccagcaccaccagaatcagcgagaccagcttcagcaccacccccaccgacagaaccgccaccagcctgagcgacggcatcctgcccccccagcccaccgccgcccacagcagcgccacccccgtgcccgtgacccacatgttcagcctgcccgtgaacggcagcagcgtggtggccgaggagaccgaggtgaccatgagcgagcccagcaccctggccagagccttcagcaccagcgtgctgagcgacgtgagcaacctgagcagcaccaccatgaccaccgccctggtgccccccctggaccagaccgccagcaccaccatcgtgatcgtgcccacccacggcgacctgatcagaaccaccagcgaggccaccgtgatcagcgtgagaaagaccagcatggccgtgcccagcctgaccgagacccccttccacagcctgagactgagcacccccgtgaccgccaaggccgagaccaccctgttcagcaccagcgtggacaccgtgacccccagcacccacaccctggtgtgcagcaagcccccccccgacaacatcccccccgccagcagcacccacgtgatcagcaccaccagcacccccgaggccacccagcccatcagccaggtggaggagaccagcacctacgccctgagcttcccctacaccttcagcggcggcggcgtggtggccagcctggccaccggcaccaccgagaccagcgtggtggacgagaccacccccagccacatcagcgccaacaagctgaccaccagcgtgaacagccacatcagcagcagcgccacctacagagtgcacacccccgtgagcatccagctggtgaccagcaccagcgtgctgagcagcgacaaggaccagatgaccatcagcctgggcaagacccccagaaccatggaggtgaccgagatgagccccagcaagaacagcttcatcagctacagcagaggcacccccagcctggagatgaccgacaccggcttccccgagaccaccaagatcagcagccaccagacccacagccccagcgagatccccctgggcacccccagcgacggcaacctggccagcagccccaccagcggcagcacccagatcacccccaccctgaccagcagcaacaccgtgggcgtgcacatccccgagatgagcaccagcctgggcaagaccgccctgcccagccaggccctgaccatcaccaccttcctgtgccccgagaaggagagcaccagcgccctgcccgcctacacccccagaaccgtggagatgatcgtgaacagcacctacgtgacccacagcgtgagctacggccaggacaccagcttcgtggacaccaccaccagcagcagcaccagaatcagcaaccccatggacatcaacaccaccttcagccacctgcacagcctgagaacccagcccgaggtgaccagcgtggccagcttcatcagcgagagcacccagaccttccccgagagcctgagcctgagcaccgccggcctgtacaacgacggcttcaccgtgctgagcgacagaatcaccaccgccttcagcgtgcccaacgtgcccaccatgctgcccagagagagcagcatggccaccagcacccccatctaccagatgagcagcctgcccgtgaacgtgaccgccttcaccagcaagaaggtgagcgacaccccccccatcgtgatcaccaagagcagcaagaccatgcaccccggctgcctgaagagcccctgcaccgccaccagcggccccatgagcgagatgagcagcatccccgtgaacaacagcgccttcacccccgccaccgtgagcagcgacaccagcaccagagtgggcctgttcagcaccctgctgagcagcgtgacccccagaaccaccatgaccatgcagaccagcaccctggacgtgacccccgtgatctacgccggcgccaccagcaagaacaagatggtgagcagcgccttcaccaccgagatgatcgaggcccccagcagaatcacccccaccaccttcctgagccccaccgagcccaccctgcccttcgtgaagaccgtgcccaccaccatcatggccggcatcgtgacccccttcgtgggcaccaccgccttcagccccctgagcagcaagagcaccggcgccatcagcagcatccccaagaccaccttcagccccttcctgagcgccacccagcagagcagccaggccgacgaggccaccaccctgggcatcctgagcggcatcaccaacagaagcctgagcaccgtgaacagcggcaccggcgtggccctgaccgacacctacagcagaatcaccgtgcccgagaacatgctgagccccacccacgccgacagcctgcacaccagcttcaacatccaggtgagccccagcctgaccagcttcaagagcgccagcggccccaccaagaacgtgaagaccaccaccaactgcttcagcagcaacaccagaaagatgaccagcctgctggagaagaccagcctgaccaactacgccaccagcctgaacacccccgtgagctaccccccctggacccccagcagcgccaccctgcccagcctgaccagcttcgtgtacagcccccacagcaccgaggccgagatcagcacccccaagaccagccccccccccaccagccagatggtggagttccccgtgctgggcaccagaatgaccagcagcaacacccagcccctgctgatgaccagctggaacatccccaccgccgagggcagccagttccccatcagcaccaccatcaacgtgcccaccagcaacgagatggagaccgagaccctgcacctggtgcccggccccctgagcaccttcaccgccagccagaccggcctggtgagcaaggacgtgatggccatgagcagcatccccatgagcggcatcctgcccaaccacggcctgagcgagaaccccagcctgagcaccagcctgagagccatcaccagcaccctggccgacgtgaagcacaccttcgagaagatgaccaccagcgtgacccccggcaccaccctgcccagcatcctgagcggcgccaccagcggcagcgtgatcagcaagagccccatcctgacctggctgctgagcagcctgcccagcggcagcccccccgccaccgtgagcaacgccccccacgtgatgaccagcagcaccgtggaggtgagcaagagcaccttcctgaccagcgacatgatcagcgcccaccccttcaccaacctgaccaccctgcccagcgccaccatgagcaccatcctgaccagaaccatccccacccccaccctgggcggcatcaccaccggcttccccaccagcctgcccatgagcatcaacgtgaccgacgacatcgtgtacatcagcacccaccccgaggccagcagcagaaccaccatcaccgccaaccccagaaccgtgagccaccccagcagcttcagcagaaagaccatgagccccagcaccaccgaccacaccctgagcgtgggcgccatgcccctgcccagcagcaccatcaccagcagctggaacagaatccccaccgccagcagccccagcaccctgatcatccccaagcccaccctggacagcctgctgaacatcatgaccaccaccagcaccgtgcccggcgccagcttccccctgatcagcaccggcgtgacctaccccttcaccgccaccgtgagcagccccatcagcagcttcttcgagaccacctggctggacagcacccccagcttcctgagcaccgaggccagcaccagccccaccgccaccaagagcaccgtgagcttctacaacgtggagatgagcttcagcgtgttcgtggaggagcccagaatccccatcaccagcgtgatcaacgagttcaccgagaacagcctgaacagcatcttccagaacagcgagttcagcctggccaccctggagacccagatcaagagcagagacatcagcgaggaggagatggtgatggacagagccatcctggagcagagagagggccaggagatggccaccatcagctacgtgccctacagctgcgtgtgccaggtgatcatcaaggccagcagcagcctggccagcagcgagctgatgagaaagatcaagagcaagatccacggcaacttcacccacggcaacttcacccaggaccagctgaccctgctggtgaactgcgagcacgtggccgtgaagaagctggagcccggcaactgcaaggccgacgagaccgccagcaagtacaagggcacctacaagtggctgctgaccaaccccaccgagaccgcccagaccagatgcatcaagaacgaggacggcaacgccaccagattctgcagcatcagcatcaacaccggcaagagccagtgggagaagcccaagttcaagcagtgcaagctgctgcaggagctgcccgacaagatcgtggacctggccaacatcaccatcagcgacgagaacgccgaggacgtggccgagcacatcctgaacctgatcaacgagagccccgccctgggcaaggaggagaccaagatcatcgtgagcaagatcagcgacatcagccagtgcgacgagatcagcatgaacctgacccacgtgatgctgcagatcatcaacgtggtgctggagaagcagaacaacagcgccagcgacctgcacgagatcagcaacgagatcctgagaatcatcgagagaaccggccacaagatggagttcagcggccagatcgccaacctgaccgtggccggcctggccctggccgtgctgagaggcgaccacaccttcgacggcatggccttcagcatccacagctacgaggagggcaccgaccccgagatcttcctgggcaacgtgcccgtgggcggcatcctggccagcatctacctgcccaagagcctgaccgagagaatccccctgagcaacctgcagaccatcctgttcaacttcttcggccagaccagcctgttcaagaccaagaacgtgaccaaggccctgaccacctacgtggtgagcgccagcatcagcgacgacatgttcatccagaacctggccgaccccgtggtgatcaccctgcagcacatcggcggcaaccagaactacggccaggtgcactgcgccttctgggacttcgagaacaacaacggcctgggcggctggaacagcagcggctgcaaggtgaaggagaccaacgtgaactacaccatctgccagtgcgaccacctgacccacttcggcgtgctgatggacctgagcagaagcaccgtggacagcgtgaacgagcagatcctggccctgatcacctacaccggctgcggcatcagcagcatcttcctgggcgtggccgtggtgacctacatcgccttccacaagctgagaaaggactaccccgccaagatcctgatcaacctgtgcaccgccctgctgatgctgaacctggtgttcctgatcaacagctggctgagcagcttccagaaggtgggcgtgtgcatcaccgccgccgtggccctgcactacttcctgctggtgagcttcacctggatgggcctggaggccgtgcacatgtacctggccctggtgaaggtgttcaacatctacatccccaactacatcctgaagttctgcctggtgggctggggcatccccgccatcatggtggccatcaccgtgagcgtgaagaaggacctgtacggcaccctgagccccaccacccccttctgctggatcaaggacgacagcatcttctacatcagcgtggtggcctacttctgcctgatcttcctgatgaacctgagcatgttctgcaccgtgctggtgcagctgaacagcgtgaagagccagatccagaagaccagaagaaagatgatcctgcacgacctgaagggcaccatgagcctgaccttcctgctgggcctgacctggggcttcgccttcttcgcctggggccccatgagaaacttcttcctgtacctgttcgccatcttcaacaccctgcagggcttcttcatcttcgtgttccactgcgtgatgaaggagagcgtgagagagcagtggcagatccacctgtgctgcggctggctgagactggacaacagcagcgacggcagcagcagatgccagatcaaggtgggctacaagcaggagggcctgaagaagatcttcgagcacaagctgctgacccccagcctgaagagcaccgccaccagcagcaccttcaagagcctgggcagcgcccagggcacccccagcgagatcagcttccccaacgacgacttcgacaaggacccctactgcagcagcccctag

SEQ ID NO: 18460 - DNA, 3240 bp, Artificial Sequence
  Description of Artificial Sequence: Synthetic coding sequence
atggtgtgcagcgccgcccccctgctgctgctggccaccaccctgcccctgctgggcagccccgtggcccaggccagccagcccgtgagcgagaccggcgtgagacccagagagggcctgcagagaagacagtggggccccctgatcggcagagacaaggcctggaacgagagaatcgacagacccttccccgcctgccccatccccctgagcagcagcttcggcagatggcccaagggccagaccatgtgggcccagaccagcaccctgaccctgaccgaggaggagctgggccagagccaggccggcggcgagagcggcagcggccagctgctggaccaggagaacggcgccggcgagagcgccctggtgagcgtgtacgtgcacctggacttccccgacaagacctggccccccgagctgagcagaaccctgaccctgcccgccgccagcgccagcagcagccccagacccctgctgaccggcctgagactgaccaccgagtgcaacgtgaaccacaagggcaacttctactgcgcctgcctgagcggctaccagtggaacaccagcatctgcctgcactaccccccctgccagagcctgcacaaccaccagccctgcggctgcctggtgttcagccaccccgagcccggctactgccagctgctgccccccggcagccccgtgacctgcctgcccgccgtgcccggcatcctgaacctgaacagccagctgcagatgcccggcgacaccctgagcctgaccctgcacctgagccaggaggccaccaacctgagctggttcctgagacaccccggcagccccagccccatcctgctgcagcccggcacccaggtgagcgtgaccagcagccacggccaggccgccctgagcgtgagcaacatgagccaccactgggccggcgagtacatgagctgcttcgaggcccagggcttcaagtggaacctgtacgaggtggtgagagtgcccctgaaggccaccgacgtggccagactgccctaccagctgagcatcagctgcgccaccagccccggcttccagctgagctgctgcatccccagcaccaacctggcctacaccgccgcctggagccccggcgagggcagcaaggccagcagcttcaacgagagcggcagccagtgcttcgtgctggccgtgcagagatgccccatggccgacaccacctacgcctgcgacctgcagagcctgggcctggcccccctgagagtgcccatcagcatcaccatcatccaggacggcgacatcacctgccccgaggacgccagcgtgctgacctggaacgtgaccaaggccggccacgtggcccaggccccctgccccgagagcaagagaggcatcgtgagaagactgtgcggcgccgacggcgtgtggggccccgtgcacagcagctgcaccgacgccagactgctggccctgttcaccagaaccaagctgctgcaggccggccagggcagccccgccgaggaggtgccccagatcctggcccagctgcccggccaggccgccgaggccagcagccccagcgacctgctgaccctgctgagcaccatgaagtacgtggccaaggtggtggccgaggccagaatccagctggacagaagagccctgaagaacctgctgatcgccaccgacaaggtgctggacatggacaccagaagcctgtggaccctggcccaggccagaaagccctgggccggcagcaccctgctgctggccgtggagaccctggcctgcagcctgtgcccccaggaccaccccttcgccttcagcctgcccaacgtgctgctgcagagccagctgttcggccccaccttccccgccgactacagcatcagcttccccaccagaccccccctgcaggcccagatccccagacacagcctggcccccctggtgagaaacggcaccgagatcagcatcaccagcctggtgctgagaaagctggaccacctgctgcccagcaactacggccagggcctgggcgacagcctgtacgccacccccggcctggtgctggtgatcagcatcatggccggcgacagagccttcagccagggcgaggtgatcatggacttcggcaacaccgacggcagcccccactgcgtgttctgggaccacagcctgttccagggcagaggcggctggagcaaggagggctgccaggcccaggtggccagcgccagccccaccgcccagtgcctgtgccagcacctgaccgccttcagcgtgctgatgagcccccacaccgtgcccgaggagcccgccctggccctgctgacccaggtgggcctgggcgccagcatcctggccctgctggtgtgcctgggcgtgtactggctggtgtggagagtggtggtgagaaacaagatcagctacttcagacacgccgccctgctgaacatggtgttctgcctgctggccgccgacacctgcttcctgggcgcccccttcctgagccccggccccagaagccccctgtgcctggccgccgccttcctgtgccacttcctgtacctggccaccttcttctggatgctggcccaggccctggtgctggcccaccagctgctgttcgtgttccaccagctggccaagcacagagtgctgcccctgatggtgctgctgggctacctgtgccccctgggcctggccggcgtgaccctgggcctgtacctgccccagggccagtacctgagagagggcgagtgctggctggacggcaagggcggcgccctgtacaccttcgtgggccccgtgctggccatcatcggcgtgaacggcctggtgctggccatggccatgctgaagctgctgagacccagcctgagcgagggcccccccgccgagaagagacaggccctgctgggcgtgatcaaggccctgctgatcctgacccccatcttcggcctgacctggggcctgggcctggccaccctgctggaggaggtgagcaccgtgccccactacatcttcaccatcctgaacaccctgcagggcgtgttcatcctgctgttcggctgcctgatggacagaaagatccaggaggccctgagaaagagattctgcagagcccaggcccccagcagcaccatcagcctggtgagctgctgcctgcagatcctgagctgcgccagcaagagcatgagcgagggcatcccctggcccagcagcgaggacatgggcaccgccagaagctag

SEQ ID NO: 18461 - DNA, 2622 bp, Artificial Sequence
  Description of Artificial Sequence: Synthetic coding sequence
atgaccaccagaaagctgagcgcccacagcgccgccacccccggctacaaggccgtgacccacaagcaccacaccggctgggccagaatggccaagaccggcctgcccgagaagggccagagccaggccggcggcgagagcggcagcggccagctgctggaccaggagaacggcgccggcgagagcgccctggtgagcgtgtacgtgcacctggacttccccgacaagacctggccccccgagctgagcagaaccctgaccctgcccgccgccagcgccagcagcagccccagacccctgctgaccggcctgagactgaccaccggcgagtacatgagctgcttcgaggcccagggcttcaagtggaacctgtacgaggtggtgagagtgcccctgaaggccaccgacgtggccagactgccctaccagctgagcatcagctgcgccaccagccccggcttccagctgagctgctgcatccccagcaccaacctggcctacaccgccgcctggagccccggcgagggcagcaaggccagcagcttcaacgagagcggcagccagtgcttcgtgctggccgtgcagagatgccccatggccgacaccacctacgcctgcgacctgcagagcctgggcctggcccccctgagagtgcccatcagcatcaccatcatccaggacggcgacatcacctgccccgaggacgccagcgtgctgacctggaacgtgaccaaggccggccacgtggcccaggccccctgccccgagagcaagagaggcatcgtgagaagactgtgcggcgccgacggcgtgtggggccccgtgcacagcagctgcaccgacgccagactgctggccctgttcaccagaaccaagctgctgcaggccggccagggcagccccgccgaggaggtgccccagatcctggcccagctgcccggccaggccgccgaggccagcagccccagcgacctgctgaccctgctgagcaccatgaagtacgtggccaaggtggtggccgaggccagaatccagctggacagaagagccctgaagaacctgctgatcgccaccgacaaggtgctggacatggacaccagaagcctgtggaccctggcccaggccagaaagccctgggccggcagcaccctgctgctggccgtggagaccctggcctgcagcctgtgcccccaggaccaccccttcgccttcagcctgcccaacgtgctgctgcagagccagctgttcggccccaccttccccgccgactacagcatcagcttccccaccagaccccccctgcaggcccagatccccagacacagcctggcccccctggtgagaaacggcaccgagatcagcatcaccagcctggtgctgagaaagctggaccacctgctgcccagcaactacggccagggcctgggcgacagcctgtacgccacccccggcctggtgctggtgatcagcatcatggccggcgacagagccttcagccagggcgaggtgatcatggacttcggcaacaccgacggcagcccccactgcgtgttctgggaccacagcctgttccagggcagaggcggctggagcaaggagggctgccaggcccaggtggccagcgccagccccaccgcccagtgcctgtgccagcacctgaccgccttcagcgtgctgatgagcccccacaccgtgcccgaggagcccgccctggccctgctgacccaggtgggcctgggcgccagcatcctggccctgctggtgtgcctgggcgtgtactggctggtgtggagagtggtggtgagaaacaagatcagctacttcagacacgccgccctgctgaacatggtgttctgcctgctggccgccgacacctgcttcctgggcgcccccttcctgagccccggccccagaagccccctgtgcctggccgccgccttcctgtgccacttcctgtacctggccaccttcttctggatgctggcccaggccctggtgctggcccaccagctgctgttcgtgttccaccagctggccaagcacagagtgctgcccctgatggtgctgctgggctacctgtgccccctgggcctggccggcgtgaccctgggcctgtacctgccccagggccagtacctgagagagggcgagtgctggctggacggcaagggcggcgccctgtacaccttcgtgggccccgtgctggccatcatcggcgtgaacggcctggtgctggccatggccatgctgaagctgctgagacccagcctgagcgagggcccccccgccgagaagagacaggccctgctgggcgtgatcaaggccctgctgatcctgacccccatcttcggcctgacctggggcctgggcctggccaccctgctggaggaggtgagcaccgtgccccactacatcttcaccatcctgaacaccctgcagggcgtgttcatcctgctgttcggctgcctgatggacagaaagatccaggaggccctgagaaagagattctgcagagcccaggcccccagcagcaccatcagcctggccaccaacgagggctgcatcctggagcacagcaagggcggcagcgacaccgccagaaagaccgacgccagcgagtag

SEQ ID NO: 18462 - DNA, 2028 bp, Artificial Sequence
  Description of Artificial Sequence: Synthetic coding sequence
atggccgacaccacctacgcctgcgacctgcagagcctgggcctggcccccctgagagtgcccatcagcatcaccatcatccaggacggcgacatcacctgccccgaggacgccagcgtgctgacctggaacgtgaccaaggccggccacgtggcccaggccccctgccccgagagcaagagaggcatcgtgagaagactgtgcggcgccgacggcgtgtggggccccgtgcacagcagctgcaccgacgccagactgctggccctgttcaccagaaccaagctgctgcaggccggccagggcagccccgccgaggaggtgccccagatcctggcccagctgcccggccaggccgccgaggccagcagccccagcgacctgctgaccctgctgagcaccatgaagtacgtggccaaggtggtggccgaggccagaatccagctggacagaagagccctgaagaacctgctgatcgccaccgacaaggtgctggacatggacaccagaagcctgtggaccctggcccaggccagaaagccctgggccggcagcaccctgctgctggccgtggagaccctggcctgcagcctgtgcccccaggaccaccccttcgccttcagcctgcccaacgtgctgctgcagagccagctgttcggccccaccttccccgccgactacagcatcagcttccccaccagaccccccctgcaggcccagatccccagacacagcctggcccccctggtgagaaacggcaccgagatcagcatcaccagcctggtgctgagaaagctggaccacctgctgcccagcaactacggccagggcctgggcgacagcctgtacgccacccccggcctggtgctggtgatcagcatcatggccggcgacagagccttcagccagggcgaggtgatcatggacttcggcaacaccgacggcagcccccactgcgtgttctgggaccacagcctgttccagggcagaggcggctggagcaaggagggctgccaggcccaggtggccagcgccagccccaccgcccagtgcctgtgccagcacctgaccgccttcagcgtgctgatgagcccccacaccgtgcccgaggagcccgccctggccctgctgacccaggtgggcctgggcgccagcatcctggccctgctggtgtgcctgggcgtgtactggctggtgtggagagtggtggtgagaaacaagatcagctacttcagacacgccgccctgctgaacatggtgttctgcctgctggccgccgacacctgcttcctgggcgcccccttcctgagccccggccccagaagccccctgtgcctggccgccgccttcctgtgccacttcctgtacctggccaccttcttctggatgctggcccaggccctggtgctggcccaccagctgctgttcgtgttccaccagctggccaagcacagagtgctgcccctgatggtgctgctgggctacctgtgccccctgggcctggccggcgtgaccctgggcctgtacctgccccagggccagtacctgagagagggcgagtgctggctggacggcaagggcggcgccctgtacaccttcgtgggccccgtgctggccatcatcggcgtgaacggcctggtgctggccatggccatgctgaagctgctgagacccagcctgagcgagggcccccccgccgagaagagacaggccctgctgggcgtgatcaaggccctgctgatcctgacccccatcttcggcctgacctggggcctgggcctggccaccctgctggaggaggtgagcaccgtgccccactacatcttcaccatcctgaacaccctgcagggcgtgttcatcctgctgttcggctgcctgatggacagaaagatccaggaggccctgagaaagagattctgcagagcccaggcccccagcagcaccatcagcctggccaccaacgagggctgcatcctggagcacagcaagggcggcagcgacaccgccagaaagaccgacgccagcgagtag

SEQ ID NO: 18463 - DNA, 2994 bp, Artificial Sequence
  Description of Artificial Sequence: Synthetic coding sequence
atggtgtgcagcgccgcccccctgctgctgctggccaccaccctgcccctgctgggcagccccgtggcccaggccagccagcccggccagagccaggccggcggcgagagcggcagcggccagctgctggaccaggagaacggcgccggcgagagcgccctggtgagcgtgtacgtgcacctggacttccccgacaagacctggccccccgagctgagcagaaccctgaccctgcccgccgccagcgccagcagcagccccagacccctgctgaccggcctgagactgaccaccgagtgcaacgtgaaccacaagggcaacttctactgcgcctgcctgagcggctaccagtggaacaccagcatctgcctgcactaccccccctgccagagcctgcacaaccaccagccctgcggctgcctggtgttcagccaccccgagcccggctactgccagctgctgccccccggcagccccgtgacctgcctgcccgccgtgcccggcatcctgaacctgaacagccagctgcagatgcccggcgacaccctgagcctgaccctgcacctgagccaggaggccaccaacctgagctggttcctgagacaccccggcagccccagccccatcctgctgcagcccggcacccaggtgagcgtgaccagcagccacggccaggccgccctgagcgtgagcaacatgagccaccactgggccggcgagtacatgagctgcttcgaggcccagggcttcaagtggaacctgtacgaggtggtgagagtgcccctgaaggccaccgacgtggccagactgccctaccagctgagcatcagctgcgccaccagccccggcttccagctgagctgctgcatccccagcaccaacctggcctacaccgccgcctggagccccggcgagggcagcaaggccagcagcttcaacgagagcggcagccagtgcttcgtgctggccgtgcagagatgccccatggccgacaccacctacgcctgcgacctgcagagcctgggcctggcccccctgagagtgcccatcagcatcaccatcatccaggacggcgacatcacctgccccgaggacgccagcgtgctgacctggaacgtgaccaaggccggccacgtggcccaggccccctgccccgagagcaagagaggcatcgtgagaagactgtgcggcgccgacggcgtgtggggccccgtgcacagcagctgcaccgacgccagactgctggccctgttcaccagaaccaagctgctgcaggccggccagggcagccccgccgaggaggtgccccagatcctggcccagctgcccggccaggccgccgaggccagcagccccagcgacctgctgaccctgctgagcaccatgaagtacgtggccaaggtggtggccgaggccagaatccagctggacagaagagccctgaagaacctgctgatcgccaccgacaaggtgctggacatggacaccagaagcctgtggaccctggcccaggccagaaagccctgggccggcagcaccctgctgctggccgtggagaccctggcctgcagcctgtgcccccaggaccaccccttcgccttcagcctgcccaacgtgctgctgcagagccagctgttcggccccaccttccccgccgactacagcatcagcttccccaccagaccccccctgcaggcccagatccccagacacagcctggcccccctggtgagaaacggcaccgagatcagcatcaccagcctggtgctgagaaagctggaccacctgctgcccagcaactacggccagggcctgggcgacagcctgtacgccacccccggcctggtgctggtgatcagcatcatggccggcgacagagccttcagccagggcgaggtgatcatggacttcggcaacaccgacggcagcccccactgcgtgttctgggaccacagcctgttccagggcagaggcggctggagcaaggagggctgccaggcccaggtggccagcgccagccccaccgcccagtgcctgtgccagcacctgaccgccttcagcgtgctgatgagcccccacaccgtgcccgaggagcccgccctggccctgctgacccaggtgggcctgggcgccagcatcctggccctgctggtgtgcctgggcgtgtactggctggtgtggagagtggtggtgagaaacaagatcagctacttcagacacgccgccctgctgaacatggtgttctgcctgctggccgccgacacctgcttcctgggcgcccccttcctgagccccggccccagaagccccctgtgcctggccgccgccttcctgtgccacttcctgtacctggccaccttcttctggatgctggcccaggccctggtgctggcccaccagctgctgttcgtgttccaccagctggccaagcacagagtgctgcccctgatggtgctgctgggctacctgtgccccctgggcctggccggcgtgaccctgggcctgtacctgccccagggccagtacctgagagagggcgagtgctggctggacggcaagggcggcgccctgtacaccttcgtgggccccgtgctggccatcatcggcgtgaacggcctggtgctggccatggccatgctgaagctgctgagacccagcctgagcgagggcccccccgccgagaagagacaggccctgctgggcgtgatcaaggccctgctgatcctgacccccatcttcggcctgacctggggcctgggcctggccaccctgctggaggaggtgagcaccgtgccccactacatcttcaccatcctgaacaccctgcagggcgtgttcatcctgctgttcggctgcctgatggacagaaagatccaggaggccctgagaaagagattctgcagagcccaggcccccagcagcaccatcagcctggccaccaacgagggctgcatcctggagcacagcaagggcggcagcgacaccgccagatag

SEQ ID NO: 18464 - DNA, 1587 bp, Artificial Sequence
  Description of Artificial Sequence: Synthetic coding sequence
atggaccactgcggcgccctgttcctgtgcctgtgcctgctgaccctgcagaacgccaccaccgagacctgggaggagctgctgagctacatggagaacatgcaggtgagcagaggcagaagcagcgtgttcagcagcagacagctgcaccagctggagcagatgctgctgaacaccagcttccccggctacaacctgaccctgcagacccccaccatccagagcctggccttcaagctgagctgcgacttcagcggcctgagcctgaccagcgccaccctgaagagagtgccccaggccggcggccagcacgccagaggccagcacgccatgcagttccccgccgagctgaccagagacgcctgcaagaccagacccagagagctgagactgatctgcatctacttcagcaacacccacttcttcaaggacgagaacaacagcagcctgctgaacaactacgtgctgggcgcccagctgagccacggccacgtgaacaacctgagagaccccgtgaacatcagcttctggcacaaccagagcctggagggctacaccctgacctgcgtgttctggaaggagggcgccagaaagcagccctggggcggctggagccccgagggctgcagaaccgagcagcccagccacagccaggtgctgtgcagatgcaaccacctgacctacttcgccgtgctgatgcagctgagccccgccctggtgcccgccgagctgctggcccccctgacctacatcagcctggtgggctgcagcatcagcatcgtggccagcctgatcaccgtgctgctgcacttccacttcagaaagcagagcgacagcctgaccagaatccacatgaacctgcacgccagcgtgctgctgctgaacatcgccttcctgctgagccccgccttcgccatgagccccgtgcccggcagcgcctgcaccgccctggccgccgccctgcactacgccctgctgagctgcctgacctggatggccatcgagggcttcaacctgtacctgctgctgggcagagtgtacaacatctacatcagaagatacgtgttcaagctgggcgtgctgggctggggcgcccccgccctgctggtgctgctgagcctgagcgtgaagagcagcgtgtacggcccctgcaccatccccgtgttcgacagctgggagaacggcaccggcttccagaacatgagcatctgctgggtgagaagccccgtggtgcacagcgtgctggtgatgggctacggcggcctgaccagcctgttcaacctggtggtgctggcctgggccctgtggaccctgagaagactgagagagagagccgacgcccccagcgtgagagcctgccacgacaccgtgaccgtgctgggcctgaccgtgctgctgggcaccacctgggccctggccttcttcagcttcggcgtgttcctgctgccccagctgttcctgttcaccatcctgaacagcctgtacggcttcttcctgttcctgtggttctgcagccagagatgcagaagcgaggccgaggccaaggcccagatcgaggccttcagcagcagccagaccacccagtag

SEQ ID NO: 18465 - DNA, 1713 bp, Artificial Sequence
  Description of Artificial Sequence: Synthetic coding sequence
atggaccactgcggcgccctgttcctgtgcctgtgcctgctgaccctgcagaacgccaccaccgagacctgggaggagctgctgagctacatggagaacatgcaggtgagcagaggcagaagcagcgtgttcagcagcagacagctgcaccagctggagcagatgctgctgaacaccagcttccccggctacaacctgaccctgcagacccccaccatccagagcctggccttcaagctgagctgcgacttcagcggcctgagcctgaccagcgccaccctgaagagagtgccccaggccggcggccagcacgccagaggccagcacgccatgcagttccccgccgagctgaccagagacgcctgcaagaccagacccagagagctgagactgatctgcatctacttcagcaacacccacttcttcaaggacgagaacaacagcagcctgctgaacaactacgtgctgggcgcccagctgagccacggccacgtgaacaacctgagagaccccgtgaacatcagcttctggcacaaccagagcctggagggctacaccctgacctgcgtgttctggaaggagggcgccagaaagcagccctggggcggctggagccccgagggctgcagaaccgagcagcccagccacagccaggtgctgtgcagatgcaaccacctgacctacttcgccgtgctgatgcagctgagccccgccctggtgcccgccgagctgctggcccccctgacctacatcagcctggtgggctgcagcatcagcatcgtggccagcctgatcaccgtgctgctgcacttccacttcagaaagcagagcgacagcctgaccagaatccacatgaacctgcacgccagcgtgctgctgctgaacatcgccttcctgctgagccccgccttcgccatgagccccgtgcccggcagcgcctgcaccgccctggccgccgccctgcactacgccctgctgagctgcctgacctggatggccatcgagggcttcaacctgtacctgctgctgggcagagtgtacaacatctacatcagaagatacgtgttcaagctgggcgtgctgggctggggcgcccccgccctgctggtgctgctgagcctgagcgtgaagagcagcgtgtacggcccctgcaccatccccgtgttcgacagctgggagaacggcaccggcttccagaacatgagcatctgctgggtgagaagccccgtggtgcacagcgtgctggtgatgggctacggcggcctgaccagcctgttcaacctggtggtgctggcctgggccctgtggaccctgagaagactgagagagagagccgacgcccccagcgtgagagcctgccacgacaccgtgaccgtgctgggcctgaccgtgctgctgggcaccacctgggccctggccttcttcagcttcggcgtgttcctgctgccccagctgttcctgttcaccatcctgaacagcctgtacggcaagggcggcggcaccgtgagcaagaagagcgacgacaccaccgtgttcctgaagaacgacgagaccgcctggggcaagctgctgtgcctgccctacagcggcttcttcttcagcaagcccatcagcagcctggccatgatcagaggcaacacccccgcccccgtgggcggcgacgacatccccgccatctacgaggtggagcacttccagcaggagcaggtgtag

SEQ ID NO: 18466 - DNA, 1356 bp, Artificial Sequence
  Description of Artificial Sequence: Synthetic coding sequence
atggaccactgcggcgccctgttcctgtgcctgtgcctgctgaccctgcagaacgccaccaccgagacctgggaggagctgctgagctacatggagaacatgcaggtgagcagaggcagaagcagcgtgttcagcagcagacagctgcaccagctggagcagatgctgctgaacaccagcttccccggctacaacctgaccctgcagacccccaccatccagagcctggccttcaagctgagctgcgacttcagcggcctgagcctgaccagcgccaccctgaagagagtgccccaggccggcggccagcacgccagaggccagcacgccatgcagttccccgccgagctgaccagagacgcctgcaagaccagacccagagagctgagactgatctgcatctacttcagcaacacccacttcttcaaggacgagaacaacagcagcctgctgaacaactacgtgctgggcgcccagctgagccacggccacgtgaacaacctgagagaccccgtgaacatcagcttctggcacaaccagagcctggagggctacaccctgacctgcgtgttctggaaggagggcgccagaaagcagccctggggcggctggagccccgagggctgcagaaccgagcagcccagccacagccaggtgctgtgcagatgcaaccacctgacctacttcgccgtgctgatgcagctgagccccgccctggtgcccgccgagctgctggcccccctgacctacatcagcctggtgggctgcagcatcagcatcgtggccagcctgatcaccgtgctgctgcacttccacttcagaaagcagagcgacagcctgaccagaatccacatgaacctgcacgccagcgtgctgctgctgaacatcgccttcctgctgagccccgccttcgccatgagccccgtgcccggcagcgcctgcaccgccctggccgccgccctgcactacgccctgctgagctgcctgacctggatggccatcgagggcttcaacctgtacctgctgctgggcagagtgtacaacatctacatcagaagatacgtgttcaagctgggcgtgctgggctgggacgccggctgcggcgccccctggtgcaccgtgagctggagctgggccaccgccgccagcagacccagcagcacctggtggtgctggcccggcagatgcggcccctgcgccggctgcggcagcggcagaatgcaccaggtgagcggccccgccatgaccctgagcctgtgctgggccagcccctgctgctgggagccccccggcccctggcccagcttcctgctggccagcagctgctgccccagctgcagcagcagccccagctag

SEQ ID NO: 18467 - DNA, 4041 bp, Artificial Sequence
  Description of Artificial Sequence: Synthetic coding sequence
atgaagagccccagaagaaccaccctgtgcctgatgttcatcgtgatctacagcagcaaggccgccctgaactggaactacgagagcaccatccaccccctgagcctgcacgagcacgagcccgccggcgaggaggccctgagacagaagagagccgtggccaccaagagccccaccgccgaggagtacaccgtgaacatcgagatcagcttcgagaacgccagcttcctggaccccatcaaggcctacctgaacagcctgagcttccccatccacggcaacaacaccgaccagatcaccgacatcctgagcatcaacgtgaccaccgtgtgcagacccgccggcaacgagatctggtgcagctgcgagaccggctacggctggcccagagagagatgcctgcacaacctgatctgccaggagagagacgtgttcctgcccggccaccactgcagctgcctgaaggagctgccccccaacggccccttctgcctgctgcaggaggacgtgaccctgaacatgagagtgagactgaacgtgggcttccaggaggacctgatgaacaccagcagcgccctgtacagaagctacaagaccgacctggagaccgccttcagaaagggctacggcatcctgcccggcttcaagggcgtgaccgtgaccggcttcaagagcggcagcgtggtggtgacctacgaggtgaagaccaccccccccagcctggagctgatccacaaggccaacgagcaggtggtgcagagcctgaaccagacctacaagatggactacaacagcttccaggccgtgaccatcaacgagagcaacttcttcgtgacccccgagatcatcttcgagggcgacaccgtgagcctggtgtgcgagaaggaggtgctgagcagcaacgtgagctggagatacgaggagcagcagctggagatccagaacagcagcagattcagcatctacaccgccctgttcaacaacatgaccagcgtgagcaagctgaccatccacaacatcacccccggcgacgccggcgagtacgtgtgcaagctgatcctggacatcttcgagtacgagtgcaagaagaagatcgacgtgatgcccatccagatcctggccaacgaggagatgaaggtgatgtgcgacaacaaccccgtgagcctgaactgctgcagccagggcaacgtgaactggagcaaggtggagtggaagcaggagggcaagatcaacatccccggcacccccgagaccgacatcgacagcagctgcagcagatacaccctgaaggccgacggcacccagtgccccagcggcagcagcggcaccaccgtgatctacacctgcgagttcatcagcgcctacggcgccagaggcagcgccaacatcaaggtgaccttcatcagcgtggccaacctgaccatcacccccgaccccatcagcgtgagcgagggccagaacttcagcatcaagtgcatcagcgacgtgagcaactacgacgaggtgtactggaacaccagcgccggcatcaagatctaccagagattctacaccaccagaagatacctggacggcgccgagagcgtgctgaccgtgaagaccagcaccagagagtggaacggcacctaccactgcatcttcagatacaagaacagctacagcatcgccaccaaggacgtgatcgtgcaccccctgcccctgaagctgaacatcatggtggaccccctggaggccaccgtgagctgcagcggcagccaccacatcaagtgctgcatcgaggaggacggcgactacaaggtgaccttccacaccggcagcagcagcctgcccgccgccaaggaggtgaacaagaagcaggtgtgctacaagcacaacttcaacgccagcagcgtgagctggtgcagcaagaccgtggacgtgtgctgccacttcaccaacgccgccaacaacagcgtgtggagccccagcatgaagctgaacctggtgcccggcgagaacatcacctgccaggaccccgtgatcggcgtgggcgagcccggcaaggtgatccagaagctgtgcagattcagcaacgtgcccagcagccccgagagccccatcggcggcaccatcacctacaagtgcgtgggcagccagtgggaggagaagagaaacgactgcatcagcgcccccatcaacagcctgctgcagatggccaaggccctgatcaagagccccagccaggacgagatgctgcccacctacctgaaggacctgagcatcagcatcgacaaggccgagcacgagatcagcagcagccccggcagcctgggcgccatcatcaacatcctggacctgctgagcaccgtgcccacccaggtgaacagcgagatgatgacccacgtgctgagcaccgtgaacgtgatcctgggcaagcccgtgctgaacacctggaaggtgctgcagcagcagtggaccaaccagagcagccagctgctgcacagcgtggagagattcagccaggccctgcagagcggcgacagcccccccctgagcttcagccagaccaacgtgcagatgagcagcatggtgatcaagagcagccaccccgagacctaccagcagagattcgtgttcccctacttcgacctgtggggcaacgtggtgatcgacaagagctacctggagaacctgcagagcgacagcagcatcgtgaccatggccttccccaccctgcaggccatcctggcccaggacatccaggagaacaacttcgccgagagcctggtgatgaccaccaccgtgagccacaacaccaccatgcccttcagaatcagcatgaccttcaagaacaacagccccagcggcggcgagaccaagtgcgtgttctggaacttcagactggccaacaacaccggcggctgggacagcagcggctgctacgtggaggagggcgacggcgacaacgtgacctgcatctgcgaccacctgaccagcttcagcatcctgatgagccccgacagccccgaccccagcagcctgctgggcatcctgctggacatcatcagctacgtgggcgtgggcttcagcatcctgagcctggccgcctgcctggtggtggaggccgtggtgtggaagagcgtgaccaagaacagaaccagctacatgagacacacctgcatcgtgaacatcgccgccagcctgctggtggccaacacctggttcatcgtggtggccgccatccaggacaacagatacatcctgtgcaagaccgcctgcgtggccgccaccttcttcatccacttcttctacctgagcgtgttcttctggatgctgaccctgggcctgatgctgttctacagactggtgttcatcctgcacgagaccagcagaagcacccagaaggccatcgccttctgcctgggctacggctgccccctggccatcagcgtgatcaccctgggcgccacccagcccagagaggtgtacaccagaaagaacgtgtgctggctgaactgggaggacaccaaggccctgctggccttcgccatccccgccctgatcatcgtggtggtgaacatcaccatcaccatcgtggtgatcaccaagatcctgagacccagcatcggcgacaagccctgcaagcaggagaagagcagcctgttccagatcagcaagagcatcggcgtgctgacccccctgctgggcctgacctggggcttcggcctgaccaccgtgttccccggcaccaacctggtgttccacatcatcttcgccatcctgaacgtgttccagggcctgttcatcctgctgttcggctgcctgtgggacctgaaggtgcaggaggccctgctgaacaagttcagcctgagcagatggagcagccagcacagcaagagcaccagcctgggcagcagcacccccgtgttcagcatgagcagccccatcagcagaagattcaacaacctgttcggcaagaccggcacctacaacgtgagcacccccgaggccaccagcagcagcctggagaacagcagcagcgccagcagcctgctgaactag

SEQ ID NO: 18468 - DNA, 4041 bp, Artificial Sequence; identical to SEQ ID NO: 18467
  Description of Artificial Sequence: Synthetic coding sequence

SEQ ID NO: 18469 - DNA, 3981 bp, Artificial Sequence
  Description of Artificial Sequence: Synthetic coding sequence
atgaagagccccagaagaaccaccctgtgcctgatgttcatcgtgatctacagcagcaaggccgccctgaactggaactacgagagcaccatccaccccctgagcctgcacgagcacgagcccgccggcgaggaggccctgagacagaagagagccgtggccaccaagagccccaccgccgaggagtacaccgtgaacatcgagatcagcttcgagaacgccagcttcctggaccccatcaaggcctacctgaacagcctgagcttccccatccacggcaacaacaccgaccagatcaccgacatcctgagcatcaacgtgaccaccgtgtgcagacccgccggcaacgagatctggtgcagctgcgagaccggctacggctggcccagagagagatgcctgcacaacctgatctgccaggagagagacgtgttcctgcccggccaccactgcagctgcctgaaggagctgccccccaacggccccttctgcctgctgcaggaggacgtgaccctgaacatgagagtgagactgaacgtgggcttccaggaggacctgatgaacaccagcagcgccctgtacagaagctacaagaccgacctggagaccgccttcagaaagggctacggcatcctgcccggcttcaagggcgtgaccgtgaccggcttcaagagcggcagcgtggtggtgacctacgaggtgaagaccaccccccccagcctggagctgatccacaaggccaacgagcaggtggtgcagagcctgaaccagacctacaagatggactacaacagcttccaggccgtgaccatcaacgagagcaacttcttcgtgacccccgagatcatcttcgagggcgacaccgtgagcctggtgtgcgagaaggaggtgctgagcagcaacgtgagctggagatacgaggagcagcagctggagatccagaacagcagcagattcagcatctacaccgccctgttcaacaacatgaccagcgtgagcaagctgaccatccacaacatcacccccggcgacgccggcgagtacgtgtgcaagctgatcctggacatcttcgagtacgagtgcaagaagaagatcgacgtgatgcccatccagatcctggccaacgaggagatgaaggtgatgtgcgacaacaaccccgtgagcctgaactgctgcagccagggcaacgtgaactggagcaaggtggagtggaagcaggagggcaagatcaacatccccggcacccccgagaccgacatcgacagcagctgcagcagatacaccctgaaggccgacggcacccagtgccccagcggcagcagcggcaccaccgtgatctacacctgcgagttcatcagcgcctacggcgccagaggcagcgccaacatcaaggtgaccttcatcagcgtggccaacctgaccatcacccccgaccccatcagcgtgagcgagggccagaacttcagcatcaagtgcatcagcgacgtgagcaactacgacgaggtgtactggaacaccagcgccggcatcaagatctaccagagattctacaccaccagaagatacctggacggcgccgagagcgtgctgaccgtgaagaccagcaccagagagtggaacggcacctaccactgcatcttcagatacaagaacagctacagcatcgccaccaaggacgtgatcgtgcaccccctgcccctgaagctgaacatcatggtggaccccctggaggccaccgtgagctgcagcggcagccaccacatcaagtgctgcatcgaggaggacggcgactacaaggtgaccttccacaccggcagcagcagcctgcccgccgccaaggaggtgaacaagaagcaggtgtgctacaagcacaacttcaacgccagcagcgtgagctggtgcagcaagaccgtggacgtgtgctgccacttcaccaacgccgccaacaacagcgtgtggagccccagcatgaagctgaacctggtgcccggcgagaacatcacctgccaggaccccgtgatcggcgtgggcgagcccggcaaggtgatccagaagctgtgcagattcagcaacgtgcccagcagccccgagagccccatcggcggcaccatcacctacaagtgcgtgggcagccagtgggaggagaagagaaacgactgcatcagcgcccccatcaacagcctgctgcagatggccaaggccctgatcaagagccccagccaggacgagatgctgcccacctacctgaaggacctgagcatcagcatcgacaaggccgagcacgagatcagcagcagccccggcagcctgggcgccatcatcaacatcctggacctgctgagcaccgtgcccacccaggtgaacagcgagatgatgacccacgtgctgagcaccgtgaacgtgatcctgggcaagcccgtgctgaacacctggaaggtgctgcagcagcagtggaccaaccagagcagccagctgctgcacagcgtggagagattcagccaggccctgcagagcggcgacagcccccccctgagcttcagccagaccaacgtgcagatgagcagcatggtgatcaagagcagccaccccgagacctaccagcagagattcgtgttcccctacttcgacctgtggggcaacgtggtgatcgacaagagctacctggagaacctgcagagcgacagcagcatcgtgaccatggccttccccaccctgcaggccatcctggcccaggacatccaggagaacaacttcgccgagagcctggtgatgaccaccaccgtgagccacaacaccaccatgcccttcagaatcagcatgaccttcaagaacaacagccccagcggcggcgagaccaagtgcgtgttctggaacttcagactggccaacaacaccggcggctgggacagcagcggctgctacgtggaggagggcgacggcgacaacgtgacctgcatctgcgaccacctgaccagcttcagcatcctgatgagccccgacagccccgaccccagcagcctgctgggcatcctgctggacatcatcagctacgtgggcgtgggcttcagcatcctgagcctggccgcctgcctggtggtggaggccgtggtgtggaagagcgtgaccaagaacagaaccagctacatgagacacacctgcatcgtgaacatcgccgccagcctgctggtggccaacacctggttcatcgtggtggccgccatccaggacaacagatacatcctgtgcaagaccgcctgcgtggccgccaccttcttcatccacttcttctacctgagcgtgttcttctggatgctgaccctgggcctgatgctgttctacagactggtgttcatcctgcacgagaccagcagaagcacccagaaggccatcgccttctgcctgggctacggctgccccctggccatcagcgtgatcaccctgggcgccacccagcccagagaggtgtacaccagaaagaacgtgtgctggctgaactgggaggacaccaaggccctgctggccttcgccatccccgccctgatcatcgtggtggtgaacatcaccatcaccatcgtggtgatcaccaagatcctgagacccagcatcggcgacaagccctgcaagcaggagaagagcagcctgttccagatcagcaagagcatcggcgtgctgacccccctgctgggcctgacctggggcttcggcctgaccaccgtgttccccggcaccaacctggtgttccacatcatcttcgccatcctgaacgtgttccagggcctgttcatcctgctgttcggctgcctgtgggacctgaagagcaccagcctgggcagcagcacccccgtgttcagcatgagcagccccatcagcagaagattcaacaacctgttcggcaagaccggcacctacaacgtgagcacccccgaggccaccagcagcagcctggagaacagcagcagcgccagcagcctgctgaactag

SEQ ID NO: 18470 - DNA, 4041 bp, Artificial Sequence; identical to SEQ ID NO: 18467
  Description of Artificial Sequence: Synthetic coding sequence

SEQ ID NO: 18471 - DNA, 3615 bp, Artificial Sequence
  Description of Artificial Sequence: Synthetic coding sequence
atgaagagccccagaagaaccaccctgtgcctgatgttcatcgtgatctacagcagcaaggccgccctgaactggaactacgagagcaccatccaccccctgagcctgcacgagcacgagcccgccggcgaggaggccctgagacagaagagagccgtggccaccaagagccccaccgccgaggagtacaccgtgaacatcgagatcagcttcgagaacgccagcttcctggaccccatcaaggcctacctgaacagcctgagcttccccatccacggcaacaacaccgaccagatcaccgacatcctgagcatcaacgtgaccaccgtgtgcagacccgccggcaacgagatctggtgcagctgcgagaccggctacggctggcccagagagagatgcctgcacaacctgatctgccaggagagagacgtgttcctgcccggccaccactgcagctgcctgaaggagctgccccccaacggccccttctgcctgctgcaggaggacgtgaccctgaacatgagagtgagactgaacgtgggcttccaggaggacctgatgaacaccagcagcgccctgtacagaagctacaagaccgacctggagaccgccttcagaaagggctacggcatcctgcccggcttcaagggcgtgaccgtgaccggcttcaagagcggcagcgtggtggtgacctacgaggtgaagaccaccccccccagcctggagctgatccacaaggccaacgagcaggtggtgcagagcctgaaccagacctacaagatggactacaacagcttccaggccgtgaccatcagaacccccgagaccgacatcgacagcagctgcagcagatacaccctgaaggccgacggcacccagtgccccagcggcagcagcggcaccaccgtgatctacacctgcgagttcatcagcgcctacggcgccagaggcagcgccaacatcaaggtgaccttcatcagcgtggccaacctgaccatcacccccgaccccatcagcgtgagcgagggccagaacttcagcatcaagtgcatcagcgacgtgagcaactacgacgaggtgtactggaacaccagcgccggcatcaagatctaccagagattctacaccaccagaagatacctggacggcgccgagagcgtgctgaccgtgaagaccagcaccagagagtggaacggcacctaccactgcatcttcagatacaagaacagctacagcatcgccaccaaggacgtgatcgtgcaccccctgcccctgaagctgaacatcatggtggaccccctggaggccaccgtgagctgcagcggcagccaccacatcaagtgctgcatcgaggaggacggcgactacaaggtgaccttccacaccggcagcagcagcctgcccgccgccaaggaggtgaacaagaagcaggtgtgctacaagcacaacttcaacgccagcagcgtgagctggtgcagcaagaccgtggacgtgtgctgccacttcaccaacgccgccaacaacagcgtgtggagccccagcatgaagctgaacctggtgcccggcgagaacatcacctgccaggaccccgtgatcggcgtgggcgagcccggcaaggtgatccagaagctgtgcagattcagcaacgtgcccagcagccccgagagccccatcggcggcaccatcacctacaagtgcgtgggcagccagtgggaggagaagagaaacgactgcatcagcgcccccatcaacagcctgctgcagatggccaaggccctgatcaagagccccagccaggacgagatgctgcccacctacctgaaggacctgagcatcagcatcgacaaggccgagcacgagatcagcagcagccccggcagcctgggcgccatcatcaacatcctggacctgctgagcaccgtgcccacccaggtgaacagcgagatgatgacccacgtgctgagcaccgtgaacgtgatcctgggcaagcccgtgctgaacacctggaaggtgctgcagcagcagtggaccaaccagagcagccagctgctgcacagcgtggagagattcagccaggccctgcagagcggcgacagcccccccctgagcttcagccagaccaacgtgcagatgagcagcatggtgatcaagagcagccaccccgagacctaccagcagagattcgtgttcccctacttcgacctgtggggcaacgtggtgatcgacaagagctacctggagaacctgcagagcgacagcagcatcgtgaccatggccttccccaccctgcaggccatcctggcccaggacatccaggagaacaacttcgccgagagcctggtgatgaccaccaccgtgagccacaacaccaccatgcccttcagaatcagcatgaccttcaagaacaacagccccagcggcggcgagaccaagtgcgtgttctggaacttcagactggccaacaacaccggcggctgggacagcagcggctgctacgtggaggagggcgacggcgacaacgtgacctgcatctgcgaccacctgaccagcttcagcatcctgatgagccccgacagccccgaccccagcagcctgctgggcatcctgctggacatcatcagctacgtgggcgtgggcttcagcatcctgagcctggccgcctgcctggtggtggaggccgtggtgtggaagagcgtgaccaagaacagaaccagctacatgagacacacctgcatcgtgaacatcgccgccagcctgctggtggccaacacctggttcatcgtggtggccgccatccaggacaacagatacatcctgtgcaagaccgcctgcgtggccgccaccttcttcatccacttcttctacctgagcgtgttcttctggatgctgaccctgggcctgatgctgttctacagactggtgttcatcctgcacgagaccagcagaagcacccagaaggccatcgccttctgcctgggctacggctgccccctggccatcagcgtgatcaccctgggcgccacccagcccagagaggtgtacaccagaaagaacgtgtgctggctgaactgggaggacaccaaggccctgctggccttcgccatccccgccctgatcatcgtggtggtgaacatcaccatcaccatcgtggtgatcaccaagatcctgagacccagcatcggcgacaagccctgcaagcaggagaagagcagcctgttccagatcagcaagagcatcggcgtgctgacccccctgctgggcctgacctggggcttcggcctgaccaccgtgttccccggcaccaacctggtgttccacatcatcttcgccatcctgaacgtgttccagggcctgttcatcctgctgttcggctgcctgtgggacctgaaggtgcaggaggccctgctgaacaagttcagcctgagcagatggagcagccagcacagcaagagcaccagcctgggcagcagcacccccgtgttcagcatgagcagccccatcagcagaagattcaacaacctgttcggcaagaccggcacctacaacgtgagcacccccgaggccaccagcagcagcctggagaacagcagcagcgccagcagcctgctgaactag

SEQ ID NO: 18472 - DNA, 2154 bp, Artificial Sequence
  Description of Artificial Sequence: Synthetic coding sequence
gactacagaagccaggtgcacgtggagagcagagagggcctgtggaagatcaagggcaagatcaagaagctgggcagcagcgagaaggtgaccgagagcaagggcgagaacatcacctgccaggaccccgtgatcggcgtgggcgagcccggcaaggtgatccagaagctgtgcagattcagcaacgtgcccagcagccccgagagccccatcggcggcaccatcacctacaagtgcgtgggcagccagtgggaggagaagagaaacgactgcatcagcgcccccatcaacagcctgctgcagatggccaaggccctgatcaagagccccagccaggacgagatgctgcccacctacctgaaggacctgagcatcagcatcgacaaggccgagcacgagatcagcagcagccccggcagcctgggcgccatcatcaacatcctggacctgctgagcaccgtgcccacccaggtgaacagcgagatgatgacccacgtgctgagcaccgtgaacgtgatcctgggcaagcccgtgctgaacacctggaaggtgctgcagcagcagtggaccaaccagagcagccagctgctgcacagcgtggagagattcagccaggccctgcagagcggcgacagcccccccctgagcttcagccagaccaacgtgcagatgagcagcatggtgatcaagagcagccaccccgagacctaccagcagagattcgtgttcccctacttcgacctgtggggcaacgtggtgatcgacaagagctacctggagaacctgcagagcgacagcagcatcgtgaccatggccttccccaccctgcaggccatcctggcccaggacatccaggagaacaacttcgccgagagcctggtgatgaccaccaccgtgagccacaacaccaccatgcccttcagaatcagcatgaccttcaagaacaacagccccagcggcggcgagaccaagtgcgtgttctggaacttcagactggccaacaacaccggcggctgggacagcagcggctgctacgtggaggagggcgacggcgacaacgtgacctgcatctgcgaccacctgaccagcttcagcatcctgatgagccccgacagccccgaccccagcagcctgctgggcatcctgctggacatcatcagctacgtgggcgtgggcttcagcatcctgagcctggccgcctgcctggtggtggaggccgtggtgtggaagagcgtgaccaagaacagaaccagctacatgagacacacctgcatcgtgaacatcgccgccagcctgctggtggccaacacctggttcatcgtggtggccgccatccaggacaacagatacatcctgtgcaagaccgcctgcgtggccgccaccttcttcatccacttcttctacctgagcgtgttcttctggatgctgaccctgggcctgatgctgttctacagactggtgttcatcctgcacgagaccagcagaagcacccagaaggccatcgccttctgcctgggctacggctgccccctggccatcagcgtgatcaccctgggcgccacccagcccagagaggtgtacaccagaaagaacgtgtgctggctgaactgggaggacaccaaggccctgctggccttcgccatccccgccctgatcatcgtggtggtgaacatcaccatcaccatcgtggtgatcaccaagatcctgagacccagcatcggcgacaagccctgcaagcaggagaagagcagcctgttccagatcagcaagagcatcggcgtgctgacccccctgctgggcctgacctggggcttcggcctgaccaccgtgttccccggcaccaacctggtgttccacatcatcttcgccatcctgaacgtgttccagggcctgttcatcctgctgttcggctgcctgtgggacctgaaggtgcaggaggccctgctgaacaagttcagcctgagcagatggagcagccagcacagcaagagcaccagcctgggcagcagcacccccgtgttcagcatgagcagccccatcagcagaagattcaacaacctgttcggcaagaccggcacctacaacgtgagcacccccgaggccaccagcagcagcctggagaacagcagcagcgccagcagcctgctgaactag

SEQ ID NO: 18473 - DNA, 2313 bp, Artificial Sequence
  Description of Artificial Sequence: Synthetic coding sequence
atggtggaccccctggaggccaccgtgagctgcagcggcagccaccacatcaagtgctgcatcgaggaggacggcgactacaaggtgaccttccacaccggcagcagcagcctgcccgccgccaaggaggtgaacaagaagcaggtgtgctacaagcacaacttcaacgccagcagcgtgagctggtgcagcaagaccgtggacgtgtgctgccacttcaccaacgccgccaacaacagcgtgtggagccccagcatgaagctgaacctggtgcccggcgagaacatcacctgccaggaccccgtgatcggcgtgggcgagcccggcaaggtgatccagaagctgtgcagattcagcaacgtgcccagcagccccgagagccccatcggcggcaccatcacctacaagtgcgtgggcagccagtgggaggagaagagaaacgactgcatcagcgcccccatcaacagcctgctgcagatggccaaggccctgatcaagagccccagccaggacgagatgctgcccacctacctgaaggacctgagcatcagcatcgacaaggccgagcacgagatcagcagcagccccggcagcctgggcgccatcatcaacatcctggacctgctgagcaccgtgcccacccaggtgaacagcgagatgatgacccacgtgctgagcaccgtgaacgtgatcctgggcaagcccgtgctgaacacctggaaggtgctgcagcagcagtggaccaaccagagcagccagctgctgcacagcgtggagagattcagccaggccctgcagagcggcgacagcccccccctgagcttcagccagaccaacgtgcagatgagcagcatggtgatcaagagcagccaccccgagacctaccagcagagattcgtgttcccctacttcgacctgtggggcaacgtggtgatcgacaagagctacctggagaacctgcagagcgacagcagcatcgtgaccatggccttccccaccctgcaggccatcctggcccaggacatccaggagaacaacttcgccgagagcctggtgatgaccaccaccgtgagccacaacaccaccatgcccttcagaatcagcatgaccttcaagaacaacagccccagcggcggcgagaccaagtgcgtgttctggaacttcagactggccaacaacaccggcggctgggacagcagcggctgctacgtggaggagggcgacggcgacaacgtgacctgcatctgcgaccacctgaccagcttcagcatcctgatgagccccgacagccccgaccccagcagcctgctgggcatcctgctggacatcatcagctacgtgggcgtgggcttcagcatcctgagcctggccgcctgcctggtggtggaggccgtggtgtggaagagcgtgaccaagaacagaaccagctacatgagacacacctgcatcgtgaacatcgccgccagcctgctggtggccaacacctggttcatcgtggtggccgccatccaggacaacagatacatcctgtgcaagaccgcctgcgtggccgccaccttcttcatccacttcttctacctgagcgtgttcttctggatgctgaccctgggcctgatgctgttctacagactggtgttcatcctgcacgagaccagcagaagcacccagaaggccatcgccttctgcctgggctacggctgccccctggccatcagcgtgatcaccctgggcgccacccagcccagagaggtgtacaccagaaagaacgtgtgctggctgaactgggaggacaccaaggccctgctggccttcgccatccccgccctgatcatcgtggtggtgaacatcaccatcaccatcgtggtgatcaccaagatcctgagacccagcatcggcgacaagccctgcaagcaggagaagagcagcctgttccagatcagcaagagcatcggcgtgctgacccccctgctgggcctgacctggggcttcggcctgaccaccgtgttccccggcaccaacctggtgttccacatcatcttcgccatcctgaacgtgttccagggcctgttcatcctgctgttcggctgcctgtgggacctgaaggtgcaggaggccctgctgaacaagttcagcctgagcagatggagcagccagcacagcaagagcaccagcctgggcagcagcacccccgtgttcagcatgagcagccccatcagcagaagattcaacaacctgttcggcaagaccgccgcccccaagatcccccccggccacgacggcaacctggtgagcggcggcagcagcgccatctag

SEQ ID NO: 18474 - DNA, 1008 bp, Artificial Sequence
  Description of Artificial Sequence: Synthetic coding sequence
atggagagcagcttcagcttcggcgtgatcctggccgtgctggccagcctgatcatcgccaccaacaccctggtggccgtggccgtgctgctgctgatccacaagaacgacggcgtgagcctgtgcttcaccctgaacctggccgtggccgacaccctgatcggcgtggccatcagcggcctgctgaccgaccagctgagcagccccagcagacccacccagaagaccctgtgcagcctgagaatggccttcgtgaccagcagcgccgccgccagcgtgctgaccgtgatgctgatcaccttcgacagatacctggccatcaagcagcccttcagatacctgaagatcatgagcggcttcgtggccggcgcctgcatcgccggcctgtggctggtgagctacctgatcggcttcctgcccctgggcatccccatgttccagcagaccgcctacaagggccagtgcagcttcttcgccgtgttccacccccacttcgtgctgaccctgagctgcgtgggcttcttccccgccatgctgctgttcgtgttcttctactgcgacatgctgaagatcgccagcatgcacagccagcagatcagaaagatggagcacgccggcgccatggccggcggctacagaagccccagaacccccagcgacttcaaggccctgagaaccgtgagcgtgctgatcggcagcttcgccctgagctggacccccttcctgatcaccggcatcgtgcaggtggcctgccaggagtgccacctgtacctggtgctggagagatacctgtggctgctgggcgtgggcaacagcctgctgaaccccctgatctacgcctactggcagaaggaggtgagactgcagctgtaccacatggccctgggcgtgaagaaggtgctgaccagcttcctgctgttcctgagcgccagaaactgcggccccgagagacccagagagagcagctgccacatcgtgaccatcagcagcagcgagttcgacggctag

SEQ ID NO: 18475 - DNA, 1485 bp, Artificial Sequence
  Description of Artificial Sequence: Synthetic coding sequence
atggaggagccccagccccccagaccccccgccagcatggccctgctgggcagccagcacagcggcgcccccagcgccgccggcccccccggcggcaccagcagcgccgccaccgccgccgtgctgagcttcagcaccgtggccaccgccgccctgggcaacctgagcgacgccagcggcggcggcaccgccgccgcccccggcggcggcggcctgggcggcagcggcgccgccagagaggccggcgccgccgtgagaagacccctgggccccgaggccgcccccctgctgagccacggcgccgccgtggccgcccaggccctggtgctgctgctgatcttcctgctgagcagcctgggcaactgcgccgtgatgggcgtgatcgtgaagcacagacagctgagaaccgtgaccaacgccttcatcctgagcctgagcctgagcgacctgctgaccgccctgctgtgcctgcccgccgccttcctggacctgttcaccccccccggcggcagcgcccccgccgccgccgccggcccctggagaggcttctgcgccgccagcagattcttcagcagctgcttcggcatcgtgagcaccctgagcgtggccctgatcagcctggacagatactgcgccatcgtgagaccccccagagagaagatcggcagaagaagagccctgcagctgctggccggcgcctggctgaccgccctgggcttcagcctgccctgggagctgctgggcgcccccagagagctggccgccgcccagagcttccacggctgcctgtacagaaccagccccgaccccgcccagctgggcgccgccttcagcgtgggcctggtggtggcctgctacctgctgcccttcctgctgatgtgcttctgccactaccacatctgcaagaccgtgagactgagcgacgtgagagtgagacccgtgaacacctacgccagagtgctgagattcttcagcgaggtgagaaccgccaccaccgtgctgatcatgatcgtgttcgtgatctgctgctggggcccctactgcttcctggtgctgctggccgccgccagacaggcccagaccatgcaggcccccagcctgctgagcgtggtggccgtgtggctgacctgggccaacggcgccatcaaccccgtgatctacgccatcagaaaccccaacatcagcatgctgctgggcagaaacagagaggagggctacagaaccagaaacgtggacgccttcctgcccagccagggccccggcctgcaggccagaagcagaagcagactgagaaacagatacgccaacagactgggcgcctgcaacagaatgagcagcagcaaccccgccagcggcgtggccggcgacgtggccatgtgggccagaaagaaccccgtggtgctgttctgcagagagggcccccccgagcccgtgaccgccgtgaccaagcagcccaagagcgaggccggcgacaccagcctgtag

SEQ ID NO: 18476 - DNA, 1485 bp, Artificial Sequence; identical to SEQ ID NO: 18475
  Description of Artificial Sequence: Synthetic coding sequence

SEQ ID NO: 18477 - DNA, 969 bp, Artificial Sequence
  Description of Artificial Sequence: Synthetic coding sequence
atggccctgctgggcagccagcacagcggcgcccccagcgccgccggcccccccggcggcaccagcagcgccgccaccgccgccgtgctgagcttcagcaccgtggccaccgccgccctgggcaacctgagcgacgccagcggcggcggcaccgccgccgcccccggcggcggcggcctgggcggcagcggcgccgccagagaggccggcgccgccgtgagaagacccctgggccccgaggccgcccccctgctgagccacggcgccgccgtggccgcccaggccctggtgctgctgctgatcttcctgctgagcagcctgggcaactgcgccgtgatgggcgtgatcgtgaagcacagacagctgagaaccgtgaccaacgccttcatcctgagcctgagcctgagcgacctgctgaccgccctgctgtgcctgcccgccgccttcctggacctgttcaccccccccggcggcagcgcccccgccgccgccgccggcccctggagaggcttctgcgccgccagcagattcttcagcagctgcttcggcatcgtgcacgcccagagaggcgcccacctggtgggccccctgctgagatacagaagaccccccagagagaagatcggcagaagaagagccctgcagctgctggccggcgcctggctgaccgccctgggcttcagcctgccctgggagctgctgggcgcccccagagagctggccgccgcccagagcttccacggctgcctgtacagaaccagccccgaccccgcccagctgggcgccgccttcagcgtgggcctggtggtggcctgctacctgctgcccttcctgctgatgtgcttctgccactaccacatctgcaagaccgtgagactgagcgacgtgagagtgagacccgtgaacacctacgccagagtgctgagaagcagcgccagatgcgccagacccccccccagcagcagctag

SEQ ID NO: 18478 - DNA, 1254 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgccatgggcggcgccatggtgctgctgtacgccagcagagcctgctacaacctgaccgccctggccctggccccccagagcagactggacaccttcgactacgactggtacaacgtgagcgaccaggccgacctggtgaacgacctgggcaacaagggctacctggtgttcggcctgatcctgttcgtgtgggagctgctgcccaccaccctgctggtgggcttcttcagagtgcacagacccccccaggacctgagcaccagccacatcctgaacggccaggtgttcgccagcagaagctacttcttcgacagagccggccactgcgaggacgagggctgcagctgggagcacagcagaggcgagagcaccagatgccaggaccaggccgccaccaccaccgtgagcacccccccccacagaagagaccccccccccagccccaccgagtaccccggccccagccccccccaccccagacccctgtgccaggtgtgcctgcccctgctggcccaggaccccggcggcagaggctaccccctgctgtggcccgccccctgctgcagctgccacagcgagctggtgcccagcccctag

SEQ ID NO: 18479 - DNA, 1041 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaaggccgacctggtgaacgacctgggcaacaagggctacctggtgttcggcctgatcctgttcgtgtgggagctgctgcccaccaccctgctggtgggcttcttcagagtgcacagacccccccaggacctgagcaccagccacatcctgaacggccaggtgttcgccagcagaagctacttcttcgacagagccggccactgcgaggacgagggctgcagctgggagcacagcagaggcgagagcaccagcatgagcggcagcctgggcagcggcagctggtacggcgccatcggcagagagcccggctggtacggcggcagccagaccaagaccacccccctgctgttcagccaggtgcccggccccggcggccaccaccacagcctgtacagcaccccccagacctag

SEQ ID NO: 18480 - DNA, 1428 bp, Artificial Sequence
  Description of Artificial Sequence: Synthetic coding sequence
atgctgtgggccgtgagaaccagatgctacgtggtgaaggcccagctgggccccaccgtggccctggagggcagagcccccagagcccccggccccagctgcctgggcaacggcaactgccagagacccggccccatcaccagcagaaacgtgaccagagccagcctgcccgacatggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgccatgggcggcgccatggtgctgctgtacgccagcagagcctgctacaacctgaccgccctggccctggccccccagagcagactggacaccttcgactacgactggtacaacgtgagcgaccaggccgacctggtgaacgacctgggcaacaagggctacctggtgttcggcctgatcctgttcgtgtgggagctgctgcccaccaccctgctggtgggcttcttcagagtgcacagacccccccaggacctgagcaccagccacatcctgaacggccaggtgttcgccagcagaagctacttcttcgacagagccggccactgcgaggacgagggctgcagctgggagcacagcagaggcgagagcaccagatgccaggaccaggccgccaccaccaccgtgagcacccccccccacagaagagaccccccccccagccccaccgagtaccccggccccagccccccccaccccagacccctgtgccaggtgtgcctgcccctgctggcccaggaccccggcggcagaggctaccccctgctgtggcccgccccctgctgcagctgccacagcgagctggtgcccagcccctag

SEQ ID NO: 18481 - DNA, 1191 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgccatgggcggcgccatggtgctgctgtacgccagcagagcctgctacaacctgaccgccctggccctggccccccagagcagactggacaccttcgactacgactggtacaacgtgagcgaccaggccgacctggtgaacgacctgggcaacaagggctacctggtgttcggcctgatcctgttcgtgtgggagctgctgcccaccaccctgctggtgggcttcttcagagtgcacagacccccccaggacctgagcaccagccacatcctgaacggccaggtgttcgccagcagaagctacttcttcgacagagccggccactgcgaggacgagggctgcagctgggagcacagcagaggcgagagcaccagcatgagcggcagcctgggcagcggcagctggtacggcgccatcggcagagagcccggctggtacggcggcagccagaccaagaccacccccctgctgttcagccaggtgcccggccccggcggccaccaccacagcctgtacagcaccccccagacctag

SEQ ID NO: 18482 - DNA, 399 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgtag

SEQ ID NO: 18483 - DNA, 504 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagtag

SEQ ID NO: 18484 - DNA, 192 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctgtag

SEQ ID NO: 18485 - DNA, 663 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgcctag

SEQ ID NO: 18486 - DNA, 963 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgccatgggcggcgccatggtgctgctgtacgccagcagagcctgctacaacctgaccgccctggccctggccccccagagcagactggacaccttcgactacgactggtacaacgtgagcgaccaggccgacctggtgaacgacctgggcaacaagggctacctggtgttcggcctgatcctgttcgtgtgggagctgctgcccaccaccctgctggtgggcttcttcagagtgcacagacccccccaggacctgtacgtgggccagagcagactgtgggagctggtgtggtgccacagagcctag

SEQ ID NO: 18487 - DNA, 237 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagctag

SEQ ID NO: 18488 - DNA, 636 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccggcggcagaccccccctggccagcacctggagacccagatag

SEQ ID NO: 18489 - DNA, 723 bp, Artificial Sequence
  Description of Artificial Sequence: Synthetic coding sequence
atggagagcaacctgagcggcctggtgcccgccgccggcctggtgcccgccctgccccccgccgtgaccctgggcctgaccgccgcctacaccaccctgtacgccctgctgttcttcagcgtgtacgcccagctgtggctggtgctgctgtacggccacaagagactgagctaccagaccgtgttcctggccctgtgcctgctgtgggccgccctgagaaccaccctgttcagcttctacttcagagacacccccagagccaacagactgggccccctgcccttctggctgctgtactgctgccccgtgtgcctgcagttcttcaccctgaccctgatgaacctgtacttcgcccaggtggtgttcaaggccaaggtgaagagaagacccgagatgagcagaggcctgctggccgtgagaggcgccttcgtgggcgccagcctgctgttcctgctggtgaacgtgctgtgcgccgtgctgagccacagaagaagagcccagccctgggccctgctgctggtgagagtgctggtgagcgacagcctgttcgtgatctgcgccctgagcctggccgcctgcctgtgcctggtggccagaagagcccccagcaccagcatctacctggaggccaagggcaccagcgtgtgccaggccgccgccatgggcggcgccatggtgctgctgtacgccagcagagcctgctacaacctgaccgccctgtag

SEQ ID NO: 18490 - DNA, 702 bp, Artificial Sequence
  Description of Artificial Sequence: Synthetic coding sequence
atgagacccgagagacccagacccagaggcagcgcccccggccccatggagacccccccctgggaccccgccagaaacgacagcctgccccccaccctgacccccgccgtgcccccctacgtgaagctgggcctgaccgtggtgtacaccgtgttctacgccctgctgttcgtgttcatctacgtgcagctgtggctggtgctgagatacagacacaagagactgagctaccagagcgtgttcctgttcctgtgcctgttctgggccagcctgagaaccgtgctgttcagcttctacttcaaggacttcgtggccgccaacagcctgagccccttcgtgttctggctgctgtactgcttccccgtgtgcctgcagttcttcaccctgaccctgatgaacctgtacttcacccagggcagcagcgtgtgccaggtgaccgccatcggcgtgaccgtgatcctgctgtacaccagcagagcctgctacaacctgttcatcctgagcttcagccagaacaagagcgtgcacagcttcgactacgactggtacaacgtgagcgaccaggtgagcggcggcgccgaggaggtgagccccgaccagggcctgctggtgagcagcagacactggttccaggaccccagaaagtaccagaacctggacgcccaggtgcccgacatcaagtggtgcagcatctgcatctag

SEQ ID NO: 18491 - DNA, 1200 bp, Artificial Sequence
  Description of Artificial Sequence: Synthetic coding sequence
atgagacccgagagacccagacccagaggcagcgcccccggccccatggagacccccccctgggaccccgccagaaacgacagcctgccccccaccctgacccccgccgtgcccccctacgtgaagctgggcctgaccgtggtgtacaccgtgttctacgccctgctgttcgtgttcatctacgtgcagctgtggctggtgctgagatacagacacaagagactgagctaccagagcgtgttcctgttcctgtgcctgttctgggccagcctgagaaccgtgctgttcagcttctacttcaaggacttcgtggccgccaacagcctgagccccttcgtgttctggctgctgtactgcttccccgtgtgcctgcagttcttcaccctgaccctgatgaacctgtacttcacccaggtgatcttcaaggccaagagcaagtacagccccgagctgctgaagtacagactgcccctgtacctggccagcctgttcatcagcctggtgttcctgctggtgaacctgacctgcgccgtgctggtgaagaccggcaactgggagagaaaggtgatcgtgagcgtgagagtggccatcaacgacaccctgttcgtgctgtgcgccgtgagcctgagcatctgcctgtacaagatcagcaagatgagcctggccaacatctacctggagagcaagggcagcagcgtgtgccaggtgaccgccatcggcgtgaccgtgatcctgctgtacaccagcagagcctgctacaacctgttcatcctgagcttcagccagaacaagagcgtgcacagcttcgactacgactggtacaacgtgagcgaccaggccgacctgaagaaccagctgggcgacgccggctacgtgctgttcggcgtggtgctgttcgtgtgggagctgctgcccaccaccctggtggtgtacttcttcagagtgagaaaccccaccaaggacctgaccaaccccggcatggtgcccagccacggcttcagccccagaagctacttcttcgacaaccccagaagatacgacagcgacgacgacctggcctggaacatcgccccccagggcctgcagggcggcttcgcccccgactactacgactggggccagcagaccaacagcttcctggcccaggccggcaccctgcaggacagcaccctggaccccgacaagcccagcctgggctag

SEQ ID NO: 18492 - DNA, 1197 bp, Artificial Sequence
  Description of Artificial Sequence: Synthetic coding sequence
atgagaggcgaccccagacccagaggcagcgcccccggccccatggagacccccccctgggaccccgccagaaacgacagcctgccccccaccctgacccccgccgtgcccccctacgtgaagctgggcctgaccgtggtgtacaccgtgttctacgccctgctgttcgtgttcatctacgtgcagctgtggctggtgctgagatacagacacaagagactgagctaccagagcgtgttcctgttcctgtgcctgttctgggccagcctgagaaccgtgctgttcagcttctacttcaaggacttcgtggccgccaacagcctgagccccttcgtgttctggctgctgtactgcttccccgtgtgcctgcagttcttcaccctgaccctgatgaacctgtacttcacccaggtgatcttcaaggccaagagcaagtacagccccgagctgctgaagtacagactgcccctgtacctggccagcctgttcatcagcctggtgttcctgctggtgaacctgacctgcgccgtgctggtgaagaccggcaactgggagagaaaggtgatcgtgagcgtgagagtggccatcaacgacaccctgttcgtgctgtgcgccgtgagcctgagcatctgcctgtacaagatcagcaagatgagcctggccaacatctacctggagagcaagggcagcagcgtgtgccaggtgaccgccatcggcgtgaccgtgatcctgctgtacaccagcagagcctgctacaacctgttcatcctgagcttcagccagaacaagagcgtgcacagcttcgactacgactggtacaacgtgagcgaccaggccgacctgaagaaccagctgggcgacgccggctacgtgctgttcggcgtggtgctgttcgtgtgggagctgctgcccaccaccctggtggtgtacttcttcagagtgagaaaccccaccaaggacctgaccaaccccggcatggtgcccagccacggcttcagccccagaagctacttcttcgacaaccccagaagatacgacagcgacgacgacctggcctggaacatcgccccccagggcctgcagggcggcttcgcccccgactactacgactggggccagcagaccaacagcttcctggcccaggccggcaccctgcaggacagcaccctggaccccgacaagcccagcctgggctag

SEQ ID NO: 18493 - DNA, 387 bp, Artificial Sequence
  Description of Artificial Sequence: Synthetic coding sequence
atgagcctggccaacatctacctggagagcaagggcagcagcgtgtgccaggtgaccgccatcggcgtgaccgtgatcctgctgtacaccagcagagcctgctacaacctgttcatcctgagcttcagccagaacaagagcgtgcacagcttcgactacgactggtacaacgtgagcgaccaggccgacctgaagaaccagctgggcgacgccggctacgtgctgttcggcgtggtgctgttcgtgtgggagctgctgcccaccaccctggtggtgtacttcttcagagtgagaaaccccaccaaggacctgaccaaccccggcatggtgcccagccacggcttcagccccagaagctacttcttcgacaaccccagaagatactag

SEQ ID NO: 18494 - DNA, 693 bp, Artificial Sequence
  Description of Artificial Sequence: Synthetic coding sequence
tgacaggtgatcttcaaggccaagagcaagtacagccccgagctgctgaagtacagactgcccctgtacctggccagcctgttcatcagcctggtgttcctgctggtgaacctgacctgcgccgtgctggtgaagaccggcaactgggagagaaaggtgatcgtgagcgtgagagtggccatcaacgacaccctgttcgtgctgtgcgccgtgagcctgagcatctgcctgtacaagatcagcaagatgagcctggccaacatctacctggagagcaagggcagcagcgtgtgccaggtgaccgccatcggcgtgaccgtgatcctgctgtacaccagcagagcctgctacaacctgttcatcctgagcttcagccagaacaagagcgtgcacagcttcgactacgactggtacaacgtgagcgaccaggccgacctgaagaaccagctgggcgacgccggctacgtgctgttcggcgtggtgctgttcgtgtgggagctgctgcccaccaccctggtggtgtacttcttcagagtgagaaaccccaccaaggacctgaccaaccccggcatggtgcccagccacggcttcagccccagaagctacttcttcgacaaccccagaagatacgacagcgacgacgacctggcctggaacatcgccccccagggcctgcagggcggcctgctgtag

SEQ ID NO: 18495 - DNA, 1290 bp, Artificial Sequence
  Description of Artificial Sequence: Synthetic coding sequence
atgagagtgagcgtgcccggccccgccgccgccgccgcccccgccgccggcagagagcccagcacccccggcggcggcagcggcggcggcggcgccgtggccgccgccagcggcgccgccgtgcccggcagcgtgcagctggccctgagcgtgctgcacgccctgctgtacgccgccctgttcgccttcgcctacctgcagctgtggagactgctgctgtacagagagagaagactgagctaccagagcctgtgcctgttcctgtgcctgctgtgggccgccctgagaaccaccctgttcagcgccgccttcagcctgagcggcagcctgcccctgctgagaccccccgcccacctgcacttcttcccccactggctgctgtactgcttccccagctgcctgcagttcagcaccctgtgcctgctgaacctgtacctggccgaggtgatctgcaaggtgagatgcgccaccgagctggacagacacaagatcctgctgcacctgggcttcatcatggccagcctgctgttcctggtggtgaacctgacctgcgccatgctggtgcacggcgacgtgcccgagaaccagctgaagtggaccgtgttcgtgagagccctgatcaacgacagcctgttcatcctgtgcgccatcagcctggtgtgctacatctgcaagatcaccaagatgagcagcgccaacgtgtacctggagagcaagggcatgagcctgtgccagaccgtggtggtgggcagcgtggtgatcctgctgtacagcagcagagcctgctacaacctggtggtggtgaccatcagccaggacaccctggagagccccttcaactacggctgggacaacctgagcgacaaggcccacgtggaggacatcagcggcgaggagtacatcgtgttcggcatggtgctgttcctgtgggagcacgtgcccgcctggagcgtggtgctgttcttcagagcccagagactgaaccagaacctggcccccgccggcatgatcaacagccacagctacagcagcagagcctacttcttcgacaaccccagaagatacgacagcgacgacgacctgcccagactgggcagcagcagagagggcagcctgcccaacagccagagcctgggctggtacggcaccatgaccggctgcggcagcagcagctacaccgtgaccccccacctgaacggccccatgaccgacaccgcccccctgctgttcacctgcagcaacctggacctgaacaaccaccacagcctgtacgtgaccccccagaactag

SEQ ID NO: 18496 - DNA, 1062 bp, Artificial Sequence
  Description of Artificial Sequence: Synthetic coding sequence
atggagcacacccacgcccacctggccgccaacagcagcctgagctggtggagccccggcagcgcctgcggcctgggcttcgtgcccgtggtgtactacagcctgctgctgtgcctgggcctgcccgccaacatcctgaccgtgatcatcctgagccagctggtggccagaagacagaagagcagctacaactacctgctggccctggccgccgccgacatcctggtgctgttcttcatcgtgttcgtggacttcctgctggaggacttcatcctgaacatgcagatgccccaggtgcccgacaagatcatcgaggtgctggagttcagcagcatccacaccagcatctggatcaccgtgcccctgaccatcgacagatacatcgccgtgtgccaccccctgaagtaccacaccgtgagctaccccgccagaaccagaaaggtgatcgtgagcgtgtacatcacctgcttcctgaccagcatcccctactactggtggcccaacatctggaccgaggactacatcagcaccagcgtgcaccacgtgctgatctggatccactgcttcaccgtgtacctggtgccctgcagcatcttcttcatcctgaacagcatcatcgtgtacaagctgagaagaaagagcaacttcagactgagaggctacagcaccggcaagaccaccgccatcctgttcaccatcaccagcatcttcgccaccctgtgggcccccagaatcatcatgatcctgtaccacctgtacggcgcccccatccagaacagatggctggtgcacatcatgagcgacatcgccaacatgctggccctgctgaacaccgccatcaacttcttcctgtactgcttcatcagcaagagattcagaaccatggccgccgccaccctgaaggccttcttcaagtgccagaagcagcccgtgcagttctacaccaaccacaacttcagcatcaccagcagcccctggatcagccccgccaacagccactgcatcaagatgctggtgtaccagtacgacaagaacggcaagcccatcaaggtgagcccctag

SEQ ID NO: 18497 - DNA, 1062 bp, Artificial Sequence; identical to SEQ ID NO: 18496
  Description of Artificial Sequence: Synthetic coding sequence

SEQ ID NO: 18498 - DNA, 918 bp, Artificial Sequence
  Description of Artificial Sequence: Synthetic coding sequence
atgcccggccacaacaccagcagaaacagcagctgcgaccccatcgtgaccccccacctgatcagcctgtacttcatcgtgctgatcggcggcctggtgggcgtgatcagcatcctgttcctgctggtgaagatgaacaccagaagcgtgaccaccatggccgtgatcaacctggtggtggtgcacagcgtgttcctgctgaccgtgcccttcagactgacctacctgatcaagaagacctggatgttcggcctgcccttctgcaagttcgtgagcgccatgctgcacatccacatgtacctgaccttcctgttctacgtggtgatcctggtgaccagatacctgatcttcttcaagtgcaaggacaaggtggagttctacagaaagctgcacgccgtggccgccagcgccggcatgtggaccctggtgatcgtgatcgtggtgcccctggtggtgagcagatacggcatccacgaggagtacaacgaggagcactgcttcaagttccacaaggagctggcctacacctacgtgaagatcatcaactacatgatcgtgatcttcgtgatcgccgtggccgtgatcctgctggtgttccaggtgttcatcatcatgctgatggtgcagaagctgagacacagcctgctgagccaccaggagttctgggcccagctgaagaacctgttcttcatcggcgtgatcctggtgtgcttcctgccctaccagttcttcagaatctactacctgaacgtggtgacccacagcaacgcctgcaacagcaaggtggccttctacaacgagatcttcctgagcgtgaccgccatcagctgctacgacctgctgctgttcgtgttcggcggcagccactggttcaagcagaagatcatcggcctgtggaactgcgtgctgtgcagatag

SEQ ID NO: 18499 - DNA, 918 bp, Artificial Sequence; identical to SEQ ID NO: 18498
  Description of Artificial Sequence: Synthetic coding sequence

SEQ ID NO: 18500 - DNA, 315 bp, Artificial Sequence
  Description of Artificial Sequence: Synthetic coding sequence
atgcccggccacaacaccagcagaaacagcagctgcgaccccatcgtgaccccccacctgatcagcctgtacttcatcgtgctgatcggcggcctggtgggcgtgatcagcatcctgttcctgctggtgaagatgaacaccagaagcgtgaccaccatggccgtgatcaacctggtggtggtgcacagcgtgttcctgctgaccgtgcccttcagactgacctacctgatcaagaagacctggatgttcggcctgcccttctgcaagttcgtgagcgccatgctgcacatccacatgtacctgaccttcctgtag

SEQ ID NO: 18501 - DNA, 1389 bp, Artificial Sequence
  Description of Artificial Sequence: Synthetic coding sequence
atgagcatcatgatgctgcccatggagcagaagatccagtgggtgcccaccagcctgcaggacatcaccgccgtgctgggcaccgaggcctacaccgaggaggacaagagcatggtgagccacgcccagaagagccagcacagctgcctgagccacagcagatggctgagaagcccccaggtgaccggcggcagctgggacctgagaatcagacccagcaaggacagcagcagcttcagacaggcccagtgcctgagaaaggaccccggcgccaacaaccacctggagagccagggcgtgagaggcaccgccggcgacgccgacagagagctgagaggccccagcgagaaggccaccgccggccagcccagagtgaccctgctgcccaccccccacgtgagcggcctgagccaggagttcgagagccactggcccgagatcgccgagagaagcccctgcgtggccggcgtgatccccgtgatctactacagcgtgctgctgggcctgggcctgcccgtgagcctgctgaccgccgtggccctggccagactggccaccagaaccagaagacccagctactactacctgctggccctgaccgccagcgacatcatcatccaggtggtgatcgtgttcgccggcttcctgctgcagggcgccgtgctggccagacaggtgccccaggccgtggtgagaaccgccaacatcctggagttcgccgccaaccacgccagcgtgtggatcgccatcctgctgaccgtggacagatacaccgccctgtgccaccccctgcaccacagagccgccagcagccccggcagaaccagaagagccatcgccgccgtgctgagcgccgccctgctgaccggcatccccttctactggtggctggacatgtggagagacaccgacagccccagaaccctggacgaggtgctgaagtgggcccactgcctgaccgtgtacttcatcccctgcggcgtgttcctggtgaccaacagcgccatcatccacagactgagaagaagaggcagaagcggcctgcagcccagagtgggcaagagcaccgccatcctgctgggcatcaccaccctgttcaccctgctgtgggcccccagagtgttcgtgatgctgtaccacatgtacgtggcccccgtgcacagagactggagagtgcacctggccctggacgtggccaacatggtggccatgctgcacaccgccgccaacttcggcctgtactgcttcgtgagcaagaccttcagagccaccgtgagacaggtgatccacgacgcctacctgccctgcaccctggccagccagcccgagggcatggccgccaagcccgtgatggagccccccggcctgcccaccggcgccgaggtgtag

SEQ ID NO: 18502 - DNA, 2892 bp, Artificial Sequence
  Description of Artificial Sequence: Synthetic coding sequence
atggacgccccctggggcgccggcgagagatggctgcacggcgccgccgtggacagaagcggcgtgagcctgggccccccccccaccccccaggtgaaccagggcaccctgggcccccaggtggcccccgtggccgccggcgaggtggtgaagaccgccggcggcgtgtgcaagttcagcggccagagactgagctggtggcaggcccaggagagctgcgagcagcagttcggccacctggccctgcagccccccgacggcgtgctggccagcagactgagagaccccgtgtgggtgggccagagagaggcccccctgagaagacccccccagagaagagccagaaccaccgccgtgctggtgttcgacgagagaaccgccgacagagccgccagactgagaagccccctgcccgagctggccgccctgaccgcctgcacccacgtgcagtgggactgcgccagccccgaccccgccgccctgttcagcgtggccgcccccgccctgcccaacgccctgcagctgagagccttcgccgagcccggcggcgtggtgagagccgccctggtggtgagaggccagcacgcccccttcctggccgccttcagagccgacggcagatggcaccacgtgtgcgccacctgggagcagagaggcggcagatgggccctgttcagcgacggcagaagaagagccggcgccagaggcctgggcgccggccaccccgtgcccagcggcggcatcctggtgctgggccaggaccaggacagcctgggcggcggcttcagcgtgagacacgccctgagcggcaacctgaccgacttccacctgtgggccagagccctgagccccgcccagctgcacagagccagagcctgcgccccccccagcgagggcctgctgttcagatgggaccccggcgccctggacgtgacccccagcctgctgcccaccgtgtgggtgagactgctgtgccccgtgcccagcgaggagtgccccacctggaaccccggccccagaagcgagggcagcgagctgtgcctggagccccagcccttcctgtgctgctacagaaccgagccctacagaagactgcaggacgcccagagctggcccggccaggacgtgatcagcagagtgaacgccctggccaacgacatcgtgctgctgcccgaccccctgagcgaggtgcacggcgccctgagccccgccgaggccagcagcttcctgggcctgctggagcacgtgctggccatggagatggcccccctgggccccgccgccctgctggccgtggtgagattcctgaagagagtggtggccctgggcgccggcgaccccgagctgctgctgaccggcccctgggagcagctgagccagggcgtggtgagcgtggccagcctggtgctggaggagcaggtggccgacacctggctgagcctgagagaggtgatcggcggccccatggccctggtggccagcgtgcagagactggcccccctgctgagcaccagcatgaccagcgagagacccagaatgagaatccagcacagacacgccggcctgagcggcgtgaccgtgatccacagctggttcaccagcagagtgttccagcacaccctggagggccccgacctggagccccaggcccccgccagcagcgaggaggccaacagagtgcagagattcctgagcacccaggtgggcagcgccatcatcagcagcgaggtgtgggacgtgaccggcgaggtgaacgtggccatgaccttccacctgcagcacagagcccagagccccctgttccccccccacccccccagcccctacaccggcggcgcctgggccaccaccggctgcagcgtggccgccctgtacctggacagcaccgcctgcttctgcaaccacagcaccagcttcgccatcctgctgcagatctacgaggtgcagagaggccccgaggaggagagcctgctgagaaccctgagcttcgtgggctgcggcgtgagcttctgcgccctgaccaccaccttcctgctgttcctggtggccggcgtgcccaagagcgagagaaccaccgtgcacaagaacctgaccttcagcctggccagcgccgagggcttcctgatgaccagcgagtgggccaaggccaacgaggtggcctgcgtggccgtgaccgtggccatgcacttcctgttcctggtggccttcagctggatgctggtggagggcctgctgctgtggagaaaggtggtggccgtgagcatgcaccccggccccggcatgagactgtaccacgccaccggctggggcgtgcccgtgggcatcgtggccgtgaccctggccatgctgccccacgactacgtggcccccggccactgctggctgaacgtgcacaccaacgccatctgggccttcgtgggccccgtgctgttcgtgctgaccgccaacacctgcatcctggccagagtggtgatgatcaccgtgagcagcgccagaagaagagccagaatgctgagcccccagccctgcctgcagcagcagatctggacccagatctgggccaccgtgaagcccgtgctggtgctgctgcccgtgctgggcctgacctggctggccggcatcctggtgcacctgagccccgcctgggcctacgccgccgtgggcctgaacagcatccagggcctgtacatcttcctggtgtacgccgcctgcaacgaggaggtgagaagcgccctgcagagaatggccgagaagaaggtggccgaggtgctgagagccctgggcgtgtggggcggcgccgccaaggagcacagcctgcccttcagcgtgctgcccctgttcctgccccccaagcccagcacccccagacaccccctgaaggcccccgcctag

SEQ ID NO: 18503 - DNA, 1104 bp, Artificial Sequence
  Description of Artificial Sequence: Synthetic coding sequence
ctgaccgacttccacctgtgggccagagccctgagccccgcccagctgcacagagccagagcctgcgccccccccagcgagggcctgctgttcagatgggaccccggcgccctggacgtgacccccagcctgctgcccaccgtgtgggtgagactgctgtgccccgagccctacagaagactgcaggacgcccagagctggcccggccaggacgtgatcagcagagtgaacgccctggccaacgacatcgtgctgctgcccgaccccctgagcgaggtgcacggcgccctgagccccgccgaggccagcagcttcctgggcctgctggagcacgtgctggccatggagatggcccccctgggccccgccgccctgctggccgtggtgagattcctgaagagagtggtggccctgggcgccggcgaccccgagctgctgctgaccggcccctgggagcagctgagccagggcgtggtgagcgtggccagcctggtgctggaggagcaggtgatcggcggccccatggccctggtggccagcgtgcagagactggcccccctgctgagcaccagcatgaccagcgagagacccagaatgagaatccagcacagacacgccggcctggaggtgagaagcctgagactgagagaggccagcaccagaggctgcctgttcaccatgcccggcggcagacccgagggccccggccacatccacatccccgccagcgaggtgagaagactgctgagaaagggcctgagcggcgtgaccgtgatccacagctggttcaccagcagagtgttccagcacaccctggagggccccgacctggagccccaggcccccgccagcagcgaggaggccaacagagtgcagagattcctgagcacccaggtgggcagcgccatcatcagcagcgaggtgtgggacgtgaccggcgaggtgaacgtggccatgaccttccacctgcagcacagagcccagcccatctacagaggctgcctgggccaccacagactgctgagaggctgccccgtgcccggcctgcacagactgctgctgcagccccagcaccagctgtgccaccccgccgccaacctgtag

SEQ ID NO: 18504 - DNA, 393 bp, Artificial Sequence
  Description of Artificial Sequence: Synthetic coding sequence
agcggcggcatcctgctggacgccggcggcggcgccgccgccgtggaggagggcggcagctgcgagcacgcccccggccccagacacgccgccctgcccagacacagactgggcgccaccgtgaagcccgtgctggtgctgctgcccgtgctgggcctgacctggctggccggcatcctggtgcacctgagccccgcctgggcctacgccgccgtgggcctgaacagcatccagggcctgtacatcttcctggtgtacgccgcctgcaacgaggaggtgagaagcgccctgcagagaatggccgagaagaaggtggccgagggccccatggccctggagctgccccagcacagcccccccctgcagaccagaagagacagactgtggaactag

SEQ ID NO: 18505 - DNA, 105 bp, Artificial Sequence
  Description of Artificial Sequence: Synthetic coding sequence
atgcaccccccccccagcctgctgagcttcctggcccccgtggccgccggcgaggtggtgaagaccgccggcggcgtgtgcaagttcagcggccagagactgtag

SEQ ID NO: 18506 - DNA, 1002 bp, Artificial Sequence
  Description of Artificial Sequence: Synthetic coding sequence
atgtggagctgcagctggttcaacggcaccggcctggtggaggagctgcccgcctgccaggacctgcagctgggcctgagcctgctgagcctgctgggcctggtggtgggcgtgcccgtgggcctgtgctacaacgccctgctggtgctggccaacctgcacagcaaggccagcatgaccatgcccgacgtgtacttcgtgaacatggccgtggccggcctggtgctgagcgccctggcccccgtgcacctgctgggcccccccagcagcagatgggccctgtggagcgtgggcggcgaggtgcacgtggccctgcagatccccttcaacgtgagcagcctggtggccatgtacagcaccgccctgctgagcctggaccactacatcgagagagccctgcccagaacctacatggccagcgtgtacaacaccagacacgtgtgcggcttcgtgtggggcggcgccctgctgaccagcttcagcagcctgctgttctacatctgcagccacgtgagcaccagagccctggagtgcgccaagatgcagaacgccgaggccgccgacgccaccctggtgttcatcggctacgtggtgcccgccctggccaccctgtacgccctggtgctgctgagcagagtgagaagagaggacacccccctggacagagacaccggcagactggagcccagcgcccacagactgctggtggccaccgtgtgcacccagttcggcctgtggaccccccactacctgatcctgctgggccacaccgtgatcatcagcagaggcaagcccgtggacgcccactacctgggcctgctgcacttcgtgaaggacttcagcaagctgctggccttcagcagcagcttcgtgacccccctgctgtacagatacatgaaccagagcttccccagcaagctgcagagactgatgaagaagctgccctgcggcgacagacactgcagccccgaccacatgggcgtgcagcaggtgctggcctag

SEQ ID NO: 18507 - DNA, 1002 bp, Artificial Sequence; identical to SEQ ID NO: 18506
  Description of Artificial Sequence: Synthetic coding sequence

SEQ ID NO: 18508 - DNA, 948 bp, Artificial Sequence
  Description of Artificial Sequence: Synthetic coding sequence
atgtggagctgcagctggttcaacggcaccggcctggtggaggagctgcccgcctgccaggacctgcagctgggcctgagcctgctgagcctgctgggcctggtggtgggcgtgcccgtgggcctgtgctacaacgccctgctggtgctggccaacctgcacagcaaggccagcatgaccatgcccgacgtgtacttcgtgaacatggccgtggccggcctggtgctgagcgccctggcccccgtgcacctgctgggcccccccagcagcagatgggccctgtggagcgtgggcggcgaggtgcacgtggccctgcagatccccttcaacgtgagcagcctggtggccatgtacagcaccgccctgctgagcctggaccactacatcgagagagccctgcccagaacctacatggccagcgtgtacaacaccagacacgtgtgcggcttcgtgtggggcggcgccctgctgaccagcttcagcagcctgctgttctacatctgcagccacgtgagcaccagagccctggagtgcgccaagatgcagaacgccgaggccgccgacgccaccctggtgttcatcggctacgtggtgcccgccctggccaccctgtacgccctggtgctgctgagcagagtgagaagagaggacacccccctggacagagacaccggcagactggagcccagcgcccacagactgctggtggccaccgtgtgcacccagttcggcctgtggaccccccactacctgatcctgctgggccacaccgtgatcatcagcagaggcaagcccgtggacgcccactacctgggcctgctgcacttcgtgaaggacttcagcaagctgctggccttcagcagcagcttcgtgacccccctgctgtacagatacatgaaccagagcttccccagcaagctgcagagactgatgaagaagctgccctag

SEQ ID NO: 18509 - DNA, 756 bp, Artificial Sequence
  Description of Artificial Sequence: Synthetic coding sequence
atgctgctgggcccccccagcagcagatgggccctgtggagcgtgggcggcgaggtgcacgtggccctgcagatccccttcaacgtgagcagcctggtggccatgtacagcaccgccctgctgagcctggaccactacatcgagagagccctgcccagaacctacatggccagcgtgtacaacaccagacacgtgtgcggcttcgtgtggggcggcgccctgctgaccagcttcagcagcctgctgttctacatctgcagccacgtgagcaccagagccctggagtgcgccaagatgcagaacgccgaggccgccgacgccaccctggtgttcatcggctacgtggtgcccgccctggccaccctgtacgccctggtgctgctgagcagagtgagaagagaggacacccccctggacagagacaccggcagactggagcccagcgcccacagactgctggtggccaccgtgtgcacccagttcggcctgtggaccccccactacctgatcctgctgggccacaccgtgatcatcagcagaggcaagcccgtggacgcccactacctgggcctgctgcacttcgtgaaggacttcagcaagctgctggccttcagcagcagcttcgtgacccccctgctgtacagatacatgaaccagagcttccccagcaagctgcagagactgatgaagaagctgccctgcggcgacagacactgcagccccgaccacatgggcgtgcagcaggtgctggcctag

SEQ ID NO: 18510 - DNA, 1044 bp, Artificial Sequence
  Description of Artificial Sequence: Synthetic coding sequence
atgggcgacgagctggccccctgccccgtgggcaccaccgcctggcccgccctgatccagctgatcagcaagaccccctgcatgccccaggccgccagcaacaccagcctgggcctgggcgacctgagagtgcccagcagcatgctgtactggctgttcctgcccagcagcctgctggccgccgccaccctggccgtgagccccctgctgctggtgaccatcctgagaaaccagagactgagacaggagccccactacctgctgcccgccaacatcctgctgagcgacctggcctacatcctgctgcacatgctgatcagcagcagcagcctgggcggctgggagctgggcagaatggcctgcggcatcctgaccgacgccgtgttcgccgcctgcaccagcaccatcctgagcttcaccgccatcgtgctgcacacctacctggccgtgatccaccccctgagatacctgagcttcatgagccacggcgccgcctggaaggccgtggccctgatctggctggtggcctgctgcttccccaccttcctgatctggctgagcaagtggcaggacgcccagctggaggagcagggcgccagctacatcctgccccccagcatgggcacccagcccggctgcggcctgctggtgatcgtgacctacaccagcatcctgtgcgtgctgttcctgtgcaccgccctgatcgccaactgcttctggagaatctacgccgaggccaagaccagcggcatctggggccagggctacagcagagccagaggcaccctgctgatccacagcgtgctgatcaccctgtacgtgagcaccggcgtggtgttcagcctggacatggtgctgaccagataccaccacatcgacagcggcacccacacctggctgctggccgccaacagcgaggtgctgatgatgctgcccagagccatgctgacctacctgtacctgctgagatacagacagctgctgggcatggtgagaggccacctgcccagcagaagacaccaggccatcttcaccatcagctag

SEQ ID NO: 18511 - DNA, 2196 bp, Artificial Sequence
  Description of Artificial Sequence: Synthetic coding sequence
atgagcctgttcctgagcaacctgagcaccaacgacagcagcctgtggaaggagaaccacaacagcaccgacctgctgaacccccccggcaccctgaacatctacctgttctgcctgacctgcctgatgaccttcgccgccctggtgggcagcatctacagcctgatcagcctgctgaagatgcagaacagaaccgtggtgagcatgctggtggccagctggagcgtggacgacctgatgagcgtgctgagcgtgaccatcttcatgttcctgcagtggcccaacgaggtgcccggctacttccagttcctgtgcaccaccagcgccctgatgtacctgtgccagggcctgagcagcaacctgaaggccaccctgctggtgagctacaacttctacaccatgcacagaggcgtgggcagccagaccgccagcagaagaagcggccaggtgctgggcgtggtgctgaccgtgtgggccgccagcctgctgctgagcgccctgcccctgtgcggctggggcgccttcgtgagaaccccctggggctgcctggtggactgcagcagcagctacgtgctgttcctgagcatcgtgtacgccctggccttcggcctgctggtgggcctgagcgtgcccctgacccacagactgctgtgcagcgaggagccccccagactgcacagcaactaccaggagatcagcagaggcgccagcatccccggcaccccccccaccgccggcagagtggtgagcctgagccccgaggacgcccccggccccagcctgagaagaagcggcggctgcagccccagcagcgacaccgtgttcggccccggcgcccccgccgccgccggcgccgaggcctgcagaagagagaacagaggcaccctgtacggcaccagaagcttcaccgtgagcgtggcccagaagagattcgccctgatcctggccctgaccaaggtggtgctgtggctgcccatgatgatgcacatggtggtgcagaacgtggtgggcttccagagcctgcccctggagaccttcagcttcctgctgaccctgctggccaccaccgtgacccccgtgttcgtgctgagcaagagatggacccacctgccctgcggctgcatcatcaactgcagacagaacgcctacgccgtggccagcgacggcaagaagatcaagagaaagggcttcgagttcaacctgagcttccagaagagctacggcatctacaagatcgcccacgaggactactacgacgacgacgagaacagcatcttctaccacaacctgatgaacagcgagtgcgagaccaccaaggacccccagagagacaacagaaacatcttcaacgccatcaaggtggagatcagcaccacccccagcctggacagcagcacccagagaggcatcaacaagtgcaccaacaccgacatcaccgaggccaagcaggacagcaacaacaagaaggacgccttcagcgacaagaccggcggcgacatcaactacgaggagaccaccttcagcgagggccccgagagaagactgagccacgaggagagccagaagcccgacctgagcgactgggagtggtgcagaagcaagagcgagagaacccccagacagagaagcggctacgccctggccatccccctgtgcgccttccagggcaccgtgagcctgcacgcccccaccggcaagaccctgagcctgagcacctacgaggtgagcgccgagggccagaagatcacccccgccagcaagaagatcgaggtgtacagaagcaagagcgtgggccacgagcccaacagcgaggacagcagcagcaccttcgtggacaccagcgtgaagatccacctggaggtgctggagatctgcgacaacgaggaggccctggacaccgtgagcatcatcagcaacatcagccagagcagcacccaggtgagaagccccagcctgagatacagcagaaaggagaacagattcgtgagctgcgacctgggcgagaccgccagctacagcctgttcctgcccaccagcaaccccgacggcgacatcaacatcagcatccccgacaccgtggaggcccacagacagaacagcaagagacagcaccaggagagagacggctaccaggaggagatccagctgctgaacaaggcctacagaaagagagaggaggagagcaagggcagctag

SEQ ID NO: 18512 - DNA, 1305 bp, Artificial Sequence
  Description of Artificial Sequence: Synthetic coding sequence
atggaggacctgttcagccccagcatcctgccccccgcccccaacatcagcgtgcccatcctgctgggctggggcctgaacctgaccctgggccagggcgcccccgccagcggcccccccagcagaagagtgagactggtgttcctgggcgtgatcctggtggtggccgtggccggcaacaccaccgtgctgtgcagactgtgcggcggcggcggcccctgggccggccccaagagaagaaagatggacttcctgctggtgcagctggccctggccgacctgtacgcctgcggcggcaccgccctgagccagctggcctgggagctgctgggcgagcccagagccgccaccggcgacctggcctgcagattcctgcagctgctgcaggccagcggcagaggcgccagcgcccacctggtggtgctgatcgccctggagagaagaagagccgtgagactgccccacggcagacccctgcccgccagagccctggccgccctgggctggctgctggccctgctgctggccctgccccccgccttcgtggtgagaggcgacagccccagccccctgccccccccccccccccccaccagcctgcagcccggcgccccccccgccgccagagcctggcccggcgagagaagatgccacggcatcttcgcccccctgcccagatggcacctgcaggtgtacgccttctacgaggccgtggccggcttcgtggcccccgtgaccgtgctgggcgtggcctgcggccacctgctgagcgtgtggtggagacacagaccccaggcccccgccgccgccgccccctggagcgccagccccggcagagcccccgcccccagcgccctgcccagagccaaggtgcagagcctgaagatgagcctgctgctggccctgctgttcgtgggctgcgagctgccctacttcgccgccagactggccgccgcctggagcagcggccccgccggcgactgggagggcgagggcctgagcgccgccctgagagtggtggccatggccaacagcgccctgaaccccttcgtgtacctgttcttccaggccggcgactgcagactgagaagacagctgagaaagagactgggcagcctgtgctgcgccccccagggcggcgccgaggacgaggagggccccagaggccaccaggccctgtacagacagagatggccccacccccactaccaccacgccagaagagagcccctggacgagggcggcctgagaccccccccccccagacccagacccctgccctgcagctgcgagagcgccttctag

SEQ ID NO: 18513 - DNA, 1260 bp, Artificial Sequence
  Description of Artificial Sequence: Synthetic coding sequence
atgctggccgccgccttcgccgacagcaacagcagcagcatgaacgtgagcttcgcccacctgcacttcgccggcggctacctgcccagcgacagccaggactggagaaccatcatccccgccctgctggtggccgtgtgcctggtgggcttcgtgggcaacctgtgcgtgatcggcatcctgctgcacaacgcctggaagggcaagcccagcatgatccacagcctgatcctgaacctgagcctggccgacctgagcctgctgctgttcagcgcccccatcagagccaccgcctacagcaagagcgtgtgggacctgggctggttcgtgtgcaagagcagcgactggttcatccacacctgcatggccgccaagagcctgaccatcgtggtggtggccaaggtgtgcttcatgtacgccagcgaccccgccaagcaggtgagcatccacaactacaccatctggagcgtgctggtggccatctggaccgtggccagcctgctgcccctgcccgagtggttcttcagcaccatcagacaccacgagggcgtggagatgtgcctggtggacgtgcccgccgtggccgaggagttcatgagcatgttcggcaagctgtaccccctgctggccttcggcctgcccctgttcttcgccagcttctacttctggagagcctacgaccagtgcaagaagagaggcaccaagacccagaacctgagaaaccagatcagaagcaagcaggtgaccgtgatgctgctgagcatcgccatcatcagcgccctgctgtggctgcccgagtgggtggcctggctgtgggtgtggcacctgaaggccgccggccccgcccccccccagggcttcatcgccctgagccaggtgctgatgttcagcatcagcagcgccaaccccctgatcttcctggtgatgagcgaggagttcagagagggcctgaagggcgtgtggaagtggatgatcaccaagaagccccccaccgtgagcgagagccaggagacccccgccggcaacagcgagggcctgcccgacaaggtgcccagccccgagagccccgccagcatccccgagaaggagaagcccagcagccccagcagcggcaagggcaagaccgagaaggccgagatccccatcctgcccgacgtggagcagttctggcacgagagagacaccgtgcccagcgtgcaggacaacgaccccatcccctgggagcacgaggaccaggagaccggcgagggcgtgaagtag

SEQ ID NO: 18514 - DNA, 1413 bp, Artificial Sequence
  Description of Artificial Sequence: Synthetic coding sequence
atggacaccaccatggaggccgacctgggcgccaccggccacagacccagaaccgagctggacgacgaggacagctacccccagggcggctgggacaccgtgttcctggtggccctgctgctgctgggcctgcccgccaacggcctgatggcctggctggccggcagccaggccagacacggcgccggcaccagactggccctgctgctgctgagcctggccctgagcgacttcctgttcctggccgccgccgccttccagatcctggagatcagacacggcggccactggcccctgggcaccgccgcctgcagattctactacttcctgtggggcgtgagctacagcagcggcctgttcctgctggccgccctgagcctggacagatgcctgctggccctgtgcccccactggtaccccggccacagacccgtgagactgcccctgtgggtgtgcgccggcgtgtgggtgctggccaccctgttcagcgtgccctggctggtgttccccgaggccgccgtgtggtggtacgacctggtgatctgcctggacttctgggacagcgaggagctgagcctgagaatgctggaggtgctgggcggcttcctgcccttcctgctgctgctggtgtgccacgtgctgacccaggccaccgcctgcagaacctgccacagacagcagcagcccgccgcctgcagaggcttcgccagagtggccagaaccatcctgagcgcctacgtggtgctgagactgccctaccagctggcccagctgctgtacctggccttcctgtgggacgtgtacagcggctacctgctgtgggaggccctggtgtacagcgactacctgatcctgctgaacagctgcctgagccccttcctgtgcctgatggccagcgccgacctgagaaccctgctgagaagcgtgctgagcagcttcgccgccgccctgtgcgaggagagacccggcagcttcacccccaccgagccccagacccagctggacagcgagggccccaccctgcccgagcccatggccgaggcccagagccagatggaccccgtggcccagccccaggtgaaccccaccctgcagcccagaagcgaccccaccgcccagccccagctgaaccccaccgcccagccccagagcgaccccaccgcccagccccagctgaacctgatggcccagccccagagcgacagcgtggcccagccccaggccgacaccaacgtgcagacccccgcccccgccgccagcagcgtgcccagcccctgcgacgaggccagccccacccccagcagccaccccacccccggcgccctggaggaccccgccaccccccccgccagcgagggcgagagccccagcagcaccccccccgaggccgcccccggcgccggccccacctag

SEQ ID NO: 18515 - DNA, 2613 bp, Artificial Sequence
  Description of Artificial Sequence: Synthetic coding sequence
atgaacagcaacctgcccgccgagaacctgaccatcgccgtgaacatgaccaagaccctgcccaccgccgtgacccacggcttcaacagcaccaacgacccccccagcatgagcatcaccagactgttccccgccctgctggagtgcttcggcatcgtgctgtgcggctacatcgccggcagagccaacgtgatcaccagcacccaggccaagggcctgggcaacttcgtgagcagattcgccctgcccgccctgctgttcaagaacatggtggtgctgaacttcagcaacgtggactggagcttcctgtacagcatcctgatcgccaaggccagcgtgttcttcatcgtgtgcgtgctgaccctgctggtggccagccccgacagcagattcagcaaggccggcctgttccccatcttcgccacccagagcaacgacttcgccctgggctaccccatcgtggaggccctgtaccagaccacctaccccgagtacctgcagtacatctacctggtggcccccatcagcctgatgatgctgaaccccatcggcttcatcttctgcgagatccagaagtggaaggacacccagaacgccagccagaacaagatcaagatcgtgggcctgggcctgctgagagtgctgcagaaccccatcgtgttcatggtgttcatcggcatcgccttcaacttcatcctggacagaaaggtgcccgtgtacgtggagaacttcctggacggcctgggcaacagcttcagcggcagcgccctgttctacctgggcctgaccatggtgggcaagatcaagagactgaagaagagcgccttcgtggtgctgatcctgctgatcaccgccaagctgctggtgctgcccctgctgtgcagagagatggtggagctgctggacaagggcgacagcgtggtgaaccacaccagcctgagcaactacgccttcctgtacggcgtgttccccgtggcccccggcgtggccatcttcgccacccagttcaacatggaggtggagatcatcaccagcggcatggtgatcagcaccttcgtgagcgcccccatcatgtacgtgagcgcctggctgctgaccttccccaccatggaccccaagcccctggcctacgccatccagaacgtgagcttcgacatcagcatcgtgagcctgatcagcctgatctggagcctggccatcctgctgctgagcaagaagtacaagcagctgccccacatgctgaccaccaacctgctgatcgcccagagcatcgtgtgcgccggcatgatgatctggaacttcgtgaaggagaagaacttcgtgggccagatcctggtgttcgtgctgctgtacagcagcctgtacagcacctacctgtggaccggcctgctggccatcagcctgttcctgctgaagaagagagagagagtgcagatccccgtgggcatcatcatcatcagcggctggggcatccccgccctgctggtgggcgtgctgctgatcaccggcaagcacaacggcgacagcatcgacagcgccttcttctacggcaaggagcagatgatcaccaccgccgtgaccctgttctgcagcatcctgatcgccggcatcagcctgatgtgcatgaaccagaccgcccaggccggcagctacgagggcttcgaccagagccagagccacaaggtggtggagcccggcaacaccgccttcgaggagagccccgcccccgtgaacgagcccgagctgttcaccagcagcatccccgagaccagctgctgcagctgcagcatgggcaacggcgagctgcactgccccagcatcgagcccatcgccaacaccagcaccagcgagcccgtgatccccagcttcgagaagaacaaccactgcgtgagcagatgcaacagccagagctgcatcctggcccaggaggaggagcagtacctgcagagcggcgaccagcagctgaccagacacgtgctgctgtgcctgctgctgatcatcggcctgttcgccaacctgagcagctgcctgtggtggctgttcaaccaggagcccggcagactgtacgtggagctgcagttcttctgcgccgtgttcaacttcggccagggcttcatcagcttcggcatcttcggcctggacaagcacctgatcatcctgcccttcaagagaagactggagttcctgtggaacaacaaggacaccgccgagaacagagacagccccgtgagcgaggagatcaagatgacctgccagcagttcatccactaccacagagacctgtgcatcagaaacatcgtgaaggagagaagatgcggcgccaagaccagcgccggcaccttctgcggctgcgacctggtgagctggctgatcgaggtgggcctggccagcgacagaggcgaggccgtgatctacggcgacagactggtgcagggcggcgtgatccagcacatcaccaacgagtacgagttcagagacgagtacctgttctacagattcctgcagaagagccccgagcagagcccccccgccatcaacgccaacaccctgcagcaggagagatacaaggagatcgagcacagcagcccccccagccacagccccaagacctag

SEQ ID NO: 18516 - DNA, 2613 bp, Artificial Sequence; identical to SEQ ID NO: 18515
  Description of Artificial Sequence: Synthetic coding sequence

SEQ ID NO: 18517 - DNA, 2613 bp, Artificial Sequence; identical to SEQ ID NO: 18515
  Description of Artificial Sequence: Synthetic coding sequence

SEQ ID NO: 18518 - DNA, 795 bp, Artificial Sequence
  Description of Artificial Sequence: Synthetic coding sequence
atgatcaccaccgccgtgaccctgttctgcagcatcctgatcgccggcatcagcctgatgtgcatgaaccagaccgcccaggccggcagctacgagggcttcgaccagagccagagccacaaggtggtggagcccggcaacaccgccttcgaggagagccccgcccccgtgaacgagcccgagctgttcaccagcagcatccccgagaccagctgctgcagctgcagcatgggcaacggcgagctgcactgccccagcatcgagcccatcgccaacaccagcaccagcgagcccgtgatccccagcttcgagaagaacaaccactgcgtgagcagatgcaacagccagagctgcatcctggcccaggaggaggagcagtacctgcagagcggcgaccagcagctgaccagacacgtgctgctgtgcctgctgctgatcatcggcctgttcgccaacctgagcagctgcctgtggtggctgttcaaccaggagcccggcagactgtacgtggagctgcagttcttctgcgccgtgttcaacttcggccagggcttcatcagcttcggcatcttcggcctggacaagcacctgatcatcctgcccttcaagagaagactggagttcctgtggaacaacaaggacaccgccgagaacagagacagccccgtgagcgaggagatcaagatgacctgccagcagttcatccactaccacagagacctgtgcatcagaaacatcgtgaaggagagaagatgcggcgccaagaccagcgccggcaccttctgcggctgctag

SEQ ID NO: 18519 - DNA, 417 bp, Artificial Sequence
  Description of Artificial Sequence: Synthetic coding sequence
ttcagagccagaggccccgacggcagaggcagcggcagaaccagagccggcagagcccccggcagagagcccagagcccccagatgccccgacggcggcggcgtggccgccagagccgccagactgctgagcagcagaagaagcggcagctggccccccacccacgccctgtggcccgacctgagaagcagagccagaagactgctgctgttcctgagcctggccgacctgctgagcgccagatgcccccccagccccacccccgcccccagcagcggcccctggcccctgagaagcacctgcaccagcgccagcagcgcccccagagccggcctggcccagatcgcctgcttcggccccagcatgagcagcgccggcggcagcagatggagcagcctgtggcagcccagcccctag

SEQ ID NO: 18520 - DNA, 1008 bp, Artificial Sequence
  Description of Artificial Sequence: Synthetic coding sequence
atgcagcccagccccccccccaccgagctggtgcccagcgagagagccgtggtgctgctgagctgcgccctgagcgccctgggcagcggcctgctggtggccacccacgccctgtggcccgacctgagaagcagagccagaagactgctgctgttcctgagcctggccgacctgctgagcgccgccagctacttctacggcgtgctgcagaacttcgccggccccagctgggactgcgtgctgcagggcgccctgagcaccttcgccaacaccagcagcttcttctggaccgtggccatcgccctgtacctgtacctgagcatcgtgagagccgccagaggccccagaaccgacagactgctgtgggccttccacgtggtgagctggggcgtgcccctggtgatcaccgtggccgccgtggccctgaagaagatcggctacgacgccagcgacgtgagcgtgggctggtgctggatcgacctggaggccaaggaccacgtgctgtggatgctgctgaccggcaagctgtgggagatgctggcctacgtgctgctgcccctgctgtacctgctggtgagaaagcacatcaacagagcccacaccgccctgagcgagtacagacccatcctgagccaggagcacagactgctgagacacagcagcatggccgacaagaagctggtgctgatccccctgatcttcatcggcctgagagtgtggagcaccgtgagattcgtgctgaccctgtgcggcagccccgccgtgcagacccccgtgctggtggtgctgcacggcatcggcaacaccttccagggcggcgccaactgcatcatgttcgtgctgtgcaccagagccgtgagaaccagactgttcagcctgtgctgctgctgctgcagcagccagccccccaccaagagccccgccggcacccccaaggcccccgcccccagcaagcccggcgagagccaggagagccagggcacccccggcgagctgcccagcacctag

SEQ ID NO: 18521 - DNA, 813 bp, Artificial Sequence
  Description of Artificial Sequence: Synthetic coding sequence
atgcagcccagccccccccccaccgagctggtgcccagcgagagagccgtggtgctgctgagctgcgccctgagcgccctgggcagcggcctgctggtggccacccacgccctgtggcccgacctgagaagcagagccagaagactgctgctgttcctgagcctggccgacctgctgagcgccgccagctacttctacggcgtgctgcagaacttcgccggccccagctgggactgcgtgctgcagggcgccctgagcaccttcgccaacaccagcagcttcttctggaccgtggccatcgccctgtacctgtacctgagcatcgtgagagccgccagaggccccagaaccgacagactgctgtgggccttccacgtggtgagctggggcgtgcccctggtgatcaccgtggccgccgtggccctgaagaagatcggctacgacgccagcgacgtgagcgtgggctggtgctggatcgacctggaggccaaggaccacgtgctgtggatgctgctgaccggcaagctgtgggagatgctggcctacgtgctgctgcccctgctgtacctgctggtgagaaagcacatcaacagagccggcatcggcaacaccttccagggcggcgccaactgcatcatgttcgtgctgtgcaccagagccgtgagaaccagactgttcagcctgtgctgctgctgctgcagcagccagccccccaccaagagccccgccggcacccccaaggcccccgcccccagcaagcccggcgagagccaggagagccagggcacccccggcgagctgcccagcacctag

SEQ ID NO: 18522 - DNA, 3648 bp, Artificial Sequence
  Description of Artificial Sequence: Synthetic coding sequence
atgggcgccatggcctaccccctgctgctgtgcctgctgctggcccagctgggcctgggcgccgtgggcgccagcagagacccccagggcagacccgacagccccagagagagaacccccaagggcaagccccacgcccagcagcccggcagagccagcgccagcgacagcagcgccccctggagcagaagcaccgacggcaccatcctggcccagaagctggccgaggaggtgcccatggacgtggccagctacctgtacaccggcgacagccaccagctgaagagagccaactgcagcggcagatacgagctggccggcctgcccggcaagtggcccgccctggccagcgcccaccccagcctgcacagagccctggacaccctgacccacgccaccaacttcctgaacgtgatgctgcagagcaacaagagcagagagcagaacctgcaggacgacctggactggtaccaggccctggtgtggagcctgctggagggcgagcccagcatcagcagagccgccatcaccttcagcaccgacagcctgagcgcccccgccccccaggtgttcctgcaggccaccagagaggagagcagaatcctgctgcaggacctgagcagcagcgccccccacctggccaacgccaccctggagaccgagtggttccacggcctgagaagaaagtggagaccccacctgcacagaagaggccccaaccagggccccagaggcctgggccacagctggagaagaaaggacggcctgggcggcgacaagagccacttcaagtggagccccccctacctggagtgcgagaacggcagctacaagcccggctggctggtgaccctgagcagcgccatctacggcctgcagcccaacctggtgcccgagttcagaggcgtgatgaaggtggacatcaacctgcagaaggtggacatcgaccagtgcagcagcgacggctggttcagcggcacccacaagtgccacctgaacaacagcgagtgcatgcccatcaagggcctgggcttcgtgctgggcgcctacgagtgcatctgcaaggccggcttctaccaccccggcgtgctgcccgtgaacaacttcagaagaagaggccccgaccagcacatcagcggcagcaccaaggacgtgagcgaggaggcctacgtgtgcctgccctgcagagagggctgccccttctgcgccgacgacagcccctgcttcgtgcaggaggacaagtacctgagactggccatcatcagcttccaggccctgtgcatgctgctggacttcgtgagcatgctggtggtgtaccacttcagaaaggccaagagcatcagagccagcggcctgatcctgctggagaccatcctgttcggcagcctgctgctgtacttccccgtggtgatcctgtacttcgagcccagcaccttcagatgcatcctgctgagatgggccagactgctgggcttcgccaccgtgtacggcaccgtgaccctgaagctgcacagagtgctgaaggtgttcctgagcagaaccgcccagagaatcccctacatgaccggcggcagagtgatgagaatgctggccgtgatcctgctggtggtgttctggttcctgatcggctggaccagcagcgtgtgccagaacctggagaagcagatcagcctgatcggccagggcaagaccagcgaccacctgatcttcaacatgtgcctgatcgacagatgggactacatgaccgccgtggccgagttcctgttcctgctgtggggcgtgtacctgtgctacgccgtgagaaccgtgcccagcgccttccacgagcccagatacatggccgtggccgtgcacaacgagctgatcatcagcgccatcttccacaccatcagattcgtgctggccagcagactgcagagcgactggatgctgatgctgtacttcgcccacacccacctgaccgtgaccgtgaccatcggcctgctgctgatccccaagttcagccacagcagcaacaaccccagagacgacatcgccaccgaggcctacgaggacgagctggacatgggcagaagcggcagctacctgaacagcagcatcaacagcgcctggagcgagcacagcctggaccccgaggacatcagagacgagctgaagaagctgtacgcccagctggagatctacaagagaaagaagatgatcaccaacaacccccacctgcagaagaagagatgcagcaagaagggcctgggcagaagcatcatgagaagaatcaccgagatccccgagaccgtgagcagacagtgcagcaaggaggacaaggagggcgccgaccacggcaccgccaagggcaccgccctgatcagaaagaacccccccgagagcagcggcaacaccggcaagagcaaggaggagaccctgaagaacagagtgttcagcctgaagaagagccacagcacctacgaccacgtgagagaccagaccgaggagagcagcagcctgcccaccgagagccaggaggaggagaccaccgagaacagcaccctggagagcctgagcggcaagaagctgacccagaagctgaaggaggacagcgaggccgagagcaccgagagcgtgcccctggtgtgcaagagcgccagcgcccacaacctgagcagcgagaagaagaccggccaccccagaaccagcatgctgcagaagagcctgagcgtgatcgccagcgccaaggagaagaccctgggcctggccggcaagacccagaccgccggcgtggaggagagaaccaagagccagaagcccctgcccaaggacaaggagaccaacagaaaccacagcaacagcgacaacaccgagaccaaggaccccgccccccagaacagcaaccccgccgaggagcccagaaagccccagaagagcggcatcatgaagcagcagagagtgaaccccaccaccgccaacagcgacctgaaccccggcaccacccagatgaaggacaacttcgacatcggcgaggtgtgcccctgggaggtgtacgacctgacccccggccccgtgcccagcgagagcaaggtgcagaagcacgtgagcatcgtggccagcgagatggagaagaaccccaccttcagcctgaaggagaagagccaccacaagcccaaggccgccgaggtgtgccagcagagcaaccagaagagaatcgacaaggccgaggtgtgcctgtgggagagccagggccagagcatcctggaggacgagaagctgctgatcagcaagacccccgtgctgcccgagagagccaaggaggagaacggcggccagcccagagccgccaacgtgtgcgccggccagagcgaggagctgccccccaaggccgtggccagcaagaccgagaacgagaacctgaaccagatcggccaccaggagaagaagaccagcagcagcgaggagaacgtgagaggcagctacaacagcagcaacaacttccagcagcccctgaccagcagagccgaggtgtgcccctgggagttcgagacccccgcccagcccaacgccggcagaagcgtggccctgcccgccagcagcgccctgagcgccaacaagatcgccggccccagaaaggaggagatctgggacagcttcaaggtgtag

SEQ ID NO: 18523 - DNA, 1017 bp, Artificial Sequence
  Description of Artificial Sequence: Synthetic coding sequence
atgaccgccctgagcagcgagaactgcagcttccagtaccagctgagacagaccaaccagcccctggacgtgaactacctgctgttcctgatcatcctgggcaagatcctgctgaacatcctgaccctgggcatgagaagaaagaacacctgccagaacttcatggagtacttctgcatcagcctggccttcgtggacctgctgctgctggtgaacatcagcatcatcctgtacttcagagacttcgtgctgctgagcatcagattcaccaagtaccacatctgcctgttcacccagatcatcagcttcacctacggcttcctgcactaccccgtgttcctgaccgcctgcatcgactactgcctgaacttcagcaagaccaccaagctgagcttcaagtgccagaagctgttctacttcttcaccgtgatcctgatctggatcagcgtgctggcctacgtgctgggcgaccccgccatctaccagagcctgaaggcccagaacgcctacagcagacactgccccttctacgtgagcatccagagctactggctgagcttcttcatggtgatgatcctgttcgtggccttcatcacctgctgggaggaggtgaccaccctggtgcaggccatcagaatcaccagctacatgaacgagaccatcctgtacttccccttcagcagccacagcagctacaccgtgagaagcaagaagatcttcctgagcaagctgatcgtgtgcttcctgagcacctggctgcccttcgtgctgctgcaggtgatcatcgtgctgctgaaggtgcagatccccgcctacatcgagatgaacatcccctggctgtacttcgtgaacagcttcctgatcgccaccgtgtactggttcaactgccacaagctgaacctgaaggacatcggcctgcccctggaccccttcgtgaactggaagtgctgcttcatccccctgaccatccccaacctggagcagatcgagaagcccatcagcatcatgatctgctag

SEQ ID NO: 18524 - DNA, 432 bp, Artificial Sequence
  Description of Artificial Sequence: Synthetic coding sequence
atgaccgccctgagcagcgagaactgcagcttccagtaccagctgagacagaccaaccagcccctggacgtgaactacctgctgttcctgatcatcctgggcaagatcctgctgaacatcctgaccctgggcatgagaagaaagaacacctgccagaacttcatggagtacttctgcatcagcctggccttcgtggacctgctgctgctggtgaacatcagcatcatcctgtacttcagagacttcgtgctgctgagcatcagattcaccaagtaccacatctgcctgttcacccagatcatcagcttcacctacggcttcctgcactaccccgtgttcctgaccgcctgcatcgactactgcctgaacttcagcaagaccaccaagctgagcttcaagtgccagaagctgttctacttcttcaccgtgtag

SEQ ID NO: 18525 - DNA, 267 bp, Artificial Sequence
  Description of Artificial Sequence: Synthetic coding sequence
atgaccgccctgagcagcgagaactgcagcttccagtaccagctgagacagaccaaccagcccctggacgtgaactacctgctgttcctgatcatcctgggcaagatcctgctgaacatcctgaccctgggcatgagaagaaagaacacctgccagaacttcatggagtacttctgcatcagcctggccttcgtggacctgctgctgctggtgaacatcagcatcatcctgtacttcagagacttcgtgctgctgagcatcagatag

SEQ ID NO: 18526 - DNA, 102 bp, Artificial Sequence
  Description of Artificial Sequence: Synthetic coding sequence
atgaccgccctgagcagcgagaactgcagcttccagtaccagctgagacagaccaaccagcccctggacgtgaactacctgctgttcctgatcatcctgtag

SEQ ID NO: 18527 - DNA, 1767 bp, Artificial Sequence
  Description of Artificial Sequence: Synthetic coding sequence
atggccagaggcggcgccggcgccgaggaggccagcctgagaagcaacgccctgagctggctggcctgcggcctgctggccctgctggccaacgcctggatcatcctgagcatcagcgccaagcagcagaagcacaagcccctggagctgctgctgtgcttcctggccggcacccacatcctgatggccgccgtgcccctgaccaccttcgccgtggtgcagctgagaagacaggccagcagcgactacgactggaacgagagcatctgcaaggtgttcgtgagcacctactacaccctggccctggccacctgcttcaccgtggccagcctgagctaccacagaatgtggatggtgagatggcccgtgaactacagactgagcaacgccaagaagcaggccctgcacgccgtgatgggcatctggatggtgagcttcatcctgagcaccctgcccagcatcggctggcacaacaacggcgagagatactacgccagaggctgccagttcatcgtgagcaagatcggcctgggcttcggcgtgtgcttcagcctgctgctgctgggcggcatcgtgatgggcctggtgtgcgtggccatcaccttctaccagaccctgtgggccagacccagaagagccagacaggccagaagagtgggcggcggcggcggcaccaaggccggcggccccggcgccctgggcaccagacccgccttcgaggtgcccgccatcgtggtggaggacgccagaggcaagagaagaagcagcctggacggcagcgagagcgccaagaccagcctgcaggtgaccaacctggtgagcgccatcgtgttcctgtacgacagcctgaccggcgtgcccatcctggtggtgagcttcttcagcctgaagagcgacagcgcccccccctggatggtgctggccgtgctgtggtgcagcatggcccagaccctgctgctgcccagcttcatctggagctgcgagagatacagagccgacgtgagaaccgtgtgggagcagtgcgtggccatcatgagcgaggaggacggcgacgacgacggcggctgcgacgactacgccgagggcagagtgtgcaaggtgagattcgacgccaacggcgccaccggccccggcagcagagaccccgcccaggtgaagctgctgcccggcagacacatgctgttcccccccctggagagagtgcactacctgcaggtgcccctgagcagaagactgagccacgacgagaccaacatcttcagcacccccagagagcccggcagcttcctgcacaagtggagcagcagcgacgacatcagagtgctgcccgcccagagcagagccctgggcggcccccccgagtacctgggccagagacacagactggaggacgaggaggacgaggaggaggccgagggcggcggcctggccagcctgagacagttcctggagagcggcgtgctgggcagcggcggcggcccccccagaggccccggcttcttcagagaggagatcaccaccttcatcgacgagacccccctgcccagccccaccgccagccccggccacagccccagaagacccagacccctgggcctgagccccagaagactgagcctgggcagccccgagagcagagccgtgggcctgcccctgggcctgagcgccggcagaagatgcagcctgaccggcggcgaggagagcgccagagcctggggcggcagctggggccccggcaaccccatcttcccccagctgaccctgtag

SEQ ID NO: 18528 - DNA, 915 bp, Artificial Sequence
  Description of Artificial Sequence: Synthetic coding sequence
atgctgagcaccggcgtggtgagcttcttcagcctgaagagcgacagcgcccccccctggatggtgctggccgtgctgtggtgcagcatggcccagaccctgctgctgcccagcttcatctggagctgcgagagatacagagccgacgtgagaaccgtgtgggagcagtgcgtggccatcatgagcgaggaggacggcgacgacgacggcggctgcgacgactacgccgagggcagagtgtgcaaggtgagattcgacgccaacggcgccaccggccccggcagcagagaccccgcccaggtgaagctgctgcccggcagacacatgctgttcccccccctggagagagtgcactacctgcaggtgcccctgagcagaagactgagccacgacgagaccaacatcttcagcacccccagagagcccggcagcttcctgcacaagtggagcagcagcgacgacatcagagtgctgcccgcccagagcagagccctgggcggcccccccgagtacctgggccagagacacagactggaggacgaggaggacgaggaggaggccgagggcggcggcctggccagcctgagacagttcctggagagcggcgtgctgggcagcggcggcggcccccccagaggccccggcttcttcagagaggagatcaccaccttcatcgacgagacccccctgcccagccccaccgccagccccggccacagccccagaagacccagacccctgggcctgagccccagaagactgagcctgggcagccccgagagcagagccgtgggcctgcccctgggcctgagcgccggcagaagatgcagcctgaccggcggcgaggagagcgccagagcctggggcggcagctggggccccggcaaccccatcttcccccagctgaccctgtag

SEQ ID NO: 18529 - DNA, 960 bp, Artificial Sequence
  Description of Artificial Sequence: Synthetic coding sequence
atgaccaacagcagcttcttctgccccgtgtacaaggacctggagcccttcacctacttcttctacctggtgttcctggtgggcatcatcggcagctgcttcgccacctgggccttcatccagaagaacaccaaccacagatgcgtgagcatctacctgatcaacctgctgaccgccgacttcctgctgaccctggccctgcccgtgaagatcgtggtggacctgggcgtggccccctggaagctgaagatcttccactgccaggtgaccgcctgcctgatctacatcaacatgtacctgagcatcatcttcctggccttcgtgagcatcgacagatgcctgcagctgacccacagctgcaagatctacagaatccaggagcccggcttcgccaagatgatcagcaccgtggtgtggctgatggtgctgctgatcatggtgcccaacatgatgatccccatcaaggacatcaaggagaagagcaacgtgggctgcatggagttcaagaaggagttcggcagaaactggcacctgctgaccaacttcatctgcgtggccatcttcctgaacttcagcgccatcatcctgatcagcaactgcctggtgatcagacagctgtacagaaacaaggacaacgagaactaccccaacgtgaagaaggccctgatcaacatcctgctggtgaccaccggctacatcatctgcttcgtgccctaccacatcgtgagaatcccctacaccctgagccagaccgaggtgatcaccgactgcagcaccagaatcagcctgttcaaggccaaggaggccaccctgctgctggccgtgagcaacctgtgcttcgaccccatcctgtactaccacctgagcaaggccttcagaagcaaggtgaccgagaccttcgccagccccaaggagaccaaggcccagaaggagaagctgagatgcgagaacaacgcctag

SEQ ID NO: 18530 - DNA, 57 bp, Artificial Sequence
  Description of Artificial Sequence: Synthetic coding sequence
atgaccaacagcagcttcttctgccccgtgtacaaggacctggagcccttcacctag

SEQ ID NO: 18531 - DNA, 1122 bp, Artificial Sequence
  Description of Artificial Sequence: Synthetic coding sequence
atggccaacaccaccggcgagcccgaggaggtgagcggcgccctgagcccccccagcgccagcgcctacgtgaagctggtgctgctgggcctgatcatgtgcgtgagcctggccggcaacgccatcctgagcctgctggtgctgaaggagagagccctgcacaaggccccctactacttcctgctggacctgtgcctggccgacggcatcagaagcgccgtgtgcttccccttcgtgctggccagcgtgagacacggcagcagctggaccttcagcgccctgagctgcaagatcgtggccttcatggccgtgctgttctgcttccacgccgccttcatgctgttctgcatcagcgtgaccagatacatggccatcgcccaccacagattctacgccaagagaatgaccctgtggacctgcgccgccgtgatctgcatggcctggaccctgagcgtggccatggccttcccccccgtgttcgacgtgggcacctacaagttcatcagagaggaggaccagtgcatcttcgagcacagatacttcaaggccaacgacaccctgggcttcatgctgatgctggccgtgctgatggccgccacccacgccgtgtacggcaagctgctgctgttcgagtacagacacagaaagatgaagcccgtgcagatggtgcccgccatcagccagaactggaccttccacggccccggcgccaccggccaggccgccgccaactggatcgccggcttcggcagaggccccatgccccccaccctgctgggcatcagacagaacggccacgccgccagcagaagactgctgggcatggacgaggtgaagggcgagaagcagctgggcagaatgttctacgccatcaccctgctgttcctgctgctgtggagcccctacatcgtggcctgctactggagagtgttcgtgaaggcctgcgccgtgccccacagatacctggccaccgccgtgtggatgagcttcgcccaggccgccgtgaaccccatcgtgtgcttcctgctgaacaaggacctgaagaagtgcctgagaacccacgccccctgctggggcaccggcggcgcccccgcccccagagagccctactgcgtgatgtag

SEQ ID NO: 18532 - DNA, 159 bp, Artificial Sequence
  Description of Artificial Sequence: Synthetic coding sequence
atggccaacaccaccggcgagcccgaggaggtgagcggcgccctgagcccccccagcgccagcgcctacgtgaagctggtgctgctgggcctgatcatgtgcgtgagcctggccggcaacgccatcctgagcctgctggtgctgaaggagagagcctag

SEQ ID NO: 18533 - DNA, 1002 bp, Artificial Sequence
  Description of Artificial Sequence: Synthetic coding sequence
atgcccgccaactacacctgcaccagacccgacggcgacaacaccgacttcagatacttcatctacgccgtgacctacaccgtgatcctggtgcccggcctgatcggcaacatcctggccctgtgggtgttctacggctacatgaaggagaccaagagagccgtgatcttcatgatcaacctggccatcgccgacctgctgcaggtgctgagcctgcccctgagaatcttctactacctgaaccacgactggcccttcggccccggcctgtgcatgttctgcttctacctgaagtacgtgaacatgtacgccagcatctacttcctggtgtgcatcagcgtgagaagattctggttcctgatgtaccccttcagattccacgactgcaagcagaagtacgacctgtacatcagcatcgccggctggctgatcatctgcctggcctgcgtgctgttccccctgctgagaaccagcgacgacaccagcggcaacagaaccaagtgcttcgtggacctgcccaccagaaacgtgaacctggcccagagcgtggtgatgatgaccatcggcgagctgatcggcttcgtgacccccctgctgatcgtgctgtactgcacctggaagaccgtgctgagcctgcaggacaagtaccccatggcccaggacctgggcgagaagcagaaggccctgaagatgatcctgacctgcgccggcgtgttcctgatctgcttcgccccctaccacttcagcttccccctggacttcctggtgaagagcaacgagatcaagagctgcctggccagaagagtgatcctgatcttccacagcgtggccctgtgcctggccagcctgaacagctgcctggaccccgtgatctactacttcagcaccaacgagttcagaagaagactgagcagacaggacctgcacgacagcatccagctgcacgccaagagcttcgtgagcaaccacaccgccagcaccatgacccccgagctgtgctag

SEQ ID NO: 18534 - DNA, 7104 bp, Artificial Sequence
  Description of Artificial Sequence: Synthetic coding sequence
atgggcaccagaggcgccgtgatgcccccccccatgtggggcctgctgggctgctgcttcgtgtgcgcctgggccctgggcggccccagacccatcagaagcctgccccccctgagcagccaggtgaagcccggcagcgtgcccatgcaggtgcccctggagggcgccgaggccgccctggcctacctgtacagcggcgacgcccagcagctgagccaggtgaactgcagcgagagatacgaggccagaggcgccggcgccatgcccggcctgccccccagcctgcagggcgccgccggcaccctggcccaggccgccaacttcctgaacatgctgctgcaggccaacgacatcagagagagcagcgtggaggaggacgtggagtggtaccaggccctggtgagaagcgtggccgagggcgaccccagagtgtacagagccctgctgaccttcaaccccccccccggcgccagccacctgcagctggccctgcaggccaccagaaccggcgaggagaccatcctgcaggacctgagcggcaactgggtgcaggaggagaacccccccggcgacctggacacccccgccctgaagaagagagtgctgaccaacgacctgggcagcctgggcagccccaagtggccccaggccgacggctacgtgggcgacacccagcaggtgagactgagcccccccttcctggagtgccaggagggcagactgagacccggctggctgatcaccctgagcgccaccttctacggcctgaagcccgacctgagccccgaggtgagaggccaggtgcagatggacgtggacctgcagagcgtggacatcaaccagtgcgccagcggccccggctggtacagcaacacccacctgtgcgacctgaacagcacccagtgcgtgcccctggagagccagggcttcgtgctgggcagatacctgtgcagatgcagacccggcttctacggcgccagccccagcggcggcctggaggagagcgacttccagaccaccggccagttcggcttccccgagggcagaagcggcagactgctgcagtgcctgccctgccccgagggctgcaccagctgcatggacgccaccccctgcctggtggaggaggccgccgtgctgagagccgccgtgctggcctgccaggcctgctgcatgctggccatcttcctgagcatgctggtgagctacagatgcagaagaaacaagagaatctgggccagcggcgtggtgctgctggagaccgtgctgttcggcttcctgctgctgtacttccccgtgttcatcctgtacttcaagcccagcgtgttcagatgcatcgccctgagatgggtgagactgctgggcttcgccatcgtgtacggcaccatcatcctgaagctgtacagagtgctgcagctgttcctgagcagaaccgcccagagaagcgccctgctgagcagcggcagactgctgagaagactgggcctgctgctgctgcccgtgctgggcttcctggccgtgtggaccgtgggcgccctggagagaggcatccagcacgcccccctggtgatcagaggccacacccccagcggcagacacttctacctgtgccaccacgacagatgggactacatcatggtggtggccgagctgctgctgctgtgctggggcagcttcctgtgctacgccaccagagccgtgctgagcgccttccacgagcccagatacatgggcatcgccctgcacaacgagctgctgctgagcgccgccttccacaccgccagattcgtgctggtgcccagcctgcaccccgactggaccctgctgctgttcttcttccacacccacagcaccgtgaccaccaccctggccctgatcttcatccccaagttctggaagctgggcgccccccccagagaggagatggtggacgaggtgtgcgaggacgagctggacctgcagcacagcggcagctacctgggcagcagcatcgccagcgcctggagcgagcacagcctggaccccggcgacatcagagacgagctgaagaagctgtacgcccagctggaggtgcacaagaccaaggagatggccgccaacaacccccacctgcccaagaagagaggcagcagctgccagggcctgggcagaagcttcatgagatacctggccgagttccccgaggccctggccagacagcacagcagagacagcggcagccccggccacggcagcctgcccggcagcagcagaagaagactgctgagcagcagcctgcaggagcccgagggcacccccgccctgcacaagagcagaagcacctacgaccagagaagagagcaggacccccccctgctggacagcctgctgagaagaaagctggccaagaaggccagcagaaccgagagcagagagagcgtggagggcccccccgccctgggcttcagaagcgccagcgcccacaacctgaccgtgggcgagagactgcccagagccagacccgccagcctgcagaagagcctgagcgtggccagcagcagagagaaggccctgctgatggccagccaggcctacctggaggagacctacagacaggccaaggagagagaggagagaaagaaggccaaggccgccatggccagcctggtgagaagacccagcgccagaagactggagagacccagaggcgcccccctgagcgccccccccagccccgccaagagcagcagcgtggacagcagccacaccagcggcagactgcacgaggaggccagaagaagactgccccacccccccatcagacaccaggtgagcacccccatcctggccctgagcggcggcctgggcgagcccagaatgctgagccccaccagcaccctggcccccgccctgctgcccgccctggcccccacccccgcccccgccctggcccccgtgcccgtgagcccccagagccccaacctgctgacctacatctgcccctgggagaacgccgagctgcccgccaagcaggagaacgtgccccaggagggccccagcggccccgagagaggccaccacagccccgcccccgccagagccagactgtggagagccctgagcgtggccgtggagaagagcagagccggcgagaacgagatggacgccgaggacgcccaccaccagagagaggccaacgacgtggacgaggacagacccaagatcttccccaagagccacagcctgaaggcccccgtgcagcagggcagcatgagaagcctgggcctggccatcaaggccctgaccagaagcagaagcacctacagagagaaggagagcgtggaggagagccccgagggccagaacagcggcaccgccggcgagagcatgggcgcccccagcagaagccccagactgggcagacccaaggccgtgagcaagcaggccgccctgatccccagcgacgacaaggagagcctgcagaaccagcagaacgcccacaccagcagaatgctgcaggtgtgccagagagagggcagcagagagcaggaggacagaggcagaagaatgacccagggcctgggcgagagaaaggccgagagagccggcaagaccggcctggccatgctgagacaggtgagcagagacaagaacatcaagcagagcaaggagacccccgtgggctggcaggagctgcccaaggccggcctgcagagcctgggcagcgccgaccacagagtggccgaggtgtgcccctgggaggtgaccgagagcgagaccagacagcccgacagcggcaacaaggccgagatctgcccctgggagaccagcgagggcgcccccgagagcagagccctgagacaggaccccggcgacagccagaagaagagaggcgaggccagaggcaagagcgagcccatcgacgtggtgcccatgatgagaaagaagcccgagagactggtgagagagcaggaggccgtgtgcccctgggagagcgccgacagaggcggcctgagccccggcagcgccccccaggaccccggcagaatcagagacaagagcgaggccggcgacagcgtggaggccagaaaggtggagaagcccggctgggaggccgccggccccgaggcccacacccccgacatcaccaaggccgagccctgcccctgggaggccagcgagggcggcgaggacggcaagcccgcccaggaggccgtgaaggacctgccccaggagaagcagaagaccagaaaggccaccttctggaaggagcagaagcccggcggcgacctggagagcctgtgcccctgggagagcaccgacttcagaggccccagcgccgtgagcatccaggcccccggcagcagcgagtgcagcggcagcctgggcagcggcatcgccgaggtgtgcctgtgggaggccggcgacgcccccgccatccagaaggccgagatctgcccctgggagctggacgacaacgtgatgggccaggagatgctgagcctgggcaccggcagagagagcctgcaggagaaggagaaggccagcagaaagggcagcttcggcgagatgggcgagcagaccgtgaaggccgtgcagaagctgagccagcagcaggagagcgtgtgccccagagagagcaccgtgcccggccacagcagcccctgcctggacaacagcagcagcaaggccggcagccagttcctgtgcaacggcggcagcagagccacccaggtgtgcccccaggaggacctgagacccgaggcccaggaggccacccccgccaagaccgagatctgcccctgggaggtgaacgagagaaccagagaggagtggaccagcgcccaggtgcccagaggcggcgagagccagaaggacaaggagaagatgcccggcaagagcgagatcgaggacgtgaccgcctgggagaagcccgagggccagatccagaagcaggaggccgtgggcccctgggagagcgtggaccccggcagcttcagcccccagcccagaccccaggacaccgagagaccccagaccctgctgcagatgagcggcagcgtgggcagcaaggccgccgacatctgccccctggacgtggaggagaacctgaccgccggcaaggccgagatctgcccctgggaggtgggcgccggcgccggcgaggagagagccctgggcgccgaggccatcagaaagagccccaacgacaccggcaaggtgagcgccgacctgggccccagagagagagccgtgaccgcccccgagaagccccagaagcccacccccgagtgggaggtggcctgcccctggggcagcgtgggccccggcgcctgcagccagcaccccggcaccctggacgccgacggccccaaggccggcttccaggagctggaccacatgggctgcagacccggcgaggtgtgcccctgggaggcccaggaggccgccaccagcgagaaggccaagatctgcccctgggaggtgagcgagggcaccaccggcaagggcctggaccagaaggccggcagcgagagcgccgagcagagagagaaggccctggagaagggcagactgaccagcctgggcgaggacgtgagcaagggcatggccaagctgtgccagcagcaggagaccatctgcatctgggagaacaaggacctgagagagagccccgcccaggcccccaagatcagcgacctgcccagcagcatgagcagcgaggtggccgagggccacagcctggaggccaccgagaagggcgacctgagacaggaccccaagaccggcagcttccccgagcacatcacccaggagaaggcccccgccgccgacaccgaggagttcaccaccgaggacggcgagaagaccagccacgagctgcagagcgtgtgcccctgggagaccaccgcccccgccgacagcgtgagccacctggacagacagagacccgaccagcccaaggccagcagccagagactggtgagcaccggcggcagagccgccgacgtgtgcccctgggacgtgcccgacgccggcgtgtacaagagcgacagcagcgccaaggccgagacctgcccctgggaggtgaccgagagaatccccgtgaagggcgtgagcagacaggacggcaagggcgacagccaggaggagaagggcagagcccccgagaagagcgagcccaagggcgtgcccgtgcagaagaagcccgagatggccgacttcagacagcaggaggccgtgtgcccctgggagagccaggacggcaagggcctgagcccccagcccgcccccgacgccagcgacagaagcagaggcagcagcgaggccgccggcagcgtggagaccagagtggccgaggtgtgcctgtgggaggtggtggaggcccccagcgccaagaaggccgagatctgcccctgggaggccggcggcggcgccgccgaggagggcgagcaggagagagagagccagggccagggcgagatgttcctgcagaaggccggccccggcggcaccgaggagcacttcagcaaggccgccgccaagcccagagagcaggaggccgtgtgccccggcgagggcaccggcagcggcggcctgctgccccagagcggcgccctggaccccgagctgaaggtgagccccaaggaggccggcagcatgggcagcagaatggccgagctgtgccagtgggagatcaccgaccccgagggcaacaagatcaagggcaccatggccgacatctgccccggcgaggagaccggcgtgcccagcgaggagagcggcctgctggccctgaccgccaccagaagagagttcttccccaccgcccccgagaagcccctgtgcctgctggtgcacggccccctggaccacttcttccccgagagcaagatcccctgccccaaggtgagcagacccgccagcaccttcaccctggagggcgtgagagagctgcagggccccagcggcctggagcccagaaccagcctggcccccgagcccagcctgcaggaggccgagagccagagcagcagcctgaccgaggacagcggccaggtggccttcgaggcccagtacgaggagttcaccccccccaccgtgtacccctgggactgggagtag

SEQ ID NO: 18535 - DNA, 1323 bp, Artificial Sequence
  Description of Artificial Sequence: Synthetic coding sequence
atgggcggcctgagactgctggccgtggccctgacctgctgctggtggccccagggcagccagggcaagaccctgagaggcagcttcagcagcaccgccgcccaggacgcccagggccagagaatcggccacttcgagttccacggcgaccacgccctgctgtgcgtgagaatcaacaacatcgccgtggccgtgggcaaggaggccaagctgtacctgttccaggcccaggagtggctgaagctgcagcagagcagccacggctacagctgcagcgagaagctgagcaaggcccagctgaccatgaccatgaaccagaccgagcacaacctgaccgtgagccagatccccagcccccagacctggcacgtgttctacgccgacaagtacacctgccaggacgacaaggagaacagccaggtggaggacatccccttcgagatggtgctgctgaaccccgacgccgagggcaaccccttcgaccacttcagcgccggcgagagcggcctgcacgagttcttcttcctgctggtgctggtgtacttcgtgatcgcctgcatctacgcccagagcctgtggcaggccatcaagaagggcggccccatgcacatgatcctgaaggtgctgaccaccgccctgctgctgcaggccggcagcgccctggccaactacatccacttcagcagctacagcaaggacggcatcggcgtgcccttcatgggcagcctggccgagttcttcgacatcgccagccagatccagatgctgtacctgctgctgagcctgtgcatgggctggaccatcgtgagaatgaagaagagccagagcagacccctgcagtgggacagcacccccgccagcaccggcatcgccgtgttcatcgtgatgacccagagcgtgctgctgctgtgggagcagttcgaggacatcagccaccacagctaccacagccaccacaacctggccggcatcctgctgatcgtgctgagaatctgcctggccctgagcctgggctgcggcctgtaccagatcatcaccgtggagagaagcaccctgaagagagagttctacatcaccttcgccaagggctgcatcctgtggttcctgtgccaccccgtgctggcctgcatcagcgtgatcttcagcgactaccagagagacaaggtgatcaccatcggcgtgatcctgtgccagagcgtgagcatggtgatcctgtacagactgttcctgagccacagcctgtactgggaggtgagcagcctgagcagcgtgaccctgcccctgaccatcagcagcggccacaagagcagaccccacttctag

SEQ ID NO: 18536 - DNA, 1215 bp, Artificial Sequence
  Description of Artificial Sequence: Synthetic coding sequence
atgagcgtgaagcccagctggggccccggccccagcgagggcgtgaccgccgtgcccaccagcgacctgggcgagatccacaactggaccgagctgctggacctgttcaaccacaccctgagcgagtgccacgtggagctgagccagagcaccaagagagtggtgctgttcgccctgtacctggccatgttcgtggtgggcctggtggagaacctgctggtgatctgcgtgaactggagaggcagcggcagagccggcctgatgaacctgtacatcctgaacatggccatcgccgacctgggcatcgtgctgagcctgcccgtgtggatgctggaggtgaccctggactacacctggctgtggggcagcttcagctgcagattcacccactacttctacttcgtgaacatgtacagcagcatcttcttcctggtgtgcctgagcgtggacagatacgtgaccctgaccagcgccagccccagctggcagagataccagcacagagtgagaagagccatgtgcgccggcatctgggtgctgagcgccatcatccccctgcccgaggtggtgcacatccagctggtggagggccccgagcccatgtgcctgttcatggcccccttcgagacctacagcacctgggccctggccgtggccctgagcaccaccatcctgggcttcctgctgcccttccccctgatcaccgtgttcaacgtgctgaccgcctgcagactgagacagcccggccagcccaagagcagaagacactgcctgctgctgtgcgcctacgtggccgtgttcgtgatgtgctggctgccctaccacgtgaccctgctgctgctgaccctgcacggcacccacatcagcctgcactgccacctggtgcacctgctgtacttcttctacgacgtgatcgactgcttcagcatgctgcactgcgtgatcaaccccatcctgtacaacttcctgagcccccacttcagaggcagactgctgaacgccgtggtgcactacctgcccaaggaccagaccaaggccggcacctgcgccagcagcagcagctgcagcacccagcacagcatcatcatcaccaagggcgacagccagcccgccgccgccgccccccaccccgagcccagcctgagcttccaggcccaccacctgctgcccaacaccagccccatcagccccacccagcccctgacccccagctag

SEQ ID NO: 18537 - DNA, 1446 bp, Artificial Sequence
  Description of Artificial Sequence: Synthetic coding sequence
atgagatggctgtggcccctggccgtgagcctggccgtgatcctggccgtgggcctgagcagagtgagcggcggcgcccccctgcacctgggcagacacagagccgagacccaggagcagcagagcagaagcaagagaggcaccgaggacgaggaggccaagggcgtgcagcagtacgtgcccgaggagtgggccgagtaccccagacccatccaccccgccggcctgcagcccaccaagcccctggtggccaccagccccaaccccggcaaggacggcggcacccccgacagcggccaggagctgagaggcaacctgaccggcgcccccggccagagactgcagatccagaaccccctgtaccccgtgaccgagagcagctacagcgcctacgccatcatgctgctggccctggtggtgttcgccgtgggcatcgtgggcaacctgagcgtgatgtgcatcgtgtggcacagctactacctgaagagcgcctggaacagcatcctggccagcctggccctgtgggacttcctggtgctgttcttctgcctgcccatcgtgatcttcaacgagatcaccaagcagagactgctgggcgacgtgagctgcagagccgtgcccttcatggaggtgagcagcctgggcgtgaccaccttcagcctgtgcgccctgggcatcgacagattccacgtggccaccagcaccctgcccaaggtgagacccatcgagagatgccagagcatcctggccaagctggccgtgatctgggtgggcagcatgaccctggccgtgcccgagctgctgctgtggcagctggcccaggagcccgcccccaccatgggcaccctggacagctgcatcatgaagcccagcgccagcctgcccgagagcctgtacagcctggtgatgacctaccagaacgccagaatgtggtggtacttcggctgctacttctgcctgcccatcctgttcaccgtgacctgccagctggtgacctggagagtgagaggcccccccggcagaaagagcgagtgcagagccagcaagcacgagcagtgcgagagccagctgaacagcaccgtggtgggcctgaccgtggtgtacgccttctgcaccctgcccgagaacgtgtgcaacatcgtggtggcctacctgagcaccgagctgaccagacagaccctggacctgctgggcctgatcaaccagttcagcaccttcttcaagggcgccatcacccccgtgctgctgctgtgcatctgcagacccctgggccaggccttcctggactgctgctgctgctgctgctgcgaggagtgcggcggcgccagcgaggccagcgccgccaacggcagcgacaacaagctgaagaccgaggtgagcagcagcatctacttccacaagcccagagagagcccccccctgctgcccctgggcaccccctgctag

SEQ ID NO: 18538 - DNA, 1047 bp, Artificial Sequence
  Description of Artificial Sequence: Synthetic coding sequence
atgctgctggccctggtggtgttcgccgtgggcatcgtgggcaacctgagcgtgatgtgcatcgtgtggcacagctactacctgaagagcgcctggaacagcatcctggccagcctggccctgtgggacttcctggtgctgttcttctgcctgcccatcgtgatcttcaacgagatcaccaagcagagactgctgggcgacgtgagctgcagagccgtgcccttcatggaggtgagcagcctgggcgtgaccaccttcagcctgtgcgccctgggcatcgacagattccacgtggccaccagcaccctgcccaaggtgagacccatcgagagatgccagagcatcctggccaagctggccgtgatctgggtgggcagcatgaccctggccgtgcccgagctgctgctgtggcagctggcccaggagcccgcccccaccatgggcaccctggacagctgcatcatgaagcccagcgccagcctgcccgagagcctgtacagcctggtgatgacctaccagaacgccagaatgtggtggtacttcggctgctacttctgcctgcccatcctgttcaccgtgacctgccagctggtgacctggagagtgagaggcccccccggcagaaagagcgagtgcagagccagcaagcacgagcagtgcgagagccagctgaacagcaccgtggtgggcctgaccgtggtgtacgccttctgcaccctgcccgagaacgtgtgcaacatcgtggtggcctacctgagcaccgagctgaccagacagaccctggacctgctgggcctgatcaaccagttcagcaccttcttcaagggcgccatcacccccgtgctgctgctgtgcatctgcagacccctgggccaggccttcctggactgctgctgctgctgctgctgcgaggagtgcggcggcgccagcgaggccagcgccgccaacggcagcgacaacaagctgaagaccgaggtgagcagcagcatctacttccacaagcccagagagagcccccccctgctgcccctgggcaccccctgctag

SEQ ID NO: 18539 - DNA, 1014 bp, Artificial Sequence
  Description of Artificial Sequence: Synthetic coding sequence
atgggcaacgacagcgtgagctacgagtacggcgactacagcgacctgagcgacagacccgtggactgcctggacggcgcctgcctggccatcgaccccctgagagtggcccccctgcccctgtacgccgccatcttcctggtgggcgtgcccggcaacgccatggtggcctgggtggccggcaaggtggccagaagaagagtgggcgccacctggctgctgcacctggccgtggccgacctgctgtgctgcctgagcctgcccatcctggccgtgcccatcgccagaggcggccactggccctacggcgccgtgggctgcagagccctgcccagcatcatcctgctgaccatgtacgccagcgtgctgctgctggccgccctgagcgccgacctgtgcttcctggccctgggccccgcctggtggagcaccgtgcagagagcctgcggcgtgcaggtggcctgcggcgccgcctggaccctggccctgctgctgaccgtgcccagcgccatctacagaagactgcaccaggagcacttccccgccagactgcagtgcgtggtggactacggcggcagcagcagcaccgagaacgccgtgaccgccatcagattcctgttcggcttcctgggccccctggtggccgtggccagctgccacagcgccctgctgtgctgggccgccagaagatgcagacccctgggcaccgccatcgtggtgggcttcttcgtgtgctgggccccctaccacctgctgggcctggtgctgaccgtggccgcccccaacagcgccctgctggccagagccctgagagccgagcccctgatcgtgggcctggccctggcccacagctgcctgaaccccatgctgttcctgtacttcggcagagcccagctgagaagaagcctgcccgccgcctgccactgggccctgagagagagccagggccaggacgagagcgtggacagcaagaagagcaccagccacgacctggtgagcgagatggaggtgtag

SEQ ID NO: 18540 - DNA, 1014 bp, Artificial Sequence; identical to SEQ ID NO: 18539
  Description of Artificial Sequence: Synthetic coding sequence

SEQ ID NO: 18541 - DNA, 1155 bp, Artificial Sequence
  Description of Artificial Sequence: Synthetic coding sequence
atgaccaacagcagcagcaccagcaccagcagcaccaccggcggcagcctgctgctgctgtgcgaggaggaggagagctgggccggcagaagaatccccgtgagcctgctgtacagcggcctggccatcggcggcaccctggccaacggcatggtgatctacctggtgagcagcttcagaaagctgcagaccaccagcaacgccttcatcgtgaacggctgcgccgccgacctgagcgtgtgcgccctgtggatgccccaggaggccgtgctgggcctgctgcccaccggcagcgccgagccccccgccgactgggacggcgccggcggcagctacagactgctgagaggcggcctgctgggcctgggcctgaccgtgagcctgctgagccactgcctggtggccctgaacagatacctgctgatcaccagagcccccgccacctaccaggccctgtaccagagaagacacaccgccggcatgctggccctgagctgggccctggccctgggcctggtgctgctgctgcccccctgggcccccagacccggcgccgccccccccagagtgcactaccccgccctgctggccgccgccgccctgctggcccagaccgccctgctgctgcactgctacctgggcatcgtgagaagagtgagagtgagcgtgaagagagtgagcgtgctgaacttccacctgctgcaccagctgcccggctgcgccgccgccgccgccgccttccccggcgcccagcacgcccccggccccggcggcgccgcccaccccgcccaggcccagcccctgccccccgccctgcaccccagaagagcccagagaagactgagcggcctgagcgtgctgctgctgtgctgcgtgttcctgctggccacccagcccctggtgtgggtgagcctggccagcggcttcagcctgcccgtgccctggggcgtgcaggccgccagctggctgctgtgctgcgccctgagcgccctgaaccccctgctgtacacctggagaaacgaggagttcagaagaagcgtgagaagcgtgctgcccggcgtgggcgacgccgccgccgccgccgtggccgccaccgccgtgcccgccgtgagccaggcccagctgggcaccagagccgccggccagcactggtag

SEQ ID NO: 18542 - DNA, 963 bp, Artificial Sequence
  Description of Artificial Sequence: Synthetic coding sequence
atgttcctgggcatcctgagcatcgagcagctgatcagcagagtgggcgtgatcggcgtgaccctgatggccctgctgagcggcttcggcgccgtgaactgcccctacacctacatgagctacttcctgagaaacgtgaccgacaccgacatcctggccctggagagaagactgctgcagaccatggacatgatcatcagcaagaagaagagaatggccatggccagaagaaccatgttccagaagggcgaggtgcacaacaagcccagcggcttctggggcatgatcaagagcgtgaccaccagcgccagcggcagcgagaacctgaccctgatccagcaggaggtggacgccctggaggagctgagcagacagctgttcctggagaccgccgacctgtacgccaccaaggagagaatcgagtacagcaagaccttcaagggcaagtacttcaacttcctgggctacttcttcagcatctactgcgtgtggaagatcttcatggccaccatcaacatcgtgttcgacagagtgggcaagaccgaccccgtgaccagaggcatcgagatcaccgtgaactacctgggcatccagttcgacgtgaagttctggagccagcacatcagcttcatcctggtgggcatcatcatcgtgaccagcatcagaggcctgctgatcaccctgaccaagttcttctacgccatcagcagcagcaagagcagcaacgtgatcgtgctgctgctggcccagatcatgggcatgtacttcgtgagcagcgtgctgctgatcagaatgagcatgcccctggagtacagaaccatcatcaccgaggtgctgggcgagctgcagttcaacttctaccacagatggttcgacgtgatcttcctggtgagcgccctgagcagcatcctgttcctgtacctggcccacaagcaggcccccgagaagcagatggccccctag

SEQ ID NO: 18543 - DNA, 1173 bp, Artificial Sequence
  Description of Artificial Sequence: Synthetic coding sequence
atgaccctgacctgcgtgttctgggacgtgaccaagggcaccaccggcgactggagcagcgagggctgcagcaccgaggtgagacccgagggcaccgtgtgctgctgcgaccacctgaccttcttcgccctgctgctgagacccaccctggaccagagcaccgtgcacatcctgaccagaatcagccaggccggctgcggcgtgagcatgatcttcctggccttcaccatcatcctgtacgccttcctgagactgagcagagagagattcaagagcgaggacgcccccaagatccacgtggccctgggcggcagcctgttcctgctgaacctggccttcctggtgaacgtgggcagcggcagcaagggcagcgacgccgcctgctgggccagaggcgccgtgttccactacttcctgctgtgcgccttcacctggatgggcctggaggccttccacctgtacctgctggccgtgagagtgttcaacacctacttcggccactacttcctgaagctgagcctggtgggctggggcctgcccgccctgatggtgatcggcaccggcagcgccaacagctacggcctgtacaccatcagagacagagagaacagaaccagcctggagctgtgctggttcagagagggcaccaccatgtacgccctgtacatcaccgtgcacggctacttcctgatcaccttcctgttcggcatggtggtgctggccctggtggtgtggaagatcttcaccctgagcagagccaccgccgtgaaggagagaggcaagaacagaaagaaggtgctgaccctgctgggcctgagcagcctggtgggcgtgacctggggcctggccatcttcacccccctgggcctgagcaccgtgtacatcttcgccctgttcaacagcctgcagggcagcagcgtggactgccaggccctgagcgccggcgagaagctgctgagcctgctgggcctgccccagcagccctggaagctgagagccgccgcccacctgcccgtgagaatgctgggcgccgacgtggactgcaagtggatgagattcgccagcccccccagcccccaggccgtggagagacaggagggcggccccagcctgtacgccagaagatgcgtgcccggcagagagatcctgggcagaggccactgcatcatctag

SEQ ID NO: 18544 - DNA, 1650 bp, Artificial Sequence
  Description of Artificial Sequence: Synthetic coding sequence
atggccacccccagaggcctgggcgccctgctgctgctgctgctgctgcccaccagcggccaggagaagcccaccgagggccccagaaacacctgcctgggcagcaacaacatgtacgacatcttcaacctgaacgacaaggccctgtgcttcaccaagtgcagacagagcggcagcgacagctgcaacgtggagaacctgcagagatactggctgaactacgaggcccacctgatgaaggagggcctgacccagaaggtgaacacccccttcctgaaggccctggtgcagaacctgagcaccaacaccgccgaggacttctacttcagcctggagcccagccaggtgcccagacaggtgatgaaggacgaggacaagccccccgacagagtgagactgcccaagagcctgttcagaagcctgcccggcaacagaagcgtggtgagactggccgtgaccatcctggacatcggccccggcaccctgttcaagggccccagactgggcctgggcgacggcagcggcgtgctgaacaacagactggtgggcctgagcgtgggccagatgcacgtgaccaagctggccgagcccctggagatcgtgttcagccaccagagacccccccccaacatgaccctgacctgcgtgttctgggacgtgaccaagggcaccaccggcgactggagcagcgagggctgcagcaccgaggtgagacccgagggcaccgtgtgctgctgcgaccacctgaccttcttcgccctgctgctgagacccaccctggaccagagcaccgtgcacatcctgaccagaatcagccaggccggctgcggcgtgagcatgatcttcctggccttcaccatcatcctgtacgccttcctgagactgagcagagagagattcaagagcgaggacgcccccaagatccacgtggccctgggcggcagcctgttcctgctgaacctggccttcctggtgaacgtgggcagcggcagcaagggcagcgacgccgcctgctgggccagaggcgccgtgttccactacttcctgctgtgcgccttcacctggatgggcctggaggccttccacctgtacctgctggccgtgagagtgttcaacacctacttcggccactacttcctgaagctgagcctggtgggctggggcctgcccgccctgatggtgatcggcaccggcagcgccaacagctacggcctgtacaccatcagagacagagagaacagaaccagcctggagctgtgctggttcagagagggcaccaccatgtacgccctgtacatcaccgtgcacggctacttcctgatcaccttcctgttcggcatggtggtgctggccctggtggtgtggaagatcttcaccctgagcagagccaccgccgtgaaggagagaggcaagaacagaaagaaggtgctgaccctgctgggcctgagcagcctggtgggcgtgacctggggcctggccatcttcacccccctgggcctgagcaccgtgtacatcttcgccctgttcaacagcctgcagggcgtgttcatctgctgctggttcaccatcctgtacctgcccagccagagcaccaccgtgagcagcagcaccgccagactggaccaggcccacagcgccagccaggagtag

SEQ ID NO: 18545 - DNA, 1290 bp, Artificial Sequence
  Description of Artificial Sequence: Synthetic coding sequence
atgaaggacgaggacaagccccccgacagagtgagactgcccaagagcctgttcagaagcctgcccggcaacagaagcgtggtgagactggccgtgaccatcctggacatcggccccggcaccctgttcaagggccccagactgggcctgggcgacggcagcggcgtgctgaacaacagactggtgggcctgagcgtgggccagatgcacgtgaccaagctggccgagcccctggagatcgtgttcagccaccagagacccccccccaacatgaccctgacctgcgtgttctgggacgtgaccaagggcaccaccggcgactggagcagcgagggctgcagcaccgaggtgagacccgagggcaccgtgtgctgctgcgaccacctgaccttcttcgccctgctgctgagacccaccctggaccagagcaccgtgcacatcctgaccagaatcagccaggccggctgcggcgtgagcatgatcttcctggccttcaccatcatcctgtacgccttcctgagactgagcagagagagattcaagagcgaggacgcccccaagatccacgtggccctgggcggcagcctgttcctgctgaacctggccttcctggtgaacgtgggcagcggcagcaagggcagcgacgccgcctgctgggccagaggcgccgtgttccactacttcctgctgtgcgccttcacctggatgggcctggaggccttccacctgtacctgctggccgtgagagtgttcaacacctacttcggccactacttcctgaagctgagcctggtgggctggggcctgcccgccctgatggtgatcggcaccggcagcgccaacagctacggcctgtacaccatcagagacagagagaacagaaccagcctggagctgtgctggttcagagagggcaccaccatgtacgccctgtacatcaccgtgcacggctacttcctgatcaccttcctgttcggcatggtggtgctggccctggtggtgtggaagatcttcaccctgagcagagccaccgccgtgaaggagagaggcaagaacagaaagaaggtgctgaccctgctgggcctgagcagcctggtgggcgtgacctggggcctggccatcttcacccccctgggcctgagcaccgtgtacatcttcgccctgttcaacagcctgcagggcgtgttcatctgctgctggttcaccatcctgtacctgcccagccagagcaccaccgtgagcagcagcaccgccagactggaccaggcccacagcgccagccaggagtag

SEQ ID NO: 18546 - DNA, 1074 bp, Artificial Sequence
  Description of Artificial Sequence: Synthetic coding sequence
atggccaccaccgtgcccgacggctgcagaaacggcctgaagagcaagtactacagactgtgcgacaaggccgaggcctggggcatcgtgctggagaccgtggccaccgccggcgtggtgaccagcgtggccttcatgctgaccctgcccatcctggtgtgcaaggtgcaggacagcaacagaagaaagatgctgcccacccagttcctgttcctgctgggcgtgctgggcatcttcggcctgaccttcgccttcatcatcggcctggacggcagcaccggccccaccagattcttcctgttcggcatcctgttcagcatctgcttcagctgcctgctggcccacgccgtgagcctgaccaagctggtgagaggcagaaagcccctgagcctgctggtgatcctgggcctggccgtgggcttcagcctggtgcaggacgtgatcgccatcgagtacatcgtgctgaccatgaacagaaccaacgtgaacgtgttcagcgagctgagcgcccccagaagaaacgaggacttcgtgctgctgctgacctacgtgctgttcctgatggccctgaccttcctgatgagcagcttcaccttctgcggcagcttcaccggctggaagagacacggcgcccacatctacctgaccatgctgctgagcatcgccatctgggtggcctggatcaccctgctgatgctgcccgacttcgacagaagatgggacgacaccatcctgagcagcgccctggccgccaacggctgggtgttcctgctggcctacgtgagccccgagttctggctgctgaccaagcagagaaaccccatggactaccccgtggaggacgccttctgcaagccccagctggtgaagaagagctacggcgtggagaacagagcctacagccaggaggagatcacccagggcttcgaggagaccggcgacaccctgtacgccccctacagcacccacttccagctgcagaaccagcccccccagaaggagttcagcatccccagagcccacgcctggcccagcccctacaaggactacgaggtgaagaaggagggcagctag

SEQ ID NO: 18547 - DNA, 825 bp, Artificial Sequence
  Description of Artificial Sequence: Synthetic coding sequence
atggccaccaccgtgcccgacggctgcagaaacggcctgaagagcaagtactacagactgtgcgacaaggccgaggcctggggcatcgtgctggagaccgtggccaccgccggcgtggtgaccagcgtggccttcatgctgaccctgcccatcctggtgtgcaaggtgcaggacagcaacagaagaaagatgctgcccacccagttcctgttcctgctgggcgtgctgggcatcttcggcctgaccttcgccttcatcatcggcctggacggcagcaccggccccaccagattcttcctgttcggcatcctgttcagcatctgcttcagctgcctgctggcccacgccgtgagcctgaccaagctggtgagaggcagaaagcccctgagcctgctggtgatcctgggcctggccgtgggcttcagcctggtgcaggacgtgatcgccatcgagtacatcgtgctgaccatgaacagaaccaacgtgaacgtgttcagcgagctgagcgcccccagaagaaacgaggacttcgtgctgctgctgacctacgtgctgttcctgatggccctgaccttcctgatgagcagcttcaccttctgcggcagcttcaccggctggaagagacacggcgcccacatctacctgaccatgctgctgagcatcgccatctgggtggcctggatcaccctgctgatgctgcccgacttcgacagaagatgggacgacaccatcctgagcagcgccctggccgccaacggctgggtgttcctgctggcctacgtgagccccgagttctggctgctgaccaagcagagaaacccctag

SEQ ID NO: 18548 - DNA, 2781 bp, Artificial Sequence
  Description of Artificial Sequence: Synthetic coding sequence
atggccttcctgatcatcctgatcacctgcttcgtgatcatcctggccaccagccagccctgccagacccccgacgacttcgtggccgccaccagccccggccacatcatcatcggcggcctgttcgccatccacgagaagatgctgagcagcgaggacagccccagaagaccccagatccaggagtgcgtgggcttcgagatcagcgtgttcctgcagaccctggccatgatccacagcatcgagatgatcaacaacagcaccctgctgcccggcgtgaagctgggctacgagatctacgacacctgcaccgaggtgaccgtggccatggccgccaccctgagattcctgagcaagttcaactgcagcagagagaccgtggagttcaagtgcgactacagcagctacatgcccagagtgaaggccgtgatcggcagcggctacagcgagatcaccatggccgtgagcagaatgctgaacctgcagctgatgccccaggtgggctacgagagcaccgccgagatcctgagcgacaagatcagattccccagcttcctgagaaccgtgcccagcgacttccaccagatcaaggccatggcccacctgatccagaagagcggctggaactggatcggcatcatcaccaccgacgacgactacggcagactggccctgaacaccttcatcatccaggccgaggccaacaacgtgtgcatcgccttcaaggaggtgctgcccgccttcctgagcgacaacaccatcgaggtgagaatcaacagaaccctgaagaagatcatcctggaggcccaggtgaacgtgatcgtggtgttcctgagacagttccacgtgttcgacctgttcaacaaggccatcgagatgaacatcaacaagatgtggatcgccagcgacaactggagcaccgccaccaagatcaccaccatccccaacgtgaagaagatcggcaaggtggtgggcttcgccttcagaagaggcaacatcagcagcttccacagcttcctgcagaacctgcacctgctgcccagcgacagccacaagctgctgcacgagtacgccatgcacctgagcgcctgcgcctacgtgaaggacaccgacctgagccagtgcatcttcaaccacagccagagaaccctggcctacaaggccaacaaggccatcgagagaaacttcgtgatgagaaacgacttcctgtgggactacgccgagcccggcctgatccacagcatccagctggccgtgttcgccctgggctacgccatcagagacctgtgccaggccagagactgccagaaccccaacgccttccagccctgggagctgctgggcgtgctgaagaacgtgaccttcaccgacggctggaacagcttccacttcgacgcccacggcgacctgaacaccggctacgacgtggtgctgtggaaggagatcaacggccacatgaccgtgaccaagatggccgagtacgacctgcagaacgacgtgttcatcatccccgaccaggagaccaagaacgagttcagaaacctgaagcagatccagagcaagtgcagcaaggagtgcagccccggccagatgaagaagaccaccagaagccagcacatctgctgctacgagtgccagaactgccccgagaaccactacaccaaccagaccgacatgccccactgcctgctgtgcaacaacaagacccactgggcccccgtgagaagcaccatgtgcttcgagaaggaggtggagtacctgaactggaacgacagcctggccatcctgctgctgatcctgagcctgctgggcatcatcttcgtgctggtggtgggcatcatcttcaccagaaacctgaacacccccgtggtgaagagcagcggcggcctgagagtgtgctacgtgatcctgctgtgccacttcctgaacttcgccagcaccagcttcttcatcggcgagccccaggacttcacctgcaagaccagacagaccatgttcggcgtgagcttcaccctgtgcatcagctgcatcctgaccaagagcctgaagatcctgctggccttcagcttcgaccccaagctgcagaagttcctgaagtgcctgtacagacccatcctgatcatcttcacctgcaccggcatccaggtggtgatctgcaccctgtggctgatcttcgccgcccccaccgtggaggtgaacgtgagcctgcccagagtgatcatcctggagtgcgaggagggcagcatcctggccttcggcaccatgctgggctacatcgccatcctggccttcatctgcttcatcttcgccttcaagggcaagtacgagaactacaacgaggccaagttcatcaccttcggcatgctgatctacttcatcgcctggatcaccttcatccccatctacgccaccaccttcggcaagtacgtgcccgccgtggagatcatcgtgatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccccgccagcctggacagcatgagcggcaacgtgaccatgaccaaccccagcagcagcggcaagagcgccacctggcagaagagcaaggacctgcaggcccaggccttcgcccacatctgcagagagaacgccaccagcgtgagcaagaccctgcccagaaagagaatgagcagcatctag

SEQ ID NO: 18549 - DNA, 2568 bp, Artificial Sequence
  Description of Artificial Sequence: Synthetic coding sequence
atggccttcctgatcatcctgatcacctgcttcgtgatcatcctggccaccagccagccctgccagacccccgacgacttcgtggccgccaccagccccggccacatcatcatcggcggcctgttcgccatccacgagaagatgctgagcagcgaggacagccccagaagaccccagatccaggagtgcgtgggcttcgagatcagcgtgttcctgcagaccctggccatgatccacagcatcgagatgatcaacaacagcaccctgctgcccggcgtgaagctgggctacgagatctacgacacctgcaccgaggtgaccgtggccatggccgccaccctgagattcctgagcaagttcaactgcagcagagagaccgtggagttcaagtgcgactacagcagctacatgcccagagtgaaggccgtgatcggcagcggctacagcgagatcaccatggccgtgagcagaatgctgaacctgcagctgatgccccaggtgggctacgagagcaccgccgagatcctgagcgacaagatcagattccccagcttcctgagaaccgtgcccagcgacttccaccagatcaaggccatggcccacctgatccagaagagcggctggaactggatcggcatcatcaccaccgacgacgactacggcagactggccctgaacaccttcatcatccaggccgaggccaacaacgtgtgcatcgccttcaaggaggtgctgcccgccttcctgagcgacaacaccatcgaggtgagaatcaacagaaccctgaagaagatcatcctggaggcccaggtgaacgtgatcgtggtgttcctgagacagttccacgtgttcgacctgttcaacaaggccatcgagatgaacatcaacaagatgtggatcgccagcgacaactggagcaccgccaccaagatcaccaccatccccaacgtgaagaagatcggcaaggtggtgggcttcgccttcagaagaggcaacatcagcagcttccacagcttcctgcagaacctgcacctgctgcccagcgacagccacaagctgctgcacgagtacgccatgcacctgagcgcctgcgcctacgtgaaggacaccgacctgagccagtgcatcttcaaccacagccagagaaccctggcctacaaggccaacaaggccatcgagagaaacttcgtgatgagaaacgacttcctgtgggactacgccgagcccggcctgatccacagcatccagctggccgtgttcgccctgggctacgccatcagagacctgtgccaggccagagactgccagaaccccaacgccttccagccctgggagcagatccagagcaagtgcagcaaggagtgcagccccggccagatgaagaagaccaccagaagccagcacatctgctgctacgagtgccagaactgccccgagaaccactacaccaaccagaccgacatgccccactgcctgctgtgcaacaacaagacccactgggcccccgtgagaagcaccatgtgcttcgagaaggaggtggagtacctgaactggaacgacagcctggccatcctgctgctgatcctgagcctgctgggcatcatcttcgtgctggtggtgggcatcatcttcaccagaaacctgaacacccccgtggtgaagagcagcggcggcctgagagtgtgctacgtgatcctgctgtgccacttcctgaacttcgccagcaccagcttcttcatcggcgagccccaggacttcacctgcaagaccagacagaccatgttcggcgtgagcttcaccctgtgcatcagctgcatcctgaccaagagcctgaagatcctgctggccttcagcttcgaccccaagctgcagaagttcctgaagtgcctgtacagacccatcctgatcatcttcacctgcaccggcatccaggtggtgatctgcaccctgtggctgatcttcgccgcccccaccgtggaggtgaacgtgagcctgcccagagtgatcatcctggagtgcgaggagggcagcatcctggccttcggcaccatgctgggctacatcgccatcctggccttcatctgcttcatcttcgccttcaagggcaagtacgagaactacaacgaggccaagttcatcaccttcggcatgctgatctacttcatcgcctggatcaccttcatccccatctacgccaccaccttcggcaagtacgtgcccgccgtggagatcatcgtgatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccccgccagcctggacagcatgagcggcaacgtgaccatgaccaaccccagcagcagcggcaagagcgccacctggcagaagagcaaggacctgcaggcccaggccttcgcccacatctgcagagagaacgccaccagcgtgagcaagaccctgcccagaaagagaatgagcagcatctag

SEQ ID NO: 18550 - DNA, 2256 bp, Artificial Sequence
  Description of Artificial Sequence: Synthetic coding sequence
atggccttcctgatcatcctgatcacctgcttcgtgatcatcctggccaccagccagccctgccagacccccgacgacttcgtggccgccaccagccccggccacatcatcatcggcggcctgttcgccatccacgagaagatgctgagcagcgaggacagccccagaagaccccagatccaggagtgcgtgggcttcgagatcagcgtgttcctgcagaccctggccatgatccacagcatcgagatgatcaacaacagcaccctgctgcccggcgtgaagctgggctacgagatctacgacacctgcaccgaggtgaccgtggccatggccgccaccctgagattcctgagcaagttcaactgcagcagagagaccgtggagttcaagtgcgactacagcagctacatgcccagagtgaaggccgtgatcggcagcggctacagcgagatcaccatggccgtgagcagaatgctgaacctgcagctgatgccccaggtgggctacgagagcaccgccgagatcctgagcgacaagatcagattccccagcttcctgagaaccgtgcccagcgacttccaccagatcaaggccatggcccacctgatccagaagagcggctggaactggatcggcatcatcaccaccgacgacgactacggcagactggccctgaacaccttcatcatccaggccgaggccaacaacgtgtgcatcgccttcaaggaggtgctgcccgccttcctgagcgacaacaccatcgaggtgagaatcaacagaaccctgaagaagatcatcctggaggcccagctgctgggcgtgctgaagaacgtgaccttcaccgacggctggaacagcttccacttcgacgcccacggcgacctgaacaccggctacgacgtggtgctgtggaaggagatcaacggccacatgaccgtgaccaagatggccgagtacgacctgcagaacgacgtgttcatcatccccgaccaggagaccaagaacgagttcagaaacctgaagcagatccagagcaagtgcagcaaggagtgcagccccggccagatgaagaagaccaccagaagccagcacatctgctgctacgagtgccagaactgccccgagaaccactacaccaaccagaccgacatgccccactgcctgctgtgcaacaacaagacccactgggcccccgtgagaagcaccatgtgcttcgagaaggaggtggagtacctgaactggaacgacagcctggccatcctgctgctgatcctgagcctgctgggcatcatcttcgtgctggtggtgggcatcatcttcaccagaaacctgaacacccccgtggtgaagagcagcggcggcctgagagtgtgctacgtgatcctgctgtgccacttcctgaacttcgccagcaccagcttcttcatcggcgagccccaggacttcacctgcaagaccagacagaccatgttcggcgtgagcttcaccctgtgcatcagctgcatcctgaccaagagcctgaagatcctgctggccttcagcttcgaccccaagctgcagaagttcctgaagtgcctgtacagacccatcctgatcatcttcacctgcaccggcatccaggtggtgatctgcaccctgtggctgatcttcgccgcccccaccgtggaggtgaacgtgagcctgcccagagtgatcatcctggagtgcgaggagggcagcatcctggccttcggcaccatgctgggctacatcgccatcctggccttcatctgcttcatcttcgccttcaagggcaagtacgagaactacaacgaggccaagttcatcaccttcggcatgctgatctacttcatcgcctggatcaccttcatccccatctacgccaccaccttcggcaagtacgtgcccgccgtggagatcatcgtgatcctgatcagcaactacggcatcctgtactgcaccttcatccccaagtgctacgtgatcatctgcaagcaggagatcaacaccaagagcgccttcctgaagatgatctacagctacagcagccacagcgtgagcagcatcgccctgagccccgccagcctggacagcatgagcggcaacgtgaccatgaccaaccccagcagcagcggcaagagcgccacctggcagaagagcaaggacctgcaggcccaggccttcgcccacatctgcagagagaacgccaccagcgtgagcaagaccctgcccagaaagagaatgagcagcatctag

SEQ ID NO: 18551 - DNA, 330 bp, Artificial Sequence
  Description of Artificial Sequence: Synthetic coding sequence
atgaaggaggaggacagcagcttcaagctgtgcgtgcccggcatcgtggccctgcagagcccccccaacaaggccttcagaagcaccgacaccgtgggcttcctggagagcgagctgaagaagctgctgggcatgcagcaggagagcagactgtggaagctgggcagccaggagggcagagagctgctgaccagacccgagatcaccgtggtggagggcgagggctacgaggtgcagagaagactgagacacctgcccagccccatcagcgtggcccagtgcctgctgctggaggagaagggcgagatgggcaactggccccccgagtag

SEQ ID NO: 18552 - DNA, 2886 bp, Artificial Sequence
  Description of Artificial Sequence: Synthetic coding sequence
atgctgctgctgctgctgctggcccccctgttcctgagaccccccggcgccggcggcgtgcagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgagaatctgcagcaagagctacctgaccctggagaacggcaaggtgttcctgaccggcggcgacctgcccgccctggacggcgccagagtggacttcagatgcgaccccgacttccacctggtgggcagcagcagaagcatctgcagccagggccagtggagcacccccaagccccactgccaggtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 18553 - DNA, 2700 bp, Artificial Sequence
  Description of Artificial Sequence: Synthetic coding sequence
atgctgctgctgctgctgctggcccccctgttcctgagaccccccggcgccggcggcgtgcagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 18554 - DNA, 2535 bp, Artificial Sequence
  Description of Artificial Sequence: Synthetic coding sequence
atgggccccggcgcccccttcgccagagtgggctggcccctgcccctgctggtggtgatggccgccggcgtggcccccgtgtgggccagccacagcccccacctgcccagaccccacagcagagtgcccccccaccccagcagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcggcggcagcccccccgccgaccagaccctggtgatcaagaccttcagattcctgagccagaagctgttcatcagcgtgagcgtgctgagcagcctgggcatcgtgctggccgtggtgtgcctgagcttcaacatctacaacagccacgtgagatacatccagaacagccagcccaacctgaacaacctgaccgccgtgggctgcagcctggccctggccgccgtgttccccctgggcctggacggctaccacatcggcagaaaccagttccccttcgtgtgccaggccagactgtggctgctgggcctgggcttcagcctgggctacggcagcatgttcaccaagatctggtgggtgcacaccgtgttcaccaagaaggaggagaagaaggagtggagaaagaccctggagccctggaagctgtacgccaccgtgggcctgctggtgggcatggacgtgctgaccctggccatctggcagatcgtggaccccctgcacagaaccatcgagaccttcgccaaggaggagcccaaggaggacatcgacgtgagcatcctgccccagctggagcactgcagcagcagaaagatgaacacctggctgggcatcttctacggctacaagggcctgctgctgctgctgggcatcttcctggcctacgagaccaagagcgtgagcaccgagaagatcaacgaccacagagccgtgggcatggccatctacaacgtggccgtgctgtgcctgatcaccgcccccgtgaccatgatcctgagcagccagcaggacgccgccttcgccttcgccagcctggccatcgtgttcagcagctacatcaccctggtggtgctgttcgtgcccaagatgagaagactgatcaccagaggcgagtggcagagcgaggcccaggacaccatgaagaccggcagcagcaccaacaacaacgaggaggagaagagcagactgctggagaaggagaacagagagctggagaagatcatcgccgagaaggaggagagagtgagcgagctgagacaccagctgcagagcagacagcagctgagaagcagaagacacccccccaccccccccgagcccagcggcggcctgcccagaggcccccccgagccccccgacagactgagctgcgacggcagcagagtgcacctgctgtacaagtag

SEQ ID NO: 18555 - DNA, 2535 bp, Artificial Sequence; identical to SEQ ID NO: 18554
  Description of Artificial Sequence: Synthetic coding sequence

SEQ ID NO: 18556 - DNA, 1737 bp, Artificial Sequence
  Description of Artificial Sequence: Synthetic coding sequence
atgctgctgctgctgctgctggcccccctgttcctgagaccccccggcgccggcggcgtgcagacccccaacgccaccagcgagggctgccagatcatccaccccccctgggagggcggcatcagatacagaggcctgaccagagaccaggtgaaggccatcaacttcctgcccgtggactacgagatcgagtacgtgtgcagaggcgagagagaggtggtgggccccaaggtgagaaagtgcctggccaacggcagctggaccgacatggacacccccagcagatgcgtgagaatctgcagcaagagctacctgaccctggagaacggcaaggtgttcctgaccggcggcgacctgcccgccctggacggcgccagagtggacttcagatgcgaccccgacttccacctggtgggcagcagcagaagcatctgcagccagggccagtggagcacccccaagccccactgccaggtgaacagaaccccccacagcgagagaagagccgtgtacatcggcgccctgttccccatgagcggcggctggcccggcggccaggcctgccagcccgccgtggagatggccctggaggacgtgaacagcagaagagacatcctgcccgactacgagctgaagctgatccaccacgacagcaagtgcgaccccggccaggccaccaagtacctgtacgagctgctgtacaacgaccccatcaagatcatcctgatgcccggctgcagcagcgtgagcaccctggtggccgaggccgccagaatgtggaacctgatcgtgctgagctacggcagcagcagccccgccctgagcaacagacagagattccccaccttcttcagaacccaccccagcgccaccctgcacaaccccaccagagtgaagctgttcgagaagtggggctggaagaagatcgccaccatccagcagaccaccgaggtgttcaccagcaccctggacgacctggaggagagagtgaaggaggccggcatcgagatcaccttcagacagagcttcttcagcgaccccgccgtgcccgtgaagaacctgaagagacaggacgccagaatcatcgtgggcctgttctacgagaccgaggccagaaaggtgttctgcgaggtgtacaaggagagactgttcggcaagaagtacgtgtggttcctgatcggctggtacgccgacaactggttcaagatctacgaccccagcatcaactgcaccgtggacgagatgaccgaggccgtggagggccacatcaccaccgagatcgtgatgctgaaccccgccaacaccagaagcatcagcaacatgaccagccaggagttcgtggagaagctgaccaagagactgaagagacaccccgaggagaccggcggcttccaggaggcccccctggcctacgacgccatctgggccctggccctggccctgaacaagaccagcggcggcggcggcagaagcggcgtgagactggaggacttcaactacaacaaccagaccatcaccgaccagatctacagagccatgaacagcagcagcttcgagggcgtgagcggccacgtggtgttcgacgccagcggcagcagaatggcctggaccctgatcgagcagctgcagggcggcagctacaagaagatcggctactacgacagcaccaaggacgacctgagctggagcaagaccgacaagtggatcgtgatcagcagaacccacagccccacctag

SEQ ID NO: 18557 - DNA, 1989 bp, Artificial Sequence
  Description of Artificial Sequence: Synthetic coding sequence
atggccgccgagaacgaggccagccaggagagcgccctgggcgcctacagccccgtggactacatgagcatcaccagcttccccagactgcccgaggacgagcccgcccccgccgcccccctgagaggcagaaaggacgaggacgccttcctgggcgaccccgacaccgaccccgacagcttcctgaagagcgccagactgcagagactgcccagcagcagcagcgagatgggcagccaggacggcagccccctgagagagaccagaaaggaccccttcagcgccgccgccgccgagtgcagctgcagacaggacggcctgaccgtgatcgtgaccgcctgcctgaccttcgccaccggcgtgaccgtggccctggtgatgcagatctacttcggcgacccccagatcttccagcagggcgccgtggtgaccgacgccgccagatgcaccagcctgggcatcgaggtgctgagcaagcagggcagcagcgtggacgccgccgtggccgccgccctgtgcctgggcatcgtggccccccacagcagcggcctgggcggcggcggcgtgatgctggtgcacgacatcagaagaaacgagagccacctgatcgacttcagagagagcgcccccggcgccctgagagaggagaccctgcagagaagctgggagaccaagcccggcctgctggtgggcgtgcccggcatggtgaagggcctgcacgaggcccaccagctgtacggcagactgccctggagccaggtgctggccttcgccgccgccgtggcccaggacggcttcaacgtgacccacgacctggccagagccctggccgagcagctgccccccaacatgagcgagagattcagagagaccttcctgcccagcggcagaccccccctgcccggcagcctgctgcacagacccgacctggccgaggtgctggacgtgctgggcaccagcggccccgccgccttctacgccggcggcaacctgaccctggagatggtggccgaggcccagcacgccggcggcgtgatcaccgaggaggacttcagcaactacagcgccctggtggagaagcccgtgtgcggcgtgtacagaggccacctggtgctgagccccccccccccccacaccggccccgccctgatcagcgccctgaacatcctggagggcttcaacctgaccagcctggtgagcagagagcaggccctgcactgggtggccgagaccctgaagatcgccctggccctggccagcagactgggcgaccccgtgtacgacagcaccatcaccgagagcatggacgacatgctgagcaaggtggaggccgcctacctgagaggccacatcaacgacagccaggccgcccccgcccccctgctgcccgtgtacgagctggacggcgcccccaccgccgcccaggtgctgatcatgggccccgacgacttcatcgtggccatggtgagcagcctgaaccagcccttcggcagcggcctgatcacccccagcggcatcctgctgaacagccagatgctggacttcagctggcccaacagaaccgccaaccacagcgcccccagcctggagaacagcgtgcagcccggcaagagacccctgagcttcctgctgcccaccgtggtgagacccgccgagggcctgtgcggcacctacctggccctgggcgccaacggcgccgccagaggcctgagcggcctgacccaggtgctgctgaacgtgctgaccctgaacagaaacctgagcgacagcctggccagaggcagactgcaccccgacctgcagagcaacctgctgcaggtggacagcgagttcaccgaggaggagatcgagttcctggaggccagaggccaccacgtggagaaggtggacgtgctgagctgggtgcacggcagcagaagaaccaacaacttcatcatcgccgtgaaggaccccagaagccccgacgccgccggcgccaccatcctgtag

SEQ ID NO: 18558 - DNA, 1185 bp, Artificial Sequence
  Description of Artificial Sequence: Synthetic coding sequence
atgatcgtgttcatcttcctggccatgggcctgagcctggagaacgagtacaccagccagaccaacaactgcacctacctgagagagcagtgcctgagagacgccaacggctgcaagcacgcctggagagtgatggaggacgcctgcaacgacagcgaccccggcgacccctgcaagatgagaaacagcagctactgcaacctgagcatccagtacctggtggagagcaacttccagttcaaggagtgcctgtgcaccgacgacttctactgcaccgtgaacaagctgctgggcaagaagtgcatcaacaagagcgacaacgtgaaggaggacaagttcaagtggaacctgaccaccagaagccaccacggcttcaagggcatgtggagctgcctggaggtggccgaggcctgcgtgggcgacgtggtgtgcaacgcccagctggccagctacctgaaggcctgcagcgccaacggcaacccctgcgacctgaagcagtgccaggccgccatcagattcttctaccagaacatccccttcaacatcgcccagatgctggccttctgcgactgcgcccagagcgacatcccctgccagcagagcaaggaggccctgcacagcaagacctgcgccgtgaacatggtgcccccccccacctgcctgagcgtgatcagaagctgccagaacgacgagctgtgcagaagacactacagaaccttccagagcaagtgctggcagagagtgaccagaaagtgccacgaggacgagaactgcatcagcaccctgagcaagcaggacctgacctgcagcggcagcgacgactgcaaggccgcctacatcgacatcctgggcaccgtgctgcaggtgcagtgcacctgcagaaccatcacccagagcgaggagagcctgtgcaagatcttccagcacatgctgcacagaaagagctgcttcaactaccccaccctgagcaacgtgaagggcatggccctgtacaccagaaagcacgccaacaagatcaccctgaccggcttccacagccccttcaacggcgaggtgatctacgccgccatgtgcatgaccgtgacctgcggcatcctgctgctggtgatggtgaagctgagaaccagcagaatcagcagcaaggccagagaccccagcagcatccagatccccggcgagctgtag

SEQ ID NO: 18559 - DNA, 1593 bp, Artificial Sequence
  Description of Artificial Sequence: Synthetic coding sequence
atgctgctgtggcccctgctgctgctgctgctgctgctgcccaccctggccctgctgagacagcagagaagccaggacgccagactgagctggctggccggcctgcagcacagagtggcctggggcgccctggtgtgggccgccacctggcagagaagaagactggagcagagcaccctgcacgtgcaccagagccagcagcaggccctgagatggtgcctgcagggcgcccagagaccccactgcagcctgagaagaagcaccgacatcagcaccttcagaaaccacctgcccctgaccaaggccagccagacccagcaggaggacagcggcgagcagcccctgccccccaccagcaaccaggacctgggcgaggccagcctgcaggccaccctgctgggcctggccgccctgaacaaggcctaccccgaggtgctggcccagggcagaaccgccagagtgaccctgaccagcccctggcccagacccctgccctggcccggcaacaccctgggccaggtgggcacccccggcaccaaggaccccagagccctgctgctggacgccctgagaagccccggcctgagagccctggaggccggcaccgccgtggagctgctggacgtgttcctgggcctggagaccgacggcgaggagctggccggcgccatcgccgccggcaaccccggcgcccccctgagagagagagccgccgagctgagagaggccctggagcagggccccagaggcctggccctgagactgtggcccaagctgcaggtggtggtgaccctggacgccggcggccaggccgaggccgtggccgccctgggcgccctgtggtgccagggcctggccttcttcagccccgcctacgccgccagcggcggcgtgctgggcctgaacctgcagcccgagcagccccacggcctgtacctgctgccccccggcgcccccttcatcgagctgctgcccgtgaaggagggcacccaggaggaggccgccagcaccctgctgctggccgaggcccagcagggcaaggagtacgagctggtgctgaccgacagagccagcctgaccagatgcagactgggcgacgtggtgagagtggtgggcgcctacaaccagtgccccgtggtgagattcatctgcagactggaccagaccctgagcgtgagaggcgaggacatcggcgaggacctgttcagcgaggccctgggcagagccgtgggccagtgggccggcgccaagctgctggaccacggctgcgtggagagcagcatcctggacagcagcgccggcagcgccccccactacgaggtgttcgtggccctgagaggcctgagaaacctgagcgaggagaacagagacaagctggaccactgcctgcaggaggccagccccagatacaagagcctgagattctggggcagcgtgggccccgccagagtgcacctggtgggccagggcgccttcagagccctgagagccgccctggccgcctgccccagcagccccttcccccccgccatgcccagagtgctgagacacagacacctggcccagtgcctgcaggagagagtggtgagctag

SEQ ID NO: 18560 - DNA, 1425 bp, Artificial Sequence
  Description of Artificial Sequence: Synthetic coding sequence
atgctgctgtggcccctgctgctgctgctgctgctgctgcccaccctggccctgctgagacagcagagaccccactgcagcctgagaagaagcaccgacatcagcaccttcagaaaccacctgcccctgaccaaggccagccagacccagcaggaggacagcggcgagcagcccctgccccccaccagcaaccaggacctgggcgaggccagcctgcaggccaccctgctgggcctggccgccctgaacaaggcctaccccgaggtgctggcccagggcagaaccgccagagtgaccctgaccagcccctggcccagacccctgccctggcccggcaacaccctgggccaggtgggcacccccggcaccaaggaccccagagccctgctgctggacgccctgagaagccccggcctgagagccctggaggccggcaccgccgtggagctgctggacgtgttcctgggcctggagaccgacggcgaggagctggccggcgccatcgccgccggcaaccccggcgcccccctgagagagagagccgccgagctgagagaggccctggagcagggccccagaggcctggccctgagactgtggcccaagctgcaggtggtggtgaccctggacgccggcggccaggccgaggccgtggccgccctgggcgccctgtggtgccagggcctggccttcttcagccccgcctacgccgccagcggcggcgtgctgggcctgaacctgcagcccgagcagccccacggcctgtacctgctgccccccggcgcccccttcatcgagctgctgcccgtgaaggagggcacccaggaggaggccgccagcaccctgctgctggccgaggcccagcagggcaaggagtacgagctggtgctgaccgacagagccagcctgaccagatgcagactgggcgacgtggtgagagtggtgggcgcctacaaccagtgccccgtggtgagattcatctgcagactggaccagaccctgagcgtgagaggcgaggacatcggcgaggacctgttcagcgaggccctgggcagagccgtgggccagtgggccggcgccaagctgctggaccacggctgcgtggagagcagcatcctggacagcagcgccggcagcgccccccactacgaggtgttcgtggccctgagaggcctgagaaacctgagcgaggagaacagagacaagctggaccactgcctgcaggaggccagccccagatacaagagcctgagattctggggcagcgtgggccccgccagagtgcacctggtgggccagggcgccttcagagccctgagagccgccctggccgcctgccccagcagccccttcccccccgccatgcccagagtgctgagacacagacacctggcccagtgcctgcaggagagagtggtgagctag

SEQ ID NO: 18561 - DNA, 1425 bp, Artificial Sequence
  Description of Artificial Sequence: Synthetic coding sequence
atgctgctgtggcccctgctgctgctgctgctgctgctgcccaccctggccctgctgagacagcagagaagccaggacgccagactgagctggctggccggcctgcagcacagagtggcctggggcgccctggtgtgggccgccacctggcagagaagaagactggagcagagcaccctgcacgtgcaccagagccagcagcaggccctgagatggtgcctgcagggcgcccagagaccccactgcagcctgagaagaagcaccgacatcagcaccttcagaaaccacctgcccctgaccaaggccagccagacccagcaggaggacagcggcgagcagcccctgccccccaccagcaaccaggacctgggcgaggccagcctgcaggccaccctgctgggcctggccgccctgaacaaggcctaccccgaggtgctggcccagggcagaaccgccagagtgaccctgaccagcccctggcccagacccctgccctggcccggcaacaccctgggccaggtgggcacccccggcaccaaggaccccagagccctgctgctggacgccctgagaagccccggcctgagagccctggaggccggcaccgccgtggagctgctggacgtgttcctgggcctggagaccgacggcgaggagctggccggcgccatcgccgccggcaaccccggcgcccccctgagagagagagccgccgagctgagagaggccctggagcagggccccagaggcctggccctgagactgtggcccaagctgcaggtggtggtgaccctggacgccggcggccaggccgaggccgtggccgccctgggcgccctgtggtgccagggcctggccttcttcagccccgcctacgccgccagcggcggcgtgctgggcctgaacctgcagcccgagcagccccacggcctgtacctgctgccccccggcgcccccttcatcgagctgctgcccgtgaaggagggcacccaggaggaggccgccagcaccctgctgctggccgaggcccagcagggcaaggagtacgagctggtgctgaccgacagagccagcctgaccagatgcagactgggcgacgtggtgagagtggtgggcgcctacaaccagtgccccgtggtgagattcatctgcagactggaccagaccctgagcgtgagaggcgaggacatcggcgaggacctgttcagcgaggccctgggcagagccgtgggccagtgggccggcgccaagctgctggaccacggctgcgtggagagcagcatcctggagtggggcagaaccgacagagccgaggacaccagactgggcagctgccccttcaccggcagcatgtgcgcccacggcgtgtacagccagatccccctgagagccctgctgcccaccaccagatgcctgtggagatag

SEQ ID NO: 18562 - DNA, 1476 bp, Artificial Sequence
  Description of Artificial Sequence: Synthetic coding sequence
atgctgctgtggcccctgctgctgctgctgctgctgctgcccaccctggccctgctgagacagcagagaagccaggacgccagactgagctggctggccggcctgcagcacagagtggcctggggcgccctggtgtgggccgccacctggcagagaagaagactggagcagagcaccctgcacgtgcaccagagccagcagcaggccctgagatggtgcctgcagggcgcccagagaccccactgcagcctgagaagaagcaccgacatcagcaccttcagaaaccacctgcccctgaccaaggcctaccccgaggtgctggcccagggcagaaccgccagagtgaccctgaccagcccctggcccagacccctgccctggcccggcaacaccctgggccaggtgggcacccccggcaccaaggaccccagagccctgctgctggacgccctgagaagccccggcctgagagccctggaggccggcaccgccgtggagctgctggacgtgttcctgggcctggagaccgacggcgaggagctggccggcgccatcgccgccggcaaccccggcgcccccctgagagagagagccgccgagctgagagaggccctggagcagggccccagaggcctggccctgagactgtggcccaagctgcaggtggtggtgaccctggacgccggcggccaggccgaggccgtggccgccctgggcgccctgtggtgccagggcctggccttcttcagccccgcctacgccgccagcggcggcgtgctgggcctgaacctgcagcccgagcagccccacggcctgtacctgctgccccccggcgcccccttcatcgagctgctgcccgtgaaggagggcacccaggaggaggccgccagcaccctgctgctggccgaggcccagcagggcaaggagtacgagctggtgctgaccgacagagccagcctgaccagatgcagactgggcgacgtggtgagagtggtgggcgcctacaaccagtgccccgtggtgagattcatctgcagactggaccagaccctgagcgtgagaggcgaggacatcggcgaggacctgttcagcgaggccctgggcagagccgtgggccagtgggccggcgccaagctgctggaccacggctgcgtggagagcagcatcctggacagcagcgccggcagcgccccccactacgaggtgttcgtggccctgagaggcctgagaaacctgagcgaggagaacagagacaagctggaccactgcctgcaggaggccagccccagatacaagagcctgagattctggggcagcgtgggccccgccagagtgcacctggtgggccagggcgccttcagagccctgagagccgccctggccgcctgccccagcagccccttcccccccgccatgcccagagtgctgagacacagacacctggcccagtgcctgcaggagagagtggtgagctag

SEQ ID NO: 18563 - DNA, 1425 bp, Artificial Sequence; identical to SEQ ID NO: 18561
  Description of Artificial Sequence: Synthetic coding sequence

SEQ ID NO: 18564 - DNA, 1593 bp, Artificial Sequence; identical to SEQ ID NO: 18559
  Description of Artificial Sequence: Synthetic coding sequence

SEQ ID NO: 18565 - DNA, 1002 bp, Artificial Sequence
  Description of Artificial Sequence: Synthetic coding sequence
atgcccctgggcctgggcagaagaaagaaggccccccccctggtggagaacgaggaggccgagcccggcagaggcggcctgggcgtgggcgagcccggccccctgggcggcggcggcagcggcggcccccagatgggcctgcccccccccccccccgccctgagacccagactggtgttccacacccagctggcccacggcagccccaccggcagaatcgagggcttcaccaacgtgaaggagctgtacggcaagatcgccgaggccttcagactgcccaccgccgaggtgatgttctgcaccctgaacacccacaaggtggacatggacaagctgctgggcggccagatcggcctggaggacttcatcttcgcccacgtgaagggccagagaaaggaggtggaggtgttcaagagcgaggacgccctgggcctgaccatcaccgacaacggcgccggctacgccttcatcaagagaatcaaggagggcagcgtgatcgaccacatccacctgatcagcgtgggcgacatgatcgaggccatcaacggccagagcctgctgggctgcagacactacgaggtggccagactgctgaaggagctgcccagaggcagaaccttcaccctgaagctgaccgagcccagaaaggccttcgacatgatcagccagagaagcgccggcggcagacccggcagcggcccccagctgggcaccggcagaggcaccctgagactgagaagcagaggccccgccaccgtggaggacctgcccagcgccttcgaggagaaggccatcgagaaggtggacgacctgctggagagctacatgggcatcagagacaccgagctggccgccaccatggtggagctgggcaaggacaagagaaaccccgacgagctggccgaggccctggacgagagactgggcgacttcgccttccccgacgagttcgtgttcgacgtgtggggcgccatcggcgacgccaaggtgggcagatactag

SEQ ID NO: 18566 - DNA, 1002 bp, Artificial Sequence; identical to SEQ ID NO: 18565
  Description of Artificial Sequence: Synthetic coding sequence

SEQ ID NO: 18567 - DNA, 711 bp, Artificial Sequence
  Description of Artificial Sequence: Synthetic coding sequence
atgttctgcaccctgaacacccacaaggtggacatggacaagctgctgggcggccagatcggcctggaggacttcatcttcgcccacgtgaagggccagagaaaggaggtggaggtgttcaagagcgaggacgccctgggcctgaccatcaccgacaacggcgccggctacgccttcatcaagagaatcaaggagggcagcgtgatcgaccacatccacctgatcagcgtgggcgacatgatcgaggccatcaacggccagagcctgctgggctgcagacactacgaggtggccagactgctgaaggagctgcccagaggcagaaccttcaccctgaagctgaccgagcccagaaaggccttcgacatgatcagccagagaagcgccggcggcagacccggcagcggcccccagctgggcaccggcagaggcaccctgagactgagaagcagaggccccgccaccgtggaggacctgcccagcgccttcgaggagaaggccatcgagaaggtggacgacctgctggagagctacatgggcatcagagacaccgagctggccgccaccatggtggagctgggcaaggacaagagaaaccccgacgagctggccgaggccctggacgagagactgggcgacttcgccttccccgacgagttcgtgttcgacgtgtggggcgccatcggcgacgccaaggtgggcagatactag

SEQ ID NO: 18568 - DNA, 711 bp, Artificial Sequence; identical to SEQ ID NO: 18567
  Description of Artificial Sequence: Synthetic coding sequence

SEQ ID NO: 18569 - DNA, 1002 bp, Artificial Sequence; identical to SEQ ID NO: 18565
  Description of Artificial Sequence: Synthetic coding sequence

SEQ ID NO: 18570 - DNA, 762 bp, Artificial Sequence
  Description of Artificial Sequence: Synthetic coding sequence
atggaggccgccagacccttcgccagagagtggagagcccagagcctgcccctggccgtgggcggcgtgctgaagctgagactgtgcgagctgtggctgctgctgctgggcagcagcctgaacgccagattcctgcccgacgaggaggacgtggacttcatcaacgagtacgtgaacctgcacaacgagctgagaggcgacgtgatccccagaggcagcaacctgagattcatgacctgggacgtggccctgagcagaaccgccagagcctggggcaagaagtgcctgttcacccacaacatctacctgcaggacgtgcagatggtgcaccccaagttctacggcatcggcgagaacatgtgggtgggccccgagaacgagttcaccgccagcatcgccatcagaagctggcacgccgagaagaagatgtacaacttcgagaacggcagctgcagcggcgactgcagcaactacatccagctggtgtgggaccacagctacaaggtgggctgcgccgtgaccccctgcagcaagatcggccacatcatccacgccgccatcttcatctgcaactacgcccccggcggcaccctgaccagaagaccctacgagcccggcatcttctgcaccagatgcggcagaagagacaagtgcaccgacttcctgtgcagcaagatcaagaagatcaacatgaagaagatgcacaacggcctggacaagaagaacaagagactgaacaccagcttcctgtggagctgctag

SEQ ID NO: 18571 - DNA, 321 bp, Artificial Sequence
  Description of Artificial Sequence: Synthetic coding sequence
atggaggccgccagacccttcgccagagagtggagagcccagagcctgcccctggccgtgggcggcgtgctgaagctgagactgtgcgagctgtggctgctgctgctgggcagcagcctgaacgccagattcctgcccgacgaggaggacgtggacttcatcaacgagtacgtgaacctgcacaacgagctgagaggcgacgtgatccccagaggcagcaacctgagattcatgctgtggtactgctgcgacagcgacggcagcagattcatcatcggcttccccaacctgagccccagaacccccagcgcccccctgtag

SEQ ID NO: 18572 - DNA, 714 bp, Artificial Sequence
  Description of Artificial Sequence: Synthetic coding sequence
atggtgcaccccaagttctacggcatcggcgagaacatgtgggtgggccccgagaacgagttcaccgccagcatcgccatcagaagctggcacgccgagaagaagatgtacaacttcgagaacggcagctgcagcggcgactgcagcaactacatccagctggtgtgggaccacagctacaaggtgggctgcgccgtgaccccctgcagcaagatcggccacatcatccacgccgccatcttcatctgcaactacgcccccggcggcaccctgaccagaagaccctacgagcccggcatcttctgcaccagatgcggcagaagagacaagtgcaccgacttcctgtgcagcaacgccgacagagaccaggccacctactacagattctggtaccccaagtgggagatgcccagacccgtggtgtgcgaccccctgtgcaccttcatcctgctgctgagaatcctgtgcttcatcctgtgcgtgatcaccgtgctgatcgtgcagagccagttccccaacatcctgctggagcagcagatgatcttcacccccgaggagagcgaggccggcaacgaggaggaggagaaggaggaggagaagaaggagaaggaggagatggagatggagatcatggagatggaggaggagaaggaggagagagaggaggaggaggaggagacccagaaggagaagatggaggaggaggagaagtag

SEQ ID NO: 18573 - DNA, 507 bp, Artificial Sequence
  Description of Artificial Sequence: Synthetic coding sequence
atggaggccgccagacccttcgccagagagtggagagcccagagcctgcccctggccgtgggcggcgtgctgaagctgagactgtgcgagctgtggctgctgctgctgggcagcagcctgaacgccagattcctgcccgacgaggaggacgtggacttcatcaacgagtacgtgaacctgcacaacgagctgagaggcgacgtgatccccagaggcagcaacctgagattcatgacctgggacgtggccctgagcagaaccgccagagcctggggcaagaagtgcctgttcacccacaacatctacctgcaggacgtgcagatggtgcaccccaagttctacggcatcggcgagaacatgtgggtgggccccgagaacgagttcaccgccagcatcgccatcagaagctggcacgccgagaagaagatgtacaacttcgagaacggcagctgcagcggcgactgcagcaactacatccagagaaacaccgacgagaagaccctgtag

SEQ ID NO: 18574 - DNA, 840 bp, Artificial Sequence
  Description of Artificial Sequence: Synthetic coding sequence
atgctgatcaccatgatcctgcacagagccagaaccaagacctgggacgtggccctgagcagaaccgccagagcctggggcaagaagtgcctgttcacccacaacatctacctgcaggacgtgcagatggtgcaccccaagttctacggcatcggcgagaacatgtgggtgggccccgagaacgagttcaccgccagcatcgccatcagaagctggcacgccgagaagaagatgtacaacttcgagaacggcagctgcagcggcgactgcagcaactacatccagctggtgtgggaccacagctacaaggtgggctgcgccgtgaccccctgcagcaagatcggccacatcatccacgccgccatcttcatctgcaactacgcccccggcggcaccctgaccagaagaccctacgagcccggcatcttctgcaccagatgcggcagaagagacaagtgcaccgacttcctgtgcagcaacgccgacagagaccaggccacctactacagattctggtaccccaagtgggagatgcccagacccgtggtgtgcgaccccctgtgcaccttcatcctgctgctgagaatcctgtgcttcatcctgtgcgtgatcaccgtgctgatcgtgcagagccagttccccaacatcctgctggagcagcagatgatcttcacccccgaggagagcgaggccggcaacgaggaggaggagaaggaggaggagaagaaggagaaggaggagatggagatggagatcatggagatggaggaggagaaggaggagagagaggaggaggaggaggagacccagaaggagaagatggaggaggaggagaagtag

SEQ ID NO: 18575 - DNA, 1035 bp, Artificial Sequence
  Description of Artificial Sequence: Synthetic coding sequence
atggaggccgccagacccttcgccagagagtggagagcccagagcctgcccctggccgtgggcggcgtgctgaagctgagactgtgcgagctgtggctgctgctgctgggcagcagcctgaacgccagattcctgcccgacgaggaggacgtggacttcatcaacgagtacgtgaacctgcacaacgagctgagaggcgacgtgatccccagaggcagcaacctgagattcatgacctgggacgtggccctgagcagaaccgccagagcctggggcaagaagtgcctgttcacccacaacatctacctgcaggacgtgcagatggtgcaccccaagttctacggcatcggcgagaacatgtgggtgggccccgagaacgagttcaccgccagcatcgccatcagaagctggcacgccgagaagaagatgtacaacttcgagaacggcagctgcagcggcgactgcagcaactacatccagctggtgtgggaccacagctacaaggtgggctgcgccgtgaccccctgcagcaagatcggccacatcatccacgccgccatcttcatctgcaactacgcccccggcggcaccctgaccagaagaccctacgagcccggcatcttctgcaccagatgcggcagaagagacaagtgcaccgacttcctgtgcagcaacgccgacagagaccaggccacctactacagattctggtaccccaagtgggagatgcccagacccgtggtgtgcgaccccctgtgcaccttcatcctgctgctgagaatcctgtgcttcatcctgtgcgtgatcaccgtgctgatcgtgcagagccagttccccaacatcctgctggagcagcagatgatcttcacccccgaggagagcgaggccggcaacgaggaggaggagaaggaggaggagaagaaggagaaggaggagatggagatggagatcatggagatggaggaggagaaggaggagagagaggaggaggaggaggagacccagaaggagaagatggaggaggaggagaagtag

SEQ ID NO: 18576 - DNA, 2544 bp, Artificial Sequence
  Description of Artificial Sequence: Synthetic coding sequence
atggccaagcccctgaccgaccaggagaagagaagacagatcagcatcagaggcatcgtgggcgtggagaacgtggccgagctgaagaagagcttcaacagacacctgcacttcaccctggtgaaggacagaaacgtggccaccaccagagactactacttcgccctggcccacaccgtgagagaccacctggtgggcagatggatcagaacccagcagcactactacgacaagtgccccaagagagtgtactacctgagcctggagttctacatgggcagaaccctgcagaacaccatgatcaacctgggcctgcagaacgcctgcgacgaggccatctaccagctgggcctggacatcgaggagctggaggagatcgaggaggacgccggcctgggcaacggcggcctgggcagactggccgcctgcttcctggacagcatggccaccctgggcctggccgcctacggctacggcatcagatacgagtacggcatcttcaaccagaagatcagagacggctggcaggtggaggaggccgacgactggctgagatacggcaacccctgggagaagagcagacccgagttcatgctgcccgtgcacttctacggcaaggtggagcacaccaacaccggcaccaagtggatcgacacccaggtggtgctggccctgccctacgacacccccgtgcccggctacatgaacaacaccgtgaacaccatgagactgtggagcgccagagcccccaacgacttcaacctgagagacttcaacgtgggcgactacatccaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaaggccagcaagttcggcagcaccagaggcgccggcaccgtgttcgacgccttccccgaccaggtggccatccagctgaacgacacccaccccgccctggccatccccgagctgatgagaatcttcgtggacatcgagaagctgccctggagcaaggcctgggagctgacccagaagaccttcgcctacaccaaccacaccgtgctgcccgaggccctggagagatggcccgtggacctggtggagaagctgctgcccagacacctggagatcatctacgagatcaaccagaagcacctggacagaatcgtggccctgttccccaaggacgtggacagactgagaagaatgagcctgatcgaggaggagggcagcaagagaatcaacatggcccacctgtgcatcgtgggcagccacgccgtgaacggcgtggccaagatccacagcgacatcgtgaagaccaaggtgttcaaggacttcagcgagctggagcccgacaagttccagaacaagaccaacggcatcacccccagaagatggctgctgctgtgcaaccccggcctggccgagctgatcgccgagaagatcggcgaggactacgtgaaggacctgagccagctgaccaagctgcacagcttcctgggcgacgacgtgttcctgagagagctggccaaggtgaagcaggagaacaagctgaagttcagccagttcctggagaccgagtacaaggtgaagatcaaccccagcagcatgttcgacgtgcaggtgaagagaatccacgagtacaagagacagctgctgaactgcctgcacgtgatcaccatgtacaacagaatcaagaaggaccccaagaagctgttcgtgcccagaaccgtgatcatcggcggcaaggccgcccccggctaccacatggccaagatgatcatcaagctgatcaccagcgtggccgacgtggtgaacaacgaccccatggtgggcagcaagctgaaggtgatcttcctggagaactacagagtgagcctggccgagaaggtgatccccgccaccgacctgagcgagcagatcagcaccgccggcaccgaggccagcggcaccggcaacatgaagttcatgctgaacggcgccctgaccatcggcaccatggacggcgccaacgtggagatggccgaggaggccggcgaggagaacctgttcatcttcggcatgagaatcgacgacgtggccgccctggacaagaagggctacgaggccaaggagtactacgaggccctgcccgagctgaagctggtgatcgaccagatcgacaacggcttcttcagccccaagcagcccgacctgttcaaggacatcatcaacatgctgttctaccacgacagattcaaggtgttcgccgactacgaggcctacgtgaagtgccaggacaaggtgagccagctgtacatgaaccccaaggcctggaacaccatggtgctgaagaacatcgccgccagcggcaagttcagcagcgacagaaccatcaaggagtacgcccagaacatctggaacgtggagcccagcgacctgaagatcagcctgagcaacgagagcaacaaggtgaacggcaactag

SEQ ID NO: 18577 - DNA, 492 bp, Artificial Sequence
  Description of Artificial Sequence: Synthetic coding sequence
atgaagcccgacgagacccccatgttcgaccccagcctgctgaaggaggtggactggagccagaacaccgccaccttcagccccgccatcagccccacccaccccggcgagggcctggtgctgagacccctgtgcaccgccgacctgaacagaggcttcttcaaggtgctgggccagctgaccgagaccggcgtggtgagccccgagcagttcatgaagagcttcgagcacatgaagaagagcggcgactactacgtgaccgtggtggaggacgtgaccctgggccagatcgtggccaccgccaccctgatcatcgagcacaagttcatccacagctgcgccaagagaggcagagtggaggacgtggtggtgagcgacgagtgcagaggcaagcagctgggcaagctgctgctgagcaccctgaccctgctgagcaagaagctgaactgctacaagatcaccctggagtgcctgccccagaacgtgggctag

SEQ ID NO: 18578 - DNA, 1362 bp, Artificial Sequence
  Description of Artificial Sequence: Synthetic coding sequence
atgaagatcttcaagtgctacttcaagcacaccctgcagcagaaggtgttcatcctgttcctgaccctgtggctgctgagcctgctgaagctgctgaacgtgagaagactgttcccccagaaggacatctacctggtggagtacagcctgagcaccagccccttcgtgagaaacagatacacccacgtgaaggacgaggtgagatacgaggtgaactgcagcggcatctacgagcaggagcccctggagatcggcaagagcctggagatcagaagaagagacatcatcgacctggaggacgacgacgtggtggccatgaccagcgactgcgacatctaccagaccctgagaggctacgcccagaagctggtgagcaaggaggagaagagcttccccatcgcctacagcctggtggtgcacaaggacgccatcatggtggagagactgatccacgccatctacaaccagcacaacatctactgcatccactacgacagaaaggcccccgacaccttcaaggtggccatgaacaacctggccaagtgcttcagcaacatcttcatcgccagcaagctggaggccgtggagtacgcccacatcagcagactgcaggccgacctgaactgcctgagcgacctgctgaagagcagcatccagtggaagtacgtgatcaacctgtgcggccaggacttccccctgaagagcaacttcgagctggtgagcgagctgaagaagctgaacggcgccaacatgctggagaccgtgaagccccccaacagcaagctggagagattcacctaccaccacgagctgagaagagtgccctacgagtacgtgaagctgcccatcagaaccaacatcagcaaggaggcccccccccacaacatccagatcttcgtgggcagcgcctacttcgtgctgagccaggccttcgtgaagtacatcttcaacaacagcatcgtgcaggacttcttcgcctggagcaaggacacctacagccccgacgagcacttctgggccaccctgatcagagtgcccggcatccccggcgagatcagcagaagcgcccaggacgtgagcgacctgcagagcaagaccagactggtgaagtggaactactacgagggcttcttctaccccagctgcaccggcagccacctgagaagcgtgtgcatctacggcgccgccgagctgagatggctgatcaaggacggccactggttcgccaacaagttcgacagcaaggtggaccccatcctgatcaagtgcctggccgagaagctggaggagcagcagagagactggatcaccctgcccagcgagaagctgttcatggacagaaacctgaccaccaccagctag

SEQ ID NO: 18579 - DNA, 927 bp, Artificial Sequence
  Description of Artificial Sequence: Synthetic coding sequence
atgttcgtgcagctgctgagagccatctacgtgccccagaacgtgtactgcatccacgtggacgagaaggcccccatgaagtacaagaccgccgtgcagaccctggtgaactgcttcgagaacgtgttcatcagcagcaagaccgagaaggtggcctacgccggcttcaccagactgcaggccgacatcaactgcatgaaggtgctggtgcacagcaagttccagtggaactacgtgatcaacctgtgcggccaggacttccccatcaagaccaacagagagatcatccactacatcagaagcaagtggagcgacaagaacatcacccccggcgtgatccagcccctgcacatcaagagcaagaccagccagagccacctggagttcgtgcccaagggcagcatctacgccccccccaacaacagattcaaggacaagcccccccacaacctgaccatctacttcggcagcgcctactacgtgctgaccagaaagttcgtggagttcatcctgaccgacatccacgccaaggacatgctgcagtggagcaaggacatcagaagccccgagcagcactactgggtgaccctgaacagactgaaggacgcccccggcgccacccccaacgccggctgggagggcaacgtgagagccatcaagagaaagagcgaggagggcaacgtgcacgacggctgcaagggcagatacgtggaggacatctgcgtgtacggccccggcgacctgccctggctgatccagagccccagcctgttcgccaacaagttcgagcccagcaccgaccccctggtggtgacctgcctggagagaagacacagactgcaggtgctgagacaggccgaggtgcccatcgagccccactggcacttccagcagcagagccacttcaacatgagactgaacagatag

SEQ ID NO: 18580 - DNA, 519 bp, Artificial Sequence
  Description of Artificial Sequence: Synthetic coding sequence
atgagagactgctgcggcatggtgagcagcggcagcctgagcagcctgaaggccgccgagagaacccccggcgccctgttcttcagcagcagcacccccggcagatactacaactacgacagcagcagcagaccccagagcagaagcgtgatgagcgaccagtgcgccggccagtggttcctgaaggcctgcggcctgggcgagggcgacaccgaggtgttccccacccagcacgtggtgagagccctgcagaccatcttcgagctgaacgtgcaggccttcgccggcggcgccatgggcgccgtgaacggcatgcagccccacggcgtgcccgacaagagcagcgtgcagagcgacgaggtgtgggtgggcgtggtgtacggcctggccgccaccatgatccaggaggtgatgcacagcttcagccacctgagcaccatctgcatcctggcccagaagaccagcagcaccaccaagttcctgcagggcatcacccagtgccacctggtgagactgtag

SEQ ID NO: 18581 - DNA, 2634 bp, Artificial Sequence
  Description of Artificial Sequence: Synthetic coding sequence
atgggcacccaggaccccggcaacatgggcaccggcgtgcccgccagcgagcagatcagctgcgccaaggaggacccccaggtgtactgccccgaggagaccggcggcaccaaggacgtgcaggtgaccgactgcaagagccccgaggacagcagaccccccaaggagaccgactgctgcaaccccgaggacagcggccagctgatggtgagctacgagggcaaggccatgggctaccaggtgccccccttcggctggagaatctgcctggcccacgagttcaccgagaagagaaagcccttccaggccaacaacgtgagcctgagcaacatgatcaagcacatcggcatgggcctgagatacctgcagtggtggtacagaaagacccacgtggagaagaagacccccttcatcgacatgatcaacagcgtgcccctgagacagatctacggctgccccctgggcggcatcggcggcggcaccatcaccagaggctggagaggccagttctgcagatggcagctgaaccccggcatgtaccagcacagaaccgtgatcgccgaccagttcaccgtgtgcctgagaagagagggccagaccgtgtaccagcaggtgctgagcctggagagacccagcgtgctgagaagctggaactggggcctgtgcggctacttcgccttctaccacgccctgtaccccagagcctggaccgtgtaccagctgcccggccagaacgtgaccctgacctgcagacagatcacccccatcctgccccacgactaccaggacagcagcctgcccgtgggcgtgttcgtgtgggacgtggagaacgagggcgacgaggccctggacgtgagcatcatgttcagcatgagaaacggcctgggcggcggcgacgacgcccccggcggcctgtggaacgagcccttctgcctggagagaagcggcgagaccgtgagaggcctgctgctgcaccaccccaccctgcccaacccctacaccatggccgtggccgccagagtgaccgccgccaccaccgtgacccacatcaccgccttcgaccccgacagcaccggccagcaggtgtggcaggacctgctgcaggacggccagctggacagccccaccggccagagcacccccacccagaagggcgtgggcatcgccggcgccgtgtgcgtgagcagcaagctgagacccagaggccagtgcagactggagttcagcctggcctgggacatgcccagaatcatgttcggcgccaagggccaggtgcactacagaagatacaccagattcttcggccaggacggcgacgccgcccccgccctgagccactacgccctgtgcagatacgccgagtgggaggagagaatcagcgcctggcagagccccgtgctggacgacagaagcctgcccgcctggtacaagagcgccctgttcaacgagctgtacttcctggccgacggcggcaccgtgtggctggaggtgctggaggacagcctgcccgaggagctgggcagaaacatgtgccacctgagacccaccctgagagactacggcagattcggctacctggagggccaggagtacagaatgtacaacacctacgacgtgcacttctacgccagcttcgccctgatcatgctgtggcccaagctggagctgagcctgcagtacgacatggccctggccaccctgagagaggacctgaccagaagaagatacctgatgagcggcgtgatggcccccgtgaagagaagaaacgtgatcccccacgacatcggcgaccccgacgacgagccctggctgagagtgaacgcctacctgatccacgacaccgccgactggaaggacctgaacctgaagttcgtgctgcaggtgtacagagactactacctgaccggcgaccagaacttcctgaaggacatgtggcccgtgtgcctggccgtgatggagagcgagatgaagttcgacaaggaccacgacggcctgatcgagaacggcggctacgccgaccagacctacgacggctgggtgaccaccggccccagcgcctactgcggcggcctgtggctggccgccgtggccgtgatggtgcagatggccgccctgtgcggcgcccaggacatccaggacaagttcagcagcatcctgagcagaggccaggaggcctacgagagactgctgtggaacggcagatactacaactacgacagcagcagcagaccccagagcagaagcgtgatgagcgaccagtgcgccggccagtggttcctgaaggcctgcggcctgggcgagggcgacaccgaggtgttccccacccagcacgtggtgagagccctgcagaccatcttcgagctgaacgtgcaggccttcgccggcggcgccatgggcgccgtgaacggcatgcagccccacggcgtgcccgacaagagcagcgtgcagagcgacgaggtgtgggtgggcgtggtgtacggcctggccgccaccatgatccaggagctgctgcccagcggcttctgcctgtgggtgatcgtgatcagcagcacctgctgggagctgctggagggcaaggacagcaccgccagcatctaccccgtggaggtggccctgcagagagtgcccagctag

SEQ ID NO: 18582 - DNA, 2784 bp, Artificial Sequence
  Description of Artificial Sequence: Synthetic coding sequence
atgggcacccaggaccccggcaacatgggcaccggcgtgcccgccagcgagcagatcagctgcgccaaggaggacccccaggtgtactgccccgaggagaccggcggcaccaaggacgtgcaggtgaccgactgcaagagccccgaggacagcagaccccccaaggagaccgactgctgcaaccccgaggacagcggccagctgatggtgagctacgagggcaaggccatgggctaccaggtgccccccttcggctggagaatctgcctggcccacgagttcaccgagaagagaaagcccttccaggccaacaacgtgagcctgagcaacatgatcaagcacatcggcatgggcctgagatacctgcagtggtggtacagaaagacccacgtggagaagaagacccccttcatcgacatgatcaacagcgtgcccctgagacagatctacggctgccccctgggcggcatcggcggcggcaccatcaccagaggctggagaggccagttctgcagatggcagctgaaccccggcatgtaccagcacagaaccgtgatcgccgaccagttcaccgtgtgcctgagaagagagggccagaccgtgtaccagcaggtgctgagcctggagagacccagcgtgctgagaagctggaactggggcctgtgcggctacttcgccttctaccacgccctgtaccccagagcctggaccgtgtaccagctgcccggccagaacgtgaccctgacctgcagacagatcacccccatcctgccccacgactaccaggacagcagcctgcccgtgggcgtgttcgtgtgggacgtggagaacgagggcgacgaggccctggacgtgagcatcatgttcagcatgagaaacggcctgggcggcggcgacgacgcccccggcggcctgtggaacgagcccttctgcctggagagaagcggcgagaccgtgagaggcctgctgctgcaccaccccaccctgcccaacccctacaccatggccgtggccgccagagtgaccgccgccaccaccgtgacccacatcaccgccttcgaccccgacagcaccggccagcaggtgtggcaggacctgctgcaggacggccagctggacagccccaccggccagagcacccccacccagaagggcgtgggcatcgccggcgccgtgtgcgtgagcagcaagctgagacccagaggccagtgcagactggagttcagcctggcctgggacatgcccagaatcatgttcggcgccaagggccaggtgcactacagaagatacaccagattcttcggccaggacggcgacgccgcccccgccctgagccactacgccctgtgcagatacgccgagtgggaggagagaatcagcgcctggcagagccccgtgctggacgacagaagcctgcccgcctggtacaagagcgccctgttcaacgagctgtacttcctggccgacggcggcaccgtgtggctggaggtgctggaggacagcctgcccgaggagctgggcagaaacatgtgccacctgagacccaccctgagagactacggcagattcggctacctggagggccaggagtacagaatgtacaacacctacgacgtgcacttctacgccagcttcgccctgatcatgctgtggcccaagctggagctgagcctgcagtacgacatggccctggccaccctgagagaggacctgaccagaagaagatacctgatgagcggcgtgatggcccccgtgaagagaagaaacgtgatcccccacgacatcggcgaccccgacgacgagccctggctgagagtgaacgcctacctgatccacgacaccgccgactggaaggacctgaacctgaagttcgtgctgcaggtgtacagagactactacctgaccggcgaccagaacttcctgaaggacatgtggcccgtgtgcctggccgtgatggagagcgagatgaagttcgacaaggaccacgacggcctgatcgagaacggcggctacgccgaccagacctacgacggctgggtgaccaccggccccagcgcctactgcggcggcctgtggctggccgccgtggccgtgatggtgcagatggccgccctgtgcggcgcccaggacatccaggacaagttcagcagcatcctgagcagaggccaggaggcctacgagagactgctgtggaacggcagatactacaactacgacagcagcagcagaccccagagcagaagcgtgatgagcgaccagtgcgccggccagtggttcctgaaggcctgcggcctgggcgagggcgacaccgaggtgttccccacccagcacgtggtgagagccctgcagaccatcttcgagctgaacgtgcaggccttcgccggcggcgccatgggcgccgtgaacggcatgcagccccacggcgtgcccgacaagagcagcgtgcagagcgacgaggtgtgggtgggcgtggtgtacggcctggccgccaccatgatccaggagggcctgacctgggagggcttccagaccgccgagggctgctacagaaccgtgtgggagagactgggcctggccttccagacccccgaggcctactgccagcagagagtgttcagaagcctggcctacatgagacccctgagcatctgggccatgcagctggccctgcagcagcagcagcacaagaaggccagctggcccaaggtgaagcagggcaccggcctgagaaccggccccatgttcggccccaaggaggccatggccaacctgagccccgagtag

SEQ ID NO: 18583 - DNA, 2802 bp, Artificial Sequence
  Description of Artificial Sequence: Synthetic coding sequence
atgggcacccaggaccccggcaacatgggcaccggcgtgcccgccagcgagcagatcagctgcgccaaggaggacccccaggtgtactgccccgaggagaccggcggcaccaaggacgtgcaggtgaccgactgcaagagccccgaggacagcagaccccccaaggagaccgactgctgcaaccccgaggacagcggccagctgatggtgagctacgagggcaaggccatgggctaccaggtgccccccttcggctggagaatctgcctggcccacgagttcaccgagaagagaaagcccttccaggccaacaacgtgagcctgagcaacatgatcaagcacatcggcatgggcctgagatacctgcagtggtggtacagaaagacccacgtggagaagaagacccccttcatcgacatgatcaacagcgtgcccctgagacagatctacggctgccccctgggcggcatcggcggcggcaccatcaccagaggctggagaggccagttctgcagatggcagctgaaccccggcatgtaccagcacagaaccgtgatcgccgaccagcccatctgccccctgaagttcaccgtgtgcctgagaagagagggccagaccgtgtaccagcaggtgctgagcctggagagacccagcgtgctgagaagctggaactggggcctgtgcggctacttcgccttctaccacgccctgtaccccagagcctggaccgtgtaccagctgcccggccagaacgtgaccctgacctgcagacagatcacccccatcctgccccacgactaccaggacagcagcctgcccgtgggcgtgttcgtgtgggacgtggagaacgagggcgacgaggccctggacgtgagcatcatgttcagcatgagaaacggcctgggcggcggcgacgacgcccccggcggcctgtggaacgagcccttctgcctggagagaagcggcgagaccgtgagaggcctgctgctgcaccaccccaccctgcccaacccctacaccatggccgtggccgccagagtgaccgccgccaccaccgtgacccacatcaccgccttcgaccccgacagcaccggccagcaggtgtggcaggacctgctgcaggacggccagctggacagccccaccggccagagcacccccacccagaagggcgtgggcatcgccggcgccgtgtgcgtgagcagcaagctgagacccagaggccagtgcagactggagttcagcctggcctgggacatgcccagaatcatgttcggcgccaagggccaggtgcactacagaagatacaccagattcttcggccaggacggcgacgccgcccccgccctgagccactacgccctgtgcagatacgccgagtgggaggagagaatcagcgcctggcagagccccgtgctggacgacagaagcctgcccgcctggtacaagagcgccctgttcaacgagctgtacttcctggccgacggcggcaccgtgtggctggaggtgctggaggacagcctgcccgaggagctgggcagaaacatgtgccacctgagacccaccctgagagactacggcagattcggctacctggagggccaggagtacagaatgtacaacacctacgacgtgcacttctacgccagcttcgccctgatcatgctgtggcccaagctggagctgagcctgcagtacgacatggccctggccaccctgagagaggacctgaccagaagaagatacctgatgagcggcgtgatggcccccgtgaagagaagaaacgtgatcccccacgacatcggcgaccccgacgacgagccctggctgagagtgaacgcctacctgatccacgacaccgccgactggaaggacctgaacctgaagttcgtgctgcaggtgtacagagactactacctgaccggcgaccagaacttcctgaaggacatgtggcccgtgtgcctggccgtgatggagagcgagatgaagttcgacaaggaccacgacggcctgatcgagaacggcggctacgccgaccagacctacgacggctgggtgaccaccggccccagcgcctactgcggcggcctgtggctggccgccgtggccgtgatggtgcagatggccgccctgtgcggcgcccaggacatccaggacaagttcagcagcatcctgagcagaggccaggaggcctacgagagactgctgtggaacggcagatactacaactacgacagcagcagcagaccccagagcagaagcgtgatgagcgaccagtgcgccggccagtggttcctgaaggcctgcggcctgggcgagggcgacaccgaggtgttccccacccagcacgtggtgagagccctgcagaccatcttcgagctgaacgtgcaggccttcgccggcggcgccatgggcgccgtgaacggcatgcagccccacggcgtgcccgacaagagcagcgtgcagagcgacgaggtgtgggtgggcgtggtgtacggcctggccgccaccatgatccaggagggcctgacctgggagggcttccagaccgccgagggctgctacagaaccgtgtgggagagactgggcctggccttccagacccccgaggcctactgccagcagagagtgttcagaagcctggcctacatgagacccctgagcatctgggccatgcagctggccctgcagcagcagcagcacaagaaggccagctggcccaaggtgaagcagggcaccggcctgagaaccggccccatgttcggccccaaggaggccatggccaacctgagccccgagtag

SEQ ID NO: 18584 - DNA, 3636 bp, Artificial Sequence
  Description of Artificial Sequence: Synthetic coding sequence
atggccaccaccgccacccccgccaccaaccagggctggcccgaggacttcggcttcagactgggcggcagcggcccctgcttcgtgctggaggtggccaagggcagcagcgcccacgccggcggcctgagacccggcgaccagatcctggaggtggagggcctggccgtgggcggcctgagcagagagagactggtgagactggccagaagatgccccagagtgccccccagcctgggcgtgctgcccgcccccgacggcggccccggccccggcagcggccccgccgcccccaccaccgtgctgagagcccccagatgcggcagaggcctggccctgggcagagagctgctgagactggccggcagaaagagacccgacgccgtgcacagagagagaagaagaaaggcccaggagttcagcagaaaggtggacgagatcctgggcgaccagcccaccgccaaggagcaggtgttcgccgccctgaagcagttcgccgccgagcagagagtggacgacctggtgtggaccctgaccctggccctgcccagagaggcctgcggccccctgctggacaacctgagaatcttcatccccaagaagcacagagccagattcgacgaggtggtgagccagggcctgctgggcaagctgtgcagagccagaagagcccagggcgcccagagactgagaagaagcagaagcgaggagagacccgagagactgctggtgagcaccagagccagcgccccccccagaagacccgacgagcccccccccagaagagccagcctgctggtgggcggcctggccggccccggcggcgccagaagaaccgtgagagtgtacaagggcaacaagagcttcggcttcaccctgagaggccacggccccgtgtggatcgagagcgtgctgcccggcagccccgccgacaacgccgccctgaagagcggcgacagaatcctgttcctgaacggcctggacatgagaaactgcagccacgacaaggtggtgagcatgctgcagggcagcggcgccatgcccaccctggtggtggaggagggcctggtgcccttcgccagcgacagcgacagcctggacagccccaaccccagcagcgccctgaccagcctgcagtgggtggccgagatcctgcccagcagcatcagagtgcagggcagaaccttcagccagcagctggagcacctgctgaccccccccgagagatacggcgtgtgcagagccctggagagcttcttccagcacagaaacatcgacaccctgatcgtggacgtgtaccccgtgctggacacccccgccaagcaggtgctgtggcagttcatctaccagctgctgacctacgaggagcaggagctgtgccaggagaagatcgcctgcttcctgggctacaccgccatgaccgccgagcccgagcccgagctggacctggagagcgagcccacccccgagccccagcccagaagcagcctgagagccagcagcatgtgcagaagaagcctgagaagccagggcctggaggccggcctgagctgcggccccagcgagtgccccgagatgcccctgcccctgatccccggcgagagacaggccggcgacggcaccagcctgcccgagacccccaaccccaagatgatgagcgccgtgtacgccgagctggagagcagactgaacagcagcttcaagggcaagatgggcaccgtgagcaagagcagagccagcccccccggccccagccccgccgtgaccaccggccccagaaccctgagcggcgtgagctggcccagcgagagactgctgcccagcccctgctaccaccccctgtgcagcggcggcctggccagccccagcagcagcgagagccacccctacgccagcctggacagcagcagagcccccagcccccagcccggccccggccccatctgccccgacagcccccccagccccgaccccaccagaccccccagcagaagaaagctgttcaccttcagccaccccgtgagaagcagagacaccgacagattcctggacgtgctgagcgagcagctgggccccagagtgaccatcgtggacgacttcctgacccccgagaacgactacgaggagatgagcttccacgacgaccagggcagcttcgtgaccaacgagagaagcagcgccagcgactgcatcagcagcagcgaggagggcagcagcctgacctacagcagcatcagcgaccacatcccccccccccccctgagcccccccccccccccccccctgcccttccacgacgccaagcccagcagcagaagcagcgacggcagcagaggccccgcccaggccctggccaagcccctgacccagctgagccaccccgtgcccccccccccccccccccccctgcccccccccgtgccctgcgccccccccatgctgagcagaggcctgggccacagaagaagcgagaccagccacatgagcgtgaagagactgagatgggagcaggtggagaacagcgagggcaccatctggggccagctgggcgaggacagcgactacgacaagctgagcgacatggtgaagtacctggacctggagctgcacttcggcacccagaagcccgccaagcccgtgcccggccccgagcccttcagaaagaaggaggtggtggagatcctgagccacaagaaggcctacaacaccagcatcctgctggcccacctgaagctgagccccgccgagctgagacaggtgctgatgagcatggagcccagaagactggagcccgcccacctggcccagctgctgctgttcgcccccgacgccgacgaggagcagagataccaggccttcagagaggcccccggcagactgagcgagcccgaccagttcgtgctgcagatgctgagcgtgcccgagtacaagaccagactgagaagcctgcacttccaggccaccctgcaggagaagaccgaggagatcagaggcagcctggagtgcctgagacaggccagcctggagctgaagaacagcagaaagctggccaagatcctggagttcgtgctggccatgggcaactacctgaacgacggccagcccaagaccaacaagaccaccggcttcaagatcaacttcctgaccgagctgaacagcaccaagaccgtggacggcaagagcaccttcctgcacatcctggccaagagcctgagccagcacttccccgagctgctgggcttcgcccaggacctgcccaccgtgcccctggccgccaaggtgaaccagagagccctgaccagcgacctggccgacctgcacggcaccatcagcgagatccaggacgcctgccagagcatcagccccagcagcgaggacaagttcgccatggtgatgagcagcttcctggagaccgcccagcccgccctgagagccctggacggcctgcagagagaggccatggaggagctgggcaaggccctggccttcttcggcgaggacagcaaggccaccaccagcgaggccttcttcggcatcttcgccgagttcatgagcaagttcgagagagccctgagcgacctgcaggccggcgagggcctgagaagcagcggcatggtgagccccctggcctggtag

SEQ ID NO: 18585 - DNA, 1197 bp, Artificial Sequence
  Description of Artificial Sequence: Synthetic coding sequence
atgcacaccgtggccaccagcggccccaacgccagctggggcgcccccgccaacgccagcggctgccccggctgcggcgccaacgccagcgacggccccgtgcccagccccagagccgtggacgcctggctggtgcccctgttcttcgccgccctgatgctgctgggcctggtgggcaacagcctggtgatctacgtgatctgcagacacaagcccatgagaaccgtgaccaacttctacatcgccaacctggccgccaccgacgtgaccttcctgctgtgctgcgtgcccttcaccgccctgctgtaccccctgcccggctgggtgctgggcgacttcatgtgcaagttcgtgaactacatccagcaggtgagcgtgcaggccacctgcgccaccctgaccgccatgagcgtggacagatggtacgtgaccgtgttccccctgagagccctgcacagaagaacccccagactggccctggccgtgagcctgagcatctgggtgggcagcgccgccgtgagcgcccccgtgctggccctgcacagactgagccccggccccagagcctactgcagcgaggccttccccagcagagccctggagagagccttcgccctgtacaacctgctggccctgtacctgctgcccctgctggccacctgcgcctgctacgccgccatgctgagacacctgggcagagtggccgtgagacccgcccccgccgacagcgccctgcagggccaggtgctggccgagagagccggcgccgtgagagccaaggtgagcagactggtggccgccgtggtgctgctgttcgccgcctgctggggccccatccagctgttcctggtgctgcaggccctgggccccgccggcagctggcaccccagaagctacgccgcctacgccctgaagacctgggcccactgcatgagctacagcaacagcgccctgaaccccctgctgtacgccttcctgggcagccacttcagacaggccttcagaagagtgtgcccctgcgcccccagaagacccagaagacccagaagacccggccccagcgaccccgccgccccccacgccgagctgctgagactgggcagccaccccgcccccgccagagcccagaagcccggcagcagcggcctggccgccagaggcctgtgcgtgctgggcgaggacaacgcccccctgtag

SEQ ID NO: 18586 - DNA, 3543 bp, Artificial Sequence
  Description of Artificial Sequence: Synthetic coding sequence
atggtgctgctgctgatcctgagcgtgctgctgctgaaggaggacgtgagaggcagcgcccagagcagcgagagaagagtggtggcccacatgcccggcgacatcatcatcggcgccctgttcagcgtgcaccaccagcccaccgtggacaaggtgcacgagagaaagtgcggcgccgtgagagagcagtacggcatccagagagtggaggccatgctgcacaccctggagagaatcaacagcgaccccaccctgctgcccaacatcaccctgggctgcgagatcagagacagctgctggcacagcgccgtggccctggagcagagcatcgagttcatcagagacagcctgatcagcagcgaggaggaggagggcctggtgagatgcgtggacggcagcagcagcagcttcagaagcaagaagcccatcgtgggcgtgatcggccccggcagcagcagcgtggccatccaggtgcagaacctgctgcagctgttcaacatcccccagatcgcctacagcgccaccagcatggacctgagcgacaagaccctgttcaagtacttcatgagagtggtgcccagcgacgcccagcaggccagagccatggtggacatcgtgaagagatacaactggacctacgtgagcgccgtgcacaccgagggcaactacggcgagagcggcatggaggccttcaaggacatgagcgccaaggagggcatctgcatcgcccacagctacaagatctacagcaacgccggcgagcagagcttcgacaagctgctgaagaagctgaccagccacctgcccaaggccagagtggtggcctgcttctgcgagggcatgaccgtgagaggcctgctgatggccatgagaagactgggcctggccggcgagttcctgctgctgggcagcgacggctgggccgacagatacgacgtgaccgacggctaccagagagaggccgtgggcggcatcaccatcaagctgcagagccccgacgtgaagtggttcgacgactactacctgaagctgagacccgagaccaaccacagaaacccctggttccaggagttctggcagcacagattccagtgcagactggagggcttcccccaggagaacagcaagtacaacaagacctgcaacagcagcctgaccctgaagacccaccacgtgcaggacagcaagatgggcttcgtgatcaacgccatctacagcatggcctacggcctgcacaacatgcagatgagcctgtgccccggctacgccggcctgtgcgacgccatgaagcccatcgacggcagaaagctgctggagagcctgatgaagaccaacttcaccggcgtgagcggcgacaccatcctgttcgacgagaacggcgacagccccggcagatacgagatcatgaacttcaaggagatgggcaaggactacttcgactacatcaacgtgggcagctgggacaacggcgagctgaagatggacgacgacgaggtgtggagcaagaagagcaacatcatcagaagcgtgtgcagcgagccctgcgagaagggccagatcaaggtgatcagaaagggcgaggtgagctgctgctggacctgcaccccctgcaaggagaacgagtacgtgttcgacgagtacacctgcaaggcctgccagctgggcagctggcccaccgacgacctgaccggctgcgacctgatccccgtgcagtacctgagatggggcgaccccgagcccatcgccgccgtggtgttcgcctgcctgggcctgctggccaccctgttcgtgaccgtggtgttcatcatctacagagacacccccgtggtgaagagcagcagcagagagctgtgctacatcatcctggccggcatctgcctgggctacctgtgcaccttctgcctgatcgccaagcccaagcagatctactgctacctgcagagaatcggcatcggcctgagccccgccatgagctacagcgccctggtgaccaagaccaacagaatcgccagaatcctggccggcagcaagaagaagatctgcaccaagaagcccagattcatgagcgcctgcgcccagctggtgatcgccttcatcctgatctgcatccagctgggcatcatcgtggccctgttcatcatggagccccccgacatcatgcacgactaccccagcatcagagaggtgtacctgatctgcaacaccaccaacctgggcgtggtgacccccctgggctacaacggcctgctgatcctgagctgcaccttctacgccttcaagaccagaaacgtgcccgccaacttcaacgaggccaagtacatcgccttcaccatgtacaccacctgcatcatctggctggccttcgtgcccatctacttcggcagcaactacaagatcatcaccatgtgcttcagcgtgagcctgagcgccaccgtggccctgggctgcatgttcgtgcccaaggtgtacatcatcctggccaagcccgagagaaacgtgagaagcgccttcaccaccagcaccgtggtgagaatgcacgtgggcgacggcaagagcagcagcgccgccagcagaagcagcagcctggtgaacctgtggaagagaagaggcagcagcggcgagaccctgagcagcaacggcaagagcgtgacctgggcccagaacgagaagagcagcagaggccagcacctgtggcagagactgagcatccacatcaacaagaaggagaaccccaaccagaccgccgtgatcaagcccttccccaagagcaccgagagcagaggcctgggcgccggcgccggcgccggcggcagcgccggcggcgtgggcgccaccggcggcgccggctgcgccggcgccggccccggcggccccgagagccccgacgccggccccaaggccctgtacgacgtggccgaggccgaggagcacttccccgcccccgccagacccagaagccccagccccatcagcaccctgagccacagagccggcagcgccagcagaaccgacgacgacgtgcccagcctgcacagcgagcccgtggccagaagcagcagcagccagggcagcctgatggagcagatcagcagcgtggtgaccagattcaccgccaacatcagcgagctgaacagcatgatgctgagcaccgccgcccccagccccggcgtgggcgcccccctgtgcagcagctacctgatccccaaggagatccagctgcccaccaccatgaccaccttcgccgagatccagcccctgcccgccatcgaggtgaccggcggcgcccagcccgccgccggcgcccaggccgccggcgacgccgccagagagagccccgccgccggccccgaggccgccgccgccaagcccgacctggaggagctggtggccctgaccccccccagccccttcagagacagcgtggacagcggcagcaccacccccaacagccccgtgagcgagagcgccctgtgcatccccagcagccccaagtacgacaccctgatcatcagagactacacccagagcagcagcagcctgtag

SEQ ID NO: 18587 - DNA, 3639 bp, Artificial Sequence
  Description of Artificial Sequence: Synthetic coding sequence
atggtgctgctgctgatcctgagcgtgctgctgctgaaggaggacgtgagaggcagcgcccagagcagcgagagaagagtggtggcccacatgcccggcgacatcatcatcggcgccctgttcagcgtgcaccaccagcccaccgtggacaaggtgcacgagagaaagtgcggcgccgtgagagagcagtacggcatccagagagtggaggccatgctgcacaccctggagagaatcaacagcgaccccaccctgctgcccaacatcaccctgggctgcgagatcagagacagctgctggcacagcgccgtggccctggagcagagcatcgagttcatcagagacagcctgatcagcagcgaggaggaggagggcctggtgagatgcgtggacggcagcagcagcagcttcagaagcaagaagcccatcgtgggcgtgatcggccccggcagcagcagcgtggccatccaggtgcagaacctgctgcagctgttcaacatcccccagatcgcctacagcgccaccagcatggacctgagcgacaagaccctgttcaagtacttcatgagagtggtgcccagcgacgcccagcaggccagagccatggtggacatcgtgaagagatacaactggacctacgtgagcgccgtgcacaccgagggcaactacggcgagagcggcatggaggccttcaaggacatgagcgccaaggagggcatctgcatcgcccacagctacaagatctacagcaacgccggcgagcagagcttcgacaagctgctgaagaagctgaccagccacctgcccaaggccagagtggtggcctgcttctgcgagggcatgaccgtgagaggcctgctgatggccatgagaagactgggcctggccggcgagttcctgctgctgggcagcgacggctgggccgacagatacgacgtgaccgacggctaccagagagaggccgtgggcggcatcaccatcaagctgcagagccccgacgtgaagtggttcgacgactactacctgaagctgagacccgagaccaaccacagaaacccctggttccaggagttctggcagcacagattccagtgcagactggagggcttcccccaggagaacagcaagtacaacaagacctgcaacagcagcctgaccctgaagacccaccacgtgcaggacagcaagatgggcttcgtgatcaacgccatctacagcatggcctacggcctgcacaacatgcagatgagcctgtgccccggctacgccggcctgtgcgacgccatgaagcccatcgacggcagaaagctgctggagagcctgatgaagaccaacttcaccggcgtgagcggcgacaccatcctgttcgacgagaacggcgacagccccggcagatacgagatcatgaacttcaaggagatgggcaaggactacttcgactacatcaacgtgggcagctgggacaacggcgagctgaagatggacgacgacgaggtgtggagcaagaagagcaacatcatcagaagcgtgtgcagcgagccctgcgagaagggccagatcaaggtgatcagaaagggcgaggtgagctgctgctggacctgcaccccctgcaaggagaacgagtacgtgttcgacgagtacacctgcaaggcctgccagctgggcagctggcccaccgacgacctgaccggctgcgacctgatccccgtgcagtacctgagatggggcgaccccgagcccatcgccgccgtggtgttcgcctgcctgggcctgctggccaccctgttcgtgaccgtggtgttcatcatctacagagacacccccgtggtgaagagcagcagcagagagctgtgctacatcatcctggccggcatctgcctgggctacctgtgcaccttctgcctgatcgccaagcccaagcagatctactgctacctgcagagaatcggcatcggcctgagccccgccatgagctacagcgccctggtgaccaagaccaacagaatcgccagaatcctggccggcagcaagaagaagatctgcaccaagaagcccagattcatgagcgcctgcgcccagctggtgatcgccttcatcctgatctgcatccagctgggcatcatcgtggccctgttcatcatggagccccccgacatcatgcacgactaccccagcatcagagaggtgtacctgatctgcaacaccaccaacctgggcgtggtgacccccctgggctacaacggcctgctgatcctgagctgcaccttctacgccttcaagaccagaaacgtgcccgccaacttcaacgaggccaagtacatcgccttcaccatgtacaccacctgcatcatctggctggccttcgtgcccatctacttcggcagcaactacaagatcatcaccatgtgcttcagcgtgagcctgagcgccaccgtggccctgggctgcatgttcgtgcccaaggtgtacatcatcctggccaagcccgagagaaacgtgagaagcgccttcaccaccagcaccgtggtgagaatgcacgtgggcgacggcaagagcagcagcgccgccagcagaagcagcagcctggtgaacctgtggaagagaagaggcagcagcggcgagaccctgagatacaaggacagaagactggcccagcacaagagcgagatcgagtgcttcacccccaagggcagcatgggcaacggcggcagagccaccatgagcagcagcaacggcaagagcgtgacctgggcccagaacgagaagagcagcagaggccagcacctgtggcagagactgagcatccacatcaacaagaaggagaaccccaaccagaccgccgtgatcaagcccttccccaagagcaccgagagcagaggcctgggcgccggcgccggcgccggcggcagcgccggcggcgtgggcgccaccggcggcgccggctgcgccggcgccggccccggcggccccgagagccccgacgccggccccaaggccctgtacgacgtggccgaggccgaggagcacttccccgcccccgccagacccagaagccccagccccatcagcaccctgagccacagagccggcagcgccagcagaaccgacgacgacgtgcccagcctgcacagcgagcccgtggccagaagcagcagcagccagggcagcctgatggagcagatcagcagcgtggtgaccagattcaccgccaacatcagcgagctgaacagcatgatgctgagcaccgccgcccccagccccggcgtgggcgcccccctgtgcagcagctacctgatccccaaggagatccagctgcccaccaccatgaccaccttcgccgagatccagcccctgcccgccatcgaggtgaccggcggcgcccagcccgccgccggcgcccaggccgccggcgacgccgccagagagagccccgccgccggccccgaggccgccgccgccaagcccgacctggaggagctggtggccctgaccccccccagccccttcagagacagcgtggacagcggcagcaccacccccaacagccccgtgagcgagagcgccctgtgcatccccagcagccccaagtacgacaccctgatcatcagagactacacccagagcagcagcagcctgtag

SEQ ID NO: 18588 - DNA, 2829 bp, Artificial Sequence
  Description of Artificial Sequence: Synthetic coding sequence
atggtgctgctgctgatcctgagcgtgctgctgctgaaggaggacgtgagaggcagcgcccagagcagcgagagaagagtggtggcccacatgcccggcgacatcatcatcggcgccctgttcagcgtgcaccaccagcccaccgtggacaaggtgcacgagagaaagtgcggcgccgtgagagagcagtacggcatccagagagtggaggccatgctgcacaccctggagagaatcaacagcgaccccaccctgctgcccaacatcaccctgggctgcgagatcagagacagctgctggcacagcgccgtggccctggagcagagcatcgagttcatcagagacagcctgatcagcagcgaggaggaggagggcctggtgagatgcgtggacggcagcagcagcagcttcagaagcaagaagcccatcgtgggcgtgatcggccccggcagcagcagcgtggccatccaggtgcagaacctgctgcagctgttcaacatcccccagatcgcctacagcgccaccagcatggacctgagcgacaagaccctgttcaagtacttcatgagagtggtgcccagcgacgcccagcaggccagagccatggtggacatcgtgaagagatacaactggacctacgtgagcgccgtgcacaccgagggcaactacggcgagagcggcatggaggccttcaaggacatgagcgccaaggagggcatctgcatcgcccacagctacaagatctacagcaacgccggcgagcagagcttcgacaagctgctgaagaagctgaccagccacctgcccaaggccagagtggtggcctgcttctgcgagggcatgaccgtgagaggcctgctgatggccatgagaagactgggcctggccggcgagttcctgctgctgggcagcgacggctgggccgacagatacgacgtgaccgacggctaccagagagaggccgtgggcggcatcaccatcaagctgcagagccccgacgtgaagtggttcgacgactactacctgaagctgagacccgagaccaaccacagaaacccctggttccaggagttctggcagcacagattccagtgcagactggagggcttcccccaggagaacagcaagtacaacaagacctgcaacagcagcctgaccctgaagacccaccacgtgcaggacagcaagatgggcttcgtgatcaacgccatctacagcatggcctacggcctgcacaacatgcagatgagcctgtgccccggctacgccggcctgtgcgacgccatgaagcccatcgacggcagaaagctgctggagagcctgatgaagaccaacttcaccggcgtgagcggcgacaccatcctgttcgacgagaacggcgacagccccggcagatacgagatcatgaacttcaaggagatgggcaaggactacttcgactacatcaacgtgggcagctgggacaacggcgagctgaagatggacgacgacgaggtgtggagcaagaagagcaacatcatcagaagcgtgtgcagcgagccctgcgagaagggccagatcaaggtgatcagaaagggcgaggtgagctgctgctggacctgcaccccctgcaaggagaacgagtacgtgttcgacgagtacacctgcaaggcctgccagctgggcagctggcccaccgacgacctgaccggctgcgacctgatccccgtgcagtacctgagatggggcgaccccgagcccatcgccgccgtggtgttcgcctgcctgggcctgctggccaccctgttcgtgaccgtggtgttcatcatctacagagacacccccgtggtgaagagcagcagcagagagctgtgctacatcatcctggccggcatctgcctgggctacctgtgcaccttctgcctgatcgccaagcccaagcagatctactgctacctgcagagaatcggcatcggcctgagccccgccatgagctacagcgccctggtgaccaagaccaacagaatcgccagaatcctggccggcagcaagaagaagatctgcaccaagaagcccagattcatgagcgcctgcgcccagctggtgatcgccttcatcctgatctgcatccagctgggcatcatcgtggccctgttcatcatggagccccccgacatcatgcacgactaccccagcatcagagaggtgtacctgatctgcaacaccaccaacctgggcgtggtgacccccctgggctacaacggcctgctgatcctgagctgcaccttctacgccttcaagaccagaaacgtgcccgccaacttcaacgaggccaagtacatcgccttcaccatgtacaccacctgcatcatctggctggccttcgtgcccatctacttcggcagcaactacaagatcatcaccatgtgcttcagcgtgagcctgagcgccaccgtggccctgggctgcatgttcgtgcccaaggtgtacatcatcctggccaagcccgagagaaacgtgagaagcgccttcaccaccagcaccgtggtgagaatgcacgtgggcgacggcaagagcagcagcgccgccagcagaagcagcagcctggtgaacctgtggaagagaagaggcagcagcggcgagaccctgagatacaaggacagaagactggcccagcacaagagcgagatcgagtgcttcaccccccccagccccttcagagacagcgtggacagcggcagcaccacccccaacagccccgtgagcgagagcgccctgtgcatccccagcagccccaagtacgacaccctgatcatcagagactacacccagagcagcagcagcctgtag

SEQ ID NO: 18589 - DNA, 3639 bp, Artificial Sequence; identical to SEQ ID NO: 18587
  Description of Artificial Sequence: Synthetic coding sequence

SEQ ID NO: 18590 - DNA, 3543 bp, Artificial Sequence; identical to SEQ ID NO: 18586
  Description of Artificial Sequence: Synthetic coding sequence

SEQ ID NO: 18591 - DNA, 1149 bp, Artificial Sequence
  Description of Artificial Sequence: Synthetic coding sequence
atgagaagcggcggcagaggcagacccagactgagactgggcgagagaggcctgatggagcccctgctgccccccaagagaagactgctgcccagagtgagactgctgcccctgctgctggccctggccgtgggcagcgccttctacaccatctggagcggctggcacagaagaaccgaggagctgcccctgggcagagagctgagagtgcccctgatcggcagcctgcccgaggccagactgagaagagtggtgggccagctggacccccagagactgtggagcacctacctgagacccctgctggtggtgagaacccccggcagccccggcaacctgcaggtgagaaagttcctggaggccaccctgagaagcctgaccgccggctggcacgtggagctggaccccttcaccgccagcacccccctgggccccgtggacttcggcaacgtggtggccaccctggaccccagagccgccagacacctgaccctggcctgccactacgacagcaagctgttcccccccggcagcacccccttcgtgggcgccaccgacagcgccgtgccctgcgccctgctgctggagctggcccaggccctggacctggagctgagcagagccaagaagcaggccgcccccgtgaccctgcagctgctgttcctggacggcgaggaggccctgaaggagtggggccccaaggacagcctgtacggcagcagacacctggcccagctgatggagagcatcccccacagccccggccccaccagaatccaggccatcgagctgttcatgctgctggacctgctgggcgcccccaaccccaccttctacagccacttccccagaaccgtgagatggttccacagactgagaagcatcgagaagagactgcacagactgaacctgctgcagagccacccccaggaggtgatgtacttccagcccggcgagcccttcggcagcgtggaggacgaccacatccccttcctgagaagaggcgtgcccgtgctgcacctgatcagcacccccttccccgccgtgtggcacacccccgccgacaccgaggtgaacctgcacccccccaccgtgcacaacctgtgcagaatcctggccgtgttcctggccgagtacctgggcctgtag

SEQ ID NO: 18592 - DNA, 867 bp, Artificial Sequence
  Description of Artificial Sequence: Synthetic coding sequence
atgagaagcggcggcagaggcagacccagactgagactgggcgagagaggcctgatggagcccctgctgccccccaagagaagactgctgcccagagtgagactgctgcccctgctgctggccctggccgtgggcagcgccttctacaccatctggagcggctggcacagaagaaccgaggagctgcccctgggcagagagctgagagtgcccctgatcggcagcctgcccgaggccagactgagaagagtggtgggccagctggacccccagagactgtggagcacctacctgagacccctgctggtggtgagaacccccggcagccccggcaacctgcaggtgagaaaggccgcccccgtgaccctgcagctgctgttcctggacggcgaggaggccctgaaggagtggggccccaaggacagcctgtacggcagcagacacctggcccagctgatggagagcatcccccacagccccggccccaccagaatccaggccatcgagctgttcatgctgctggacctgctgggcgcccccaaccccaccttctacagccacttccccagaaccgtgagatggttccacagactgagaagcatcgagaagagactgcacagactgaacctgctgcagagccacccccaggaggtgatgtacttccagcccggcgagcccttcggcagcgtggaggacgaccacatccccttcctgagaagaggcgtgcccgtgctgcacctgatcagcacccccttccccgccgtgtggcacacccccgccgacaccgaggtgaacctgcacccccccaccgtgcacaacctgtgcagaatcctggccgtgttcctggccgagtacctgggcctgtag

SEQ ID NO: 18593 - DNA, 960 bp, Artificial Sequence
  Description of Artificial Sequence: Synthetic coding sequence
atgctgggcagaagcctgagagaggtgagcgccgccctgaagcagggccagatcacccccaccgagctgtgccagaagtgcctgagcctgatcaagaagaccaagttcctgaacgcctacatcaccgtgagcgaggaggtggccctgaagcaggccgaggagagcgagaagagatacaagaacggccagagcctgggcgacctggacggcatccccatcgccgtgaaggacaacttcagcaccagcggcatcgagaccacctgcgccagcaacatgctgaagggctacatccccccctacaacgccaccgtggtgcagaagctgctggaccagggcgccctgctgatgggcaagaccaacctggacgagttcgccatgggcagcggcagcaccgacggcgtgttcggccccgtgaagaacccctggagctacagcaagcagtacagagagaagagaaagcagaacccccacagcgagaacgaggacagcgactggctgatcaccggcggcagcagcggcggcagcgccgccgccgtgagcgccttcacctgctacgccgccctgggcagcgacaccggcggcagcaccagaaaccccgccgcccactgcggcctggtgggcttcaagcccagctacggcctggtgagcagacacggcctgatccccctggtgaacagcatggacgtgcccggcatcctgaccagatgcgtggacgacgccgccatcgtgctgggcgccctggccggccccgaccccagagacagcaccaccgtgcacgagcccatcaacaagcccttcatgctgcccagcctggccgacgtgagcaagctgtgcatcggcatccccaaggtgaccttcagcttccactacttcaccgagatcctgagcagccccatcgagagcaccgacctgggcggcggcctgggcggcttcgagagcctgctgtgccacttctactag

SEQ ID NO: 18594 - DNA, 1587 bp, Artificial Sequence
  Description of Artificial Sequence: Synthetic coding sequence
atgctgggcagaagcctgagagaggtgagcgccgccctgaagcagggccagatcacccccaccgagctgtgccagaagtgcctgagcctgatcaagaagaccaagttcctgaacgcctacatcaccgtgagcgaggaggtggccctgaagcaggccgaggagagcgagaagagatacaagaacggccagagcctgggcgacctggacggcatccccatcgccgtgaaggacaacttcagcaccagcggcatcgagaccacctgcgccagcaacatgctgaagggctacatccccccctacaacgccaccgtggtgcagaagctgctggaccagggcgccctgctgatgggcaagaccaacctggacgagttcgccatgggcagcggcagcaccgacggcgtgttcggccccgtgaagaacccctggagctacagcaagcagtacagagagaagagaaagcagaacccccacagcgagaacgaggacagcgactggctgatcaccggcggcagcagcggcggcagcgccgccgccgtgagcgccttcacctgctacgccgccctgggcagcgacaccggcggcagcaccagaaaccccgccgcccactgcggcctggtgggcttcaagcccagctacggcctggtgagcagacacggcctgatccccctggtgaacagcatggacgtgcccggcatcctgaccagatgcgtggacgacgccgccatcgtgctgggcgccctggccggccccgaccccagagacagcaccaccgtgcacgagcccatcaacaagcccttcatgctgcccagcctggccgacgtgagcaagctgtgcatcggcatccccaaggagtacctggtgcccgagctgagcagcgaggtgcagagcctgtggagcaaggccgccgacctgttcgagagcgagggcgccaaggtgatcgaggtgagcctgccccacaccagctacagcatcgtgtgctaccacgtgctgtgcaccagcgaggtggccagcaacatggccagattcgacggcctgcagtacggccacagatgcgacatcgacgtgagcaccgaggccatgtacgccgccaccagaagagagggcttcaacgacgtggtgagaggcagaatcctgagcggcaacttcttcctgctgaaggagaactacgagaactacttcgtgaaggcccagaaggtgagaagactgatcgccaacgacttcgtgaacgccttcaacagcggcgtggacgtgctgctgacccccaccaccctgagcgaggccgtgccctacctggagttcatcaaggaggacaacagaaccagaagcgcccaggacgacatcttcacccaggccgtgaacatggccggcctgcccgccgtgagcatccccgtggccctgagcaaccagggcctgcccatcggcctgcagttcatcggcagagccttctgcgaccagcagctgctgaccgtggccaagtggttcgagaagcaggtgcagttccccgtgatccagctgcaggagctgatggacgactgcagcgccgtgctggagaacgagaagctggccagcgtgagcctgaagcagtag

SEQ ID NO: 18595 - DNA, 411 bp, Artificial Sequence
  Description of Artificial Sequence: Synthetic coding sequence
atgtggagcagactggtgtggctgggcctgagagcccccctgggcggcagacagggcttcaccagcaaggccgacccccagggcagcggcagaatcaccgccgccgtgatcgagcacctggagagactggccctggtggacttcggcagcagagaggccgtggccagactggagaaggccatcgccttcgccgacagactgagagccgtggacaccgacggcgtggagcccatggagagcgtgctggaggacagatgcctgtacctgagaagcgacaacgtggtggagggcaactgcgccgacgagctgctgcagaacagccacagagtggtggaggagtacttcgtggccccccccggcaacatcagcctgcccaagctggacgagcaggagcccttcccccacagctag

SEQ ID NO: 18596 - DNA, 630 bp, Artificial Sequence
  Description of Artificial Sequence: Synthetic coding sequence
atggagcccctggccgcctaccccctgaagtgcagcggccccagagccaaggtgttcgccgtgctgctgagcatcgtgctgtgcaccgtgaccctgttcctgctgcagctgaagttcctgaagcccaagatcaacagcttctacgccttcgaggtgaaggacgccaagggcagaaccgtgagcctggagaagtacaagggcaaggtgagcctggtggtgaacgtggccagcgactgccagctgaccgacagaaactacctgggcctgaaggagctgcacaaggagttcggccccagccacttcagcgtgctggccttcccctgcaaccagttcggcgagagcgagcccagacccagcaaggaggtggagagcttcgccagaaagaactacggcgtgaccttccccatcttccacaagatcaagatcctgggcagcgagggcgagcccgccttcagattcctggtggacagcagcaagaaggagcccagatggaacttctggaagtacctggtgaaccccgagggccaggtggtgaagttctggaagcccgaggagcccatcgaggtgatcagacccgacatcgccgccctggtgagacaggtgatcatcaagaagaaggaggacctgtag

SEQ ID NO: 18597 - DNA, 2388 bp, Artificial Sequence
  Description of Artificial Sequence: Synthetic coding sequence
atggccaccatgctggagggcagatgccagacccagcccagaagcagccccagcggcagagaggccagcctgtggagcagcggcttcggcatgaagctggaggccgtgacccccttcctgggcaagtacagacccttcgtgggcagatgctgccagacctgcacccccaagagctgggagagcctgttccacagaagcatcaccgacctgggcttctgcaacgtgatcctggtgaaggaggagaacaccagattcagaggctggctggtgagaagactgtgctacttcctgtggagcctggagcagcacatccccccctgccaggacgtgccccagaagatcatggagagcaccggcgtgcagaacctgctgagcggcagagtgcccggcggcaccggcgagggccaggtgcccgacctggtgaagaaggaggtgcagagaatcctgggccacatccaggccccccccagacccttcctggtgagactgttcagctgggccctgctgagattcctgaactgcctgttcctgaacgtgcagctgcacaagggccagatgaagatggtgcagaaggccgcccaggccggcctgcccctggtgctgctgagcacccacaagaccctgctggacggcatcctgctgcccttcatgctgctgagccagggcctgggcgtgctgagagtggcctgggacagcagagcctgcagccccgccctgagagccctgctgagaaagctgggcggcctgttcctgccccccgaggccagcctgagcctggacagcagcgagggcctgctggccagagccgtggtgcaggccgtgatcgagcagctgctggtgagcggccagcccctgctgatcttcctggaggagccccccggcgccctgggccccagactgagcgccctgggccaggcctgggtgggcttcgtggtgcaggccgtgcaggtgggcatcgtgcccgacgccctgctggtgcccgtggccgtgacctacgacctggtgcccgacgccccctgcgacatcgaccacgccagcgcccccctgggcctgtggaccggcgccctggccgtgctgagaagcctgtggagcagatggggctgcagccacagaatctgcagcagagtgcacctggcccagcccttcagcctgcaggagtacatcgtgagcgccagaagctgctggggcggcagacagaccctggagcagctgctgcagcccatcgtgctgggccagtgcaccgccgtgcccgacaccgagaaggagcaggagtggacccccatcaccggccccctgctggccctgaaggaggaggaccagctgctggtgagaagactgagctgccacgtgctgagcgccagcgtgggcagcagcgccgtgatgagcaccgccatcatggccaccctgctgctgttcaagcaccagaagctgctgggcgagttcagctggctgaccgaggagatcctgctgagaggcttcgacgtgggcttcagcggccagctgagaagcctgctgcagcacagcctgagcctgctgagagcccacgtggccctgctgagaatcagacagggcgacctgctggtggtgccccagcccggccccggcctgacccacctggcccagctgagcgccgagctgctgcccgtgttcctgagcgaggccgtgggcgcctgcgccgtgagaggcctgctggccggcagagtgcccccccagggcccctgggagctgcagggcatcctgctgctgagccagaacgagctgtacagacagatcctgctgctgatgcacctgctgccccaggacctgctgctgctgaagccctgccagagcagctactgctactgccaggaggtgctggacagactgatccagtgcggcctgctggtggccgaggagacccccggcagcagacccgcctgcgacaccggcagacagagactgagcagaaagctgctgtggaagcccagcggcgacttcaccgacagcgacagcgacgacttcggcgaggccgacggcagatacttcagactgagccagcagagccactgccccgacttcttcctgttcctgtgcagactgctgagccccctgctgaaggccttcgcccaggccgccgccttcctgagacagggccagctgcccgacaccgagctgggctacaccgagcagctgttccagttcctgcaggccaccgcccaggaggagggcatcttcgagtgcgccgaccccaagctggccatcagcgccgtgtggaccttcagagacctgggcgtgctgcagcagacccccagccccgccggccccagactgcacctgagccccaccttcgccagcctggacaaccaggagaagctggagcagttcatcagacagttcatctgcagctag

SEQ ID NO: 18598 - DNA, 2016 bp, Artificial Sequence
  Description of Artificial Sequence: Synthetic coding sequence
atggccaccatgctggagggcagatgccagacccagcccagaagcagccccagcggcagagaggccagcctgtggagcagcggcttcggcatgaagctggaggccgtgacccccttcctgggcaagtacagacccttcgtgggcagatgctgccagacctgcacccccaagagctgggagagcctgttccacagaagcatcaccgacctgggcttctgcaacgtgatcctggtgaaggaggagaacaccagattcagaggctggctggtgagaagactgtgctacttcctgtggagcctggagcagcacatccccccctgccaggacgtgccccagaagatcatggagagcaccggcgtgcagaacctgctgagcggcagagtgcccggcggcaccggcgagggccaggtgcccgacctggtgaagaaggaggtgcagagaatcctgggccacatccaggccccccccagacccttcctggtgagactgttcagctgggccctgctgagattcctgaactgcctgttcctgaacgtgcagctgcacaagggccagatgaagatggtgcagaaggccgcccaggccggcctgcccctggtgctgctgagcacccacaagaccctgctggacggcatcctgctgcccttcatgctgctgagccagggcctgggcgtgctgagagtggcctgggacagcagagcctgcagccccgccctgagagccctgctgagaaagctgggcggcctgttcctgccccccgaggccagcctgagcctggacagcagcgagggcctgctggccagagccgtggtgcaggccgtgatcgagcagctgctggtgagcggccagcccctgctgatcttcctggaggagccccccggcgccctgggccccagactgagcgccctgggccaggcctgggtgggcttcgtggtgcaggccgtgcaggtgggcatcgtgcccgacgccctgctggtgcccgtggccgtgacctacgacctggtgcccgacgccccctgcgacatcgaccacgccagcgcccccctgggcctgtggaccggcgccctggccgtgctgagaagcctgtggagcagatggggctgcagccacagaatctgcagcagagtgcacctggcccagcccttcagcctgcaggagtacatcgtgagcgccagaagctgctggggcggcagacagaccctggagcagctgctgcagcccatcgtgctgggccagtgcaccgccgtgcccgacaccgagaaggagcaggagtggacccccatcaccggccccctgctggccctgaaggaggaggaccagctgctggtgagaagactgagctgccacgtgctgagcgccagcgtgggcagcagcgccgtgatgagcaccgccatcatggccaccctgctgctgttcaagcaccagaagctgctgggcgagttcagctggctgaccgaggagatcctgctgagaggcttcgacgtgggcttcagcggccagctgagaagcctgctgcagcacagcctgagcctgctgagagcccacgtggccctgctgagaatcagacagggcgacctgctggtggtgccccagcccggccccggcctgacccacctggcccagctgagcgccgagctgctgcccgtgttcctgagcgaggccgtgggcgcctgcgccgtgagaggcctgctggccggcagagtgcccccccagggcccctgggagctgcagggcatcctgctgctgagccagaacgagctgtacagacagatcctgctgctgatgcacctgctgccccaggacctgctgctgctgaagccctgccagagcagctactgctactgccaggaggtgctggacagactgatccagtgcggcctgctggtggccgaggagagctgggccacccagagcagctgcagcagcagctgcagacccccccccagaaagaagggcagcagcagcgtgagaacccagagcagccccagcgtgctgagcggccccagcgagacctag

SEQ ID NO: 18599 - DNA, 2388 bp, Artificial Sequence; identical to SEQ ID NO: 18597
  Description of Artificial Sequence: Synthetic coding sequence

SEQ ID NO: 18600 - DNA, 483 bp, Artificial Sequence
  Description of Artificial Sequence: Synthetic coding sequence
atggccaccatgctggagggcagatgccagacccagcccagaagcagccccagcggcagagaggccagcctgtggagcagcggcttcggcatgaagctggaggccgtgacccccttcctgggcaagtacagacccttcgtgggcagatgctgccagacctgcacccccaagagctgggagagcctgttccacagaagcatcaccgacctgggcttctgcaacgtgatcctggtgaaggaggagaacaccagattcagaggctggctggtgagaagactgtgctacttcctgtggagcctggagcagcacatccccccctgccaggacgtgccccagaagatcatggagagcaccggcgtgcagaacctgctgagcggcagagtgcccggcggcaccggcgagggccaggtgcccgacctggtgaagaaggaggtgcagagaatcctgggccacatccaggccccccccagacccttcctgtag

SEQ ID NO: 18601 - DNA, 2487 bp, Artificial Sequence
  Description of Artificial Sequence: Synthetic coding sequence
atggacgagagcgccctgaccctgggcaccatcgacgtgagctacctgccccacagcagcgagtacagcgtgggcagatgcaagcacaccagcgaggagtggggcgagtgcggcttcagacccaccatcttcagaagcgccaccctgaagtggaaggagagcctgatgagcagaaagagacccttcgtgggcagatgctgctacagctgcaccccccagagctgggacaagttcttcaaccccagcatccccagcctgggcctgagaaacgtgatctacatcaacgagacccacaccagacacagaggctggctggccagaagactgagctacgtgctgttcatccaggagagagacgtgcacaagggcatgttcgccaccaacgtgaccgagaacgtgctgaacagcagcagagtgcaggaggccatcgccgaggtggccgccgagctgaaccccgacggcagcgcccagcagcagagcaaggccgtgaacaaggtgaagaagaaggccaagagaatcctgcaggagatggtggccaccgtgagccccgccatgatcagactgaccggctgggtgctgctgaagctgttcaacagcttcttctggaacatccagatccacaagggccagctggagatggtgaaggccgccaccgagaccaacctgcccctgctgttcctgcccgtgcacagaagccacatcgactacctgctgctgaccttcatcctgttctgccacaacatcaaggccccctacatcgccagcggcaacaacctgaacatccccatcttcagcaccctgatccacaagctgggcggcttcttcatcagaagaagactggacgagacccccgacggcagaaaggacgtgctgtacagagccctgctgcacggccacatcgtggagctgctgagacagcagcagttcctggagatcttcctggagggcaccagaagcagaagcggcaagaccagctgcgccagagccggcctgctgagcgtggtggtggacaccctgagcaccaacgtgatccccgacatcctgatcatccccgtgggcatcagctacgacagaatcatcgagggccactacaacggcgagcagctgggcaagcccaagaagaacgagagcctgtggagcgtggccagaggcgtgatcagaatgctgagaaagaactacggctgcgtgagagtggacttcgcccagcccttcagcctgaaggagtacctggagagccagagccagaagcccgtgagcgccctgctgagcctggagcaggccctgctgcccgccatcctgcccagcagacccagcgacgccgccgacgagggcagagacaccagcatcaacgagagcagaaacgccaccgacgagagcctgagaagaagactgatcgccaacctggccgagcacatcctgttcaccgccagcaagagctgcgccatcatgagcacccacatcgtggcctgcctgctgctgtacagacacagacagggcatcgacctgagcaccctggtggaggacttcttcgtgatgaaggaggaggtgctggccagagacttcgacctgggcttcagcggcaacagcgaggacgtggtgatgcacgccatccagctgctgggcaactgcgtgaccatcacccacaccagcagaaacgacgagttcttcatcacccccagcaccaccgtgcccagcgtgttcgagctgaacttctacagcaacggcgtgctgcacgtgttcatcatggaggccatcatcgcctgcagcctgtacgccgtgctgaacaagagaggcctgggcggccccaccagcaccccccccaacctgatcagccaggagcagctggtgagaaaggccgccagcctgtgctacctgctgagcaacgagggcaccatcagcctgccctgccagaccttctaccaggtgtgccacgagaccgtgggcaagttcatccagtacggcatcctgaccgtggccgagcacgacgaccaggaggacatcagccccagcctggccgagcagcagtgggacaagaagctgcccgagcccctgagctggagaagcgacgaggaggacgaggacagcgacttcggcgaggagcagagagactgctacctgaaggtgagccagagcaaggagcaccagcagttcatcaccttcctgcagagactgctgggccccctgctggaggcctacagcagcgccgccatcttcgtgcacaacttcagcggccccgtgcccgagcccgagtacctgcagaagctgcacaagtacctgatcaccagaaccgagagaaacgtggccgtgtacgccgagagcgccacctactgcctggtgaagaacgccgtgaagatgttcaaggacatcggcgtgttcaaggagaccaagcagaagagagtgagcgtgctggagctgagcagcaccttcctgccccagtgcaacagacagaagctgctggagtacatcctgagcttcgtggtgctgtag

SEQ ID NO: 18602 - DNA, 2133 bp, Artificial Sequence
  Description of Artificial Sequence: Synthetic coding sequence
atggacgagagcgccctgaccctgggcaccatcgacgtgagctacctgccccacagcagcgagtacagcgtgggcagatgcaagcacaccagcgaggagtggggcgagtgcggcttcagacccaccatcttcagaagcgccaccctgaagtggaaggagagcctgatgagcagaaagagacccttcgtgggcagatgctgctacagctgcaccccccagagctgggacaagttcttcaaccccagcatccccagcctgggcctgagaaacgtgatctacatcaacgagacccacaccagacacagaggctggctggccagaagactgagctacgtgctgttcatccaggagagagacgtgcacaagggcatgttcgccaccaacgtgaccgagaacgtgctgaacagcagcagagtgcaggaggccatcgccgaggtggccgccgagctgaaccccgacggcagcgcccagcagcagagcaaggccgtgaacaaggtgaagaagaaggccaagagaatcctgcaggagatggtggccaccgtgagccccgccatgatcagactgaccggctgggtgctgctgaagctgttcaacagcttcttctggaacatccagatccacaagggccagctggagatggtgaaggccgccaccgagaccaacctgcccctgctgttcctgcccgtgcacagaagccacatcgactacctgctgctgaccttcatcctgttctgccacaacatcaaggccccctacatcgccagcggcaacaacctgaacatccccatcttcagcaccctgatccacaagctgggcggcttcttcatcagaagaagactggacgagacccccgacggcagaaaggacgtgctgtacagagccctgctgcacggccacatcgtggagctgctgagacagcagcagttcctggagatcttcctggagggcaccagaagcagaagcggcaagaccagctgcgccagagccggcctgctgagcgtggtggtggacaccctgagcaccaacgtgatccccgacatcctgatcatccccgtgggcatcagctacgacagaatcatcgagggccactacaacggcgagcagctgggcaagcccaagaagaacgagagcctgtggagcgtggccagaggcgtgatcagaatgctgagaaagaactacggctgcgtgagagtggacttcgcccagcccttcagcctgaaggagtacctggagagccagagccagaagcccgtgagcgccctgctgagcctggagcaggccctgctgcccgccatcctgcccagcagacccagcgacgccgccgacgagggcagagacaccagcatcaacgagagcagaaacgccaccgacgagagcctgagaagaagactgatcgccaacctggccgagcacatcctgttcaccgccagcaagagctgcgccatcatgagcacccacatcgtggcctgcctgctgctgtacagacacagacagggcatcgacctgagcaccctggtggaggacttcttcgtgatgaaggaggaggtgctggccagagacttcgacctgggcttcagcggcaacagcgaggacgtggtgatgcacgccatccagctgctgggcaactgcgtgaccatcacccacaccagcagaaacgacgagttcttcatcacccccagcaccaccgtgcccagcgtgttcgagctgaacttctacagcaacggcgtgctgcacgtgttcatcatggaggccatcatcgcctgcagcctgtacgccgtgctgaacaagagaggcctgggcggccccaccagcaccccccccaacctgatcagccaggagcagctggtgagaaaggccgccagcctgtgctacctgctgagcaacgagggcaccatcagcctgccctgccagaccttctaccaggtgtgccacgagaccgtgggcaagttcatccagtacggcatcctgaccgtggccgagcacgacgaccaggaggacatcagccccagcctggccgagcagcagtgggacaagaagctgcccgagcccctgagctggagaagcgacgaggaggacgaggacagcgacttcggcgaggagcagagagactgctacctgaaggtgctgggctag

SEQ ID NO: 18603 - DNA, 2487 bp, Artificial Sequence; identical to SEQ ID NO: 18601
  Description of Artificial Sequence: Synthetic coding sequence

SEQ ID NO: 18604 - DNA, 945 bp, Artificial Sequence
  Description of Artificial Sequence: Synthetic coding sequence
atgagcagcaccgccgccttctacctgctgagcaccctgggcggctacctggtgaccagcttcctgctgctgaagtaccccaccctgctgcaccagagaaagaagcagagattcctgagcaagcacatcagccacagaggcggcgccggcgagaacctggagaacaccatggccgccttccagcacgccgtgaagatcggcaccgacatgctggagctggactgccacatcaccaaggacgagcaggtggtggtgagccacgacgagaacctgaagagagccaccggcgtgaacgtgaacatcagcgacctgaagtactgcgagctgcccccctacctgggcaagctggacgtgagcttccagagagcctgccagtgcgagggcaaggacaacagaatccccctgctgaaggaggtgttcgaggccttccccaacacccccatcaacatcgacatcaaggtgaacaacaacgtgctgatcaagaaggtgagcgagctggtgaagagatacaacagagagcacctgaccgtgtggggcaacgccaactacgagatcgtggagaagtgctacaaggagaacagcgacatccccatcctgttcagcctgcagagagtgctgctgatcctgggcctgttcttcaccggcctgctgcccttcgtgcccatcagagagcagttcttcgagatccccatgcccagcatcatcctgaagctgaaggagccccacaccatgagcagaagccagaagttcctgatctggctgagcgacctgctgctgatgagaaaggccctgttcgaccacctgaccgccagaggcatccaggtgtacatctgggtgctgaacgaggagcaggagtacaagagagccttcgacctgggcgccaccggcgtgatgaccgactaccccaccaagctgagagacttcctgcacaacttcagcgcctag

SEQ ID NO: 18605 - DNA, 870 bp, Artificial Sequence
  Description of Artificial Sequence: Synthetic coding sequence
atgagcagcaccgccgccttctacctgctgagcaccctgggcggctacctggtgaccagcttcctgctgctgaagtaccccaccctgctgcaccagagaaagaagcagagattcctgagcaagcacatcagccacagaggcggcgccggcgagaacctggagaacaccatggccgccttccagcacgccgtgaagatcggcaccgacatgctggagctggactgccacatcaccaaggacgagcaggtggtggtgagccacgacgagaacctgaagagagccaccggcgtgaacgtgaacatcagcgacctgaagtactgcgagctgcccccctacctgggcaagctggacgtgagcttccagagagcctgccagtgcgagggcaaggacaacagaatccccctgctgaaggaggtgttcgaggccttccccaacacccccatcaacatcgacatcaaggtgaacaacaacgtgctgatcaagaaggtgagcgagctggtgaagagatacaacagagagcacctgaccgtgtggggcaacgccaactacgagatcgtggagaagtgctacaaggagaacagcgacatccccatcctgttcagcctgcagagagtgctgctgatcctgggcctgttcttcaccggcctgctgcccttcgtgcccatcagagagcagttcttcgagatccccatgcccagcatcatcctgaagctgaaggagccccacaccatgagcagaagccagaagttcctgatctggctgagcgacctgctgctgatgagaaaggccctgttcgagcccctgcaccccgccagcaagagaaacttcgagggccactgcagctacctggtggtgagctgctacttctag

SEQ ID NO: 18606 - DNA, 873 bp, Artificial Sequence
  Description of Artificial Sequence: Synthetic coding sequence
atgagcagcaccgccgccttctacctgctgagcaccctgggcggctacctggtgaccagcttcctgctgctgaagtaccccaccctgctgcaccagagaaagaagcagagattcctgagcaagcacatcagccacagaggcggcgccggcgagaacctggagaacaccatggccgccttccagcacgccgtgaagatcggcaccgacatgctggagctggactgccacatcaccaaggacgagcaggtggtggtgagccacgacgagaacctgaagagagccaccggcgtgaacgtgaacatcagcgacctgaagtactgcgagctgcccccctacctgggcaagctggacgtgagcttccagagagcctgccagtgcgagggcaaggacaacagaatccccctgctgaaggaggtgttcgaggccttccccaacacccccatcaacatcgacatcaaggtgaacaacaacgtgctgatcaagaaggtgagcgagctggtgaagagatacaacagagagcacctgaccgtgtggggcaacgccaactacgagatcgtggagaagtgctacaaggagaacagcgacatccccatcctgttcagcctgcagagagtgctgctgatcctgggcctgttcttcaccggcctgctgcccttcgtgcccatcagagagcagttcttcgagatccccatgcccagcatcatcctgaagctgaaggagccccacaccatgagcagaagccagaagttcctgatctggctgagcgacctgctgctgatgagaaaggccctgttcgaccacctgaccgccagaggcatccaggtgagcttctggaacgacgccttctggaagcagcacagcagccccgtgtag

SEQ ID NO: 18607 - DNA, 1620 bp, Artificial Sequence
  Description of Artificial Sequence: Synthetic coding sequence
atggccgagagccccggctgctgcagcgtgtgggccagatgcctgcactgcctgtacagctgccactggagaaagtgccccagagagagaatgcagaccagcaagtgcgactgcatctggttcggcctgctgttcctgaccttcctgctgagcctgagctggctgtacatcggcctggtgctgctgaacgacctgcacaacttcaacgagttcctgttcagaagatggggccactggatggactggagcctggccttcctgctggtgatcagcctgctggtgacctacgccagcctgctgctggtgctggccctgctgctgagactgtgcagacagcccctgcacctgcacagcctgcacaaggtgctgctgctgctgatcatgctgctggtggccgccggcctggtgggcctggacatccagtggcagcaggagtggcacagcctgagagtgagcctgcaggccaccgcccccttcctgcacatcggcgccgccgccggcatcgccctgctggcctggcccgtggccgacaccttctacagaatccacagaagaggccccaagatcctgctgctgctgctgttcttcggcgtggtgctggtgatctacctggcccccctgtgcatcagcagcccctgcatcatggagcccagagacctgccccccaagcccggcctggtgggccacagaggcgcccccatgctggcccccgagaacaccctgatgagcctgagaaagaccgccgagtgcggcgccaccgtgttcgagaccgacgtgatggtgagcagcgacggcgtgcccttcctgatgcacgacgagcacctgagcagaaccaccaacgtggccagcgtgttccccaccagaatcaccgcccacagcagcgacttcagctggaccgagctgaagagactgaacgccggcagctggttcctggagagaagacccttctggggcgccaagcccctggccggccccgaccagaaggaggccgagagccagaccgtgcccgccctggaggagctgctggaggaggccgccgccctgaacctgagcatcatgttcgacctgagaagacccccccagaaccacacctactacgacaccttcgtgatccagaccctggagaccgtgctgaacgccagagtgccccaggccatggtgttctggctgcccgacgaggacagagccaacgtgcagagaagagcccccggcatgagacagatctacggcagacagggcggcaacagaaccgagagaccccagttcctgaacctgccctaccaggacctgcccctgctggacatcaaggccctgcacaaggacaacgtgagcgtgaacctgttcgtggtgaacaagccctggctgttcagcctgctgtggtgcgccggcgtggacagcgtgaccaccaacgactgccagctgctgcagcagatgagataccccatctggctgatcaccccccagacctacctgatcatctgggtgatcaccaactgcgtgagcaccatgctgctgctgtggaccttcctgctgcagagaagattcgtgaagaagagaggcaagaccggcctggagaccgccgtgctgctgaccagaatcaacaacttcatgatggagtag

SEQ ID NO: 18608 - DNA, 1773 bp, Artificial Sequence
  Description of Artificial Sequence: Synthetic coding sequence
atggccgagagccccggctgctgcagcgtgtgggccagatgcctgcactgcctgtacagctgccactggagaaagtgccccagagagagaatgcagaccagcaagtgcgactgcatctggttcggcctgctgttcctgaccttcctgctgagcctgagctggctgtacatcggcctggtgctgctgaacgacctgcacaacttcaacgagttcctgttcagaagatggggccactggatggactggagcctggccttcctgctggtgatcagcctgctggtgacctacgccagcctgctgctggtgctggccctgctgctgagactgtgcagacagcccctgcacctgcacagcctgcacaaggtgctgctgctgctgatcatgctgctggtggccgccggcctggtgggcctggacatccagtggcagcaggagtggcacagcctgagagtgagcctgcaggccaccgcccccttcctgcacatcggcgccgccgccggcatcgccctgctggcctggcccgtggccgacaccttctacagaatccacagaagaggccccaagatcctgctgctgctgctgttcttcggcgtggtgctggtgatctacctggcccccctgtgcatcagcagcccctgcatcatggagcccagagacctgccccccaagcccggcctggtgggccacagaggcgcccccatgctggcccccgagaacaccctgatgagcctgagaaagaccgccgagtgcggcgccaccgtgttcgagaccgacgtgatggtgagcagcgacggcgtgcccttcctgatgcacgacgagcacctgagcagaaccaccaacgtggccagcgtgttccccaccagaatcaccgcccacagcagcgacttcagctggaccgagctgaagagactgaacgccggcagctggttcctggagagaagacccttctggggcgccaagcccctggccggccccgaccagaaggaggccgagagccagaccgtgcccgccctggaggagctgctggaggaggccgccgccctgaacctgagcatcatgttcgacctgagaagacccccccagaaccacacctactacgacaccttcgtgatccagaccctggagaccgtgctgaacgccagagtgccccaggccatggtgttctggctgcccgacgaggacagagccaacgtgcagagaagagcccccggcatgagacagatctacggcagacagggcggcaacagaaccgagagaccccagttcctgaacctgccctaccaggacctgcccctgctggacatcaaggacagattcctgctgcccgcccaggccggcctgaagctgctggccagcagcaacctgcccgccagcgccagccagagcgccggcatcaccggcctgagccactgccccccccagccccccggctacaagcacgagctgagccacctggccatggccctgcacaaggacaacgtgagcgtgaacctgttcgtggtgaacaagccctggctgttcagcctgctgtggtgcgccggcgtggacagcgtgaccaccaacgactgccagctgctgcagcagatgagataccccatctggctgatcaccccccagacctacctgatcatctgggtgatcaccaactgcgtgagcaccatgctgctgctgtggaccttcctgctgcagagaagattcgtgaagaagagaggcaagaccggcctggagaccgccgtgctgctgaccagaatcaacaacttcatgatggagtag

SEQ ID NO: 18609 - DNA, 1383 bp, Artificial Sequence
  Description of Artificial Sequence: Synthetic coding sequence
atggactggagcctggccttcctgctggtgatcagcctgctggtgacctacgccagcctgctgctggtgctggccctgctgctgagactgtgcagacagcccctgcacctgcacagcctgcacaaggtgctgctgctgctgatcatgctgctggtggccgccggcctggtgggcctggacatccagtggcagcaggagtggcacagcctgagagtgagcctgcaggccaccgcccccttcctgcacatcggcgccgccgccggcatcgccctgctggcctggcccgtggccgacaccttctacagaatccacagaagaggccccaagatcctgctgctgctgctgttcttcggcgtggtgctggtgatctacctggcccccctgtgcatcagcagcccctgcatcatggagcccagagacctgccccccaagcccggcctggtgggccacagaggcgcccccatgctggcccccgagaacaccctgatgagcctgagaaagaccgccgagtgcggcgccaccgtgttcgagaccgacgtgatggtgagcagcgacggcgtgcccttcctgatgcacgacgagcacctgagcagaaccaccaacgtggccagcgtgttccccaccagaatcaccgcccacagcagcgacttcagctggaccgagctgaagagactgaacgccggcagctggttcctggagagaagacccttctggggcgccaagcccctggccggccccgaccagaaggaggccgagagccagaccgtgcccgccctggaggagctgctggaggaggccgccgccctgaacctgagcatcatgttcgacctgagaagacccccccagaaccacacctactacgacaccttcgtgatccagaccctggagaccgtgctgaacgccagagtgccccaggccatggtgttctggctgcccgacgaggacagagccaacgtgcagagaagagcccccggcatgagacagatctacggcagacagggcggcaacagaaccgagagaccccagttcctgaacctgccctaccaggacctgcccctgctggacatcaaggccctgcacaaggacaacgtgagcgtgaacctgttcgtggtgaacaagccctggctgttcagcctgctgtggtgcgccggcgtggacagcgtgaccaccaacgactgccagctgctgcagcagatgagataccccatctggctgatcaccccccagacctacctgatcatctgggtgatcaccaactgcgtgagcaccatgctgctgctgtggaccttcctgctgcagagaagattcgtgaagaagagaggcaagaccggcctggagaccgccgtgctgctgaccagaatcaacaacttcatgatggagtag

SEQ ID NO: 18610 - DNA, 1383 bp, Artificial Sequence; identical to SEQ ID NO: 18609
  Description of Artificial Sequence: Synthetic coding sequence

SEQ ID NO: 18611 - DNA, 771 bp, Artificial Sequence
  Description of Artificial Sequence: Synthetic coding sequence
atggcccagagaagcgacctgctggagctggactgccagctgaccagagacagagtggtggtggtgagccacgacgagaacctgtgcagacagagcggcctgaacagagacgtgggcagcctggacttcgaggacctgcccctgtacaaggagaagctggaggtgtacttcagccccggccacttcgcccacggcagcgacagaagaatggtgagactggaggacctgttccagagattccccagaacccccatgagcgtggagatcaagggcaagaacgaggagctgatcagagagatcgccggcctggtgagaagatacgacagaaacgagatcaccatctgggccagcgagaagagcagcgtgatgaagaagtgcaaggccgccaaccccgagatgcccctgagcttcaccatcagcagaggcttctgggtgctgctgagctactacctgggcctgctgcccttcatccccatccccgagaagttcttcttctgcttcctgcccaacatcatcaacagaacctacttccccttcagctgcagctgcctgaaccagctgctggccgtggtgagcaagtggctgatcatgagaaagagcctgatcagacacctggaggagagaggcgtgcaggtggtgttctggtgcctgaacgaggagagcgacttcgaggccgccttcagcgtgggcgccaccggcgtgatcaccgactaccccaccgccctgagacactacctggacaaccacggccccgccgccagaaccagctag

SEQ ID NO: 18612 - DNA, 957 bp, Artificial Sequence
  Description of Artificial Sequence: Synthetic coding sequence
atgagcctgctgctgtactacgccctgcccgccctgggcagctacgccatgctgagcatcttcttcctgagaagaccccacctgctgcacacccccagagcccccaccttcagaatcagactgggcgcccacagaggcggcagcggcgagctgctggagaacaccatggaggccatggagaacagcatggcccagagaagcgacctgctggagctggactgccagctgaccagagacagagtggtggtggtgagccacgacgagaacctgtgcagacagagcggcctgaacagagacgtgggcagcctggacttcgaggacctgcccctgtacaaggagaagctggaggtgtacttcagccccggccacttcgcccacggcagcgacagaagaatggtgagactggaggacctgttccagagattccccagaacccccatgagcgtggagatcaagggcaagaacgaggagctgatcagagagatcgccggcctggtgagaagatacgacagaaacgagatcaccatctgggccagcgagaagagcagcgtgatgaagaagtgcaaggccgccaaccccgagatgcccctgagcttcaccatcagcagaggcttctgggtgctgctgagctactacctgggcctgctgcccttcatccccatccccgagaagttcttcttctgcttcctgcccaacatcatcaacagaacctacttccccttcagctgcagctgcctgaaccagctgctggccgtggtgagcaagtggctgatcatgagaaagagcctgatcagacacctggaggagagaggcgtgcaggtggtgttctggtgcctgaacgaggagagcgacttcgaggccgccttcagcgtgggcgccaccggcgtgatcaccgactaccccaccgccctgagacactacctggacaaccacggccccgccgccagaaccagctag

SEQ ID NO: 18613 - DNA, 1563 bp, Artificial Sequence
  Description of Artificial Sequence: Synthetic coding sequence
atgctgctgttcctgtggatcgagaccagcagcgagtacttcaacttcgactgggtgaccttcctgggcaccggctactggttcttctggagcatcttcatcctgagcctggccagaatcctgaccgcctacagcagcctgctgctgctgctgggcttcctgctgctgtgggagagaatcgagctgtacctgcacctgtgccacaagatcctgatcctgctggtgatcctgctgtgcgtgatcctgatgttcatcatctgcaagttctggaaggagagatggctggtggccggcctgagcatgcagatcttcgccccctacgtgcacctggtgagcatcaccgtgatggtgatcctgttctggcccgtggccttctacgtggcctgcctggagagagaggtgagaatgagaagatacagaatgacccacagcgagaagaagagactgaagcagtgcaacgtgatcaccagactgagaggcctgcaggtgcccgtgggcctgcccttcctgctgatcctgctgggcctgtacctgatgcccctgggcatctacagcccctgcatccaggagaaggagaacctgggccccaagcccaccatcttcggccacagaggcgcccccatgctgggccccgagaacaccatgatgagcttcgagaaggccgtggagcacggcgcccacggcctggagaccgacatccacctgagctacgaccacgtgcccttcctgatgcacgacttcgacctgaagagaaccaccaacatcggcgaggtgcagcccgagagcgcctgcgagaaccccgccttcttcaactgggacttcctgagcaccctgaacgccggcaagtggttcgtgaagcccgagctgagacccttctacaacatgaagcccctgagcgaggccgacaaggagagagccagaaaccagagcatccccaccctggccgacctgctgaccctggccgagaaggagagaaagttcgtgatcttcgacctgcacagacccccccccaagcaccccctgagacacaccttcgtgagacaggtggtgagcgtgatcctggccagcaagatcgagcagcacctgatcttctggctgcccgcccacgacagacagtacgtgagaagcgtggcccccggcttccagcacgtgggcagactggtgagcatcgagaccctggccaagaacaacatcagcatcatcaacgtggactacaagaagctgttccccaacggcctgagagactacaaggccgccaacatccacatcaacgtgtacaccgtgaacgagccctggctgttcagcctggcctggtgcagcagaatcaacagcgtgaccaccgacaacatcggcctgctgagccagctggaccacccccacttcttcatgacccccaagttctacgtgttcatgtggctgctggccgacatcatcagcgtgctgttcatcgtggccatcttctgcttccactggagaagagagaccgagaaggagaagctgttcgagaccagcagcaccagaaccgacacccagagcggcagcaagaacgaggaggacagatag

SEQ ID NO: 18614 - DNA, 1872 bp, Artificial Sequence
  Description of Artificial Sequence: Synthetic coding sequence
atgctgctgttcctgtggatcgagaccagcagcgagtacttcaacttcgactgggtgaccttcctgggcaccggctactggttcttctggagcatcttcatcctgagcctggccagaatcctgaccgcctacagcagcctgctgctgctgctgggcttcctgctgctgtgggagagaatcgagctgtacctgcacctgtgccacaagatcctgatcctgctggtgatcctgctgtgcgtgatcctgatgttcatcatctgcaagttctggaaggagagatggctggtggccggcctgagcatgcagatcttcgccccctacgtgcacctggtgagcatcaccgtgatggtgatcctgttctggcccgtggccttctacgtggcctgcctggagagagaggtgagaatgagaagatacagaatgacccacagcgagaagaagagactgaagcagtgcaacgtgatcaccagactgagaggcctgcaggtgcccgtgggcctgcccttcctgctgatcctgctgggcctgtacctgatgcccctgggcatctacagcccctgcatccaggagaaggagaacctgggccccaagcccaccatcttcggccacagaggcgcccccatgctgggccccgagaacaccatgatgagcttcgagaaggccgtggagcacggcgcccacggcctggagaccgacatccacctgagctacgaccacgtgcccttcctgatgcacgacttcgacctgaagagaaccaccaacatcggcgaggtgcagcccgagagcgcctgcgagaaccccgccttcttcaactgggacttcctgagcaccctgaacgccggcaagtggttcgtgaagcccgagctgagacccttctacaacatgaagcccctgagcgaggccgacaaggagagagccagaaaccagagcatccccaccctggccgacctgctgaccctggccgagaaggagagaaagttcgtgatcttcgacctgcacagacccccccccaagcaccccctgagacacaccttcgtgagacaggtggtgagcgtgatcctggccagcaagatcgagcagcacctgatcttctggctgcccgcccacgacagacagtacgtgagaagcgtggcccccggcttccagcacgtgggcagactggtgagcatcgagaccctggccaagaacaacatcagcatcatcaacgtggactacaagaagctgttccccaacggcctgagagactacaaggccgccaacatccacatcaacgtgtacaccgtgaacgagccctggctgttcagcctggcctggtgcagcagaatcaacagcgtgaccaccgacaacatcggcctgctgagccagctggaccacccccacttcttcatgacccccaagttctacgtgttcatgtggctgctggccgacatcatcagcgtgctgttcatcgtggccatcttctgcttccactggagaagagagaccgagaaggagaagctgttcgagaccagcagcaccagaaccgacacccagagcggcaacctgcacatcgccatgaagccccccgtgagagtggtggagggcccctggaccctggccgccctgtaccccgccctgcccaagagcggcaaggagcaccagggccacttcaacttcgccgcccccagcaagaagctgctgcccatcaagaacgccgtgacccccctgaagcccggcaagcacgagatccagccccccatgcccaccgtggtgttcgagctgacccaggcccccaccagacaggccaccagcgaggccaccttccagaccaccctgcccaccctgaaggtggacaagcccaccatgcccagcatcgaggtgccctacccctag

SEQ ID NO: 18615 - DNA, 1254 bp, Artificial Sequence
  Description of Artificial Sequence: Synthetic coding sequence
atgaccaccctggtgcccgccaccctgagcttcctgctgctgtggaccctgcccggccaggtgctgctgagagtggccctggccaaggaggaggtgaagagcggcaccaagggcagccagcccatgagccccagcgacttcctggacaagctgatgggcagaaccagcggctacgacgccagaatcagacccaacttcaagggcccccccgtgaacgtgacctgcaacatcttcatcaacagcttcagcagcatcaccaagaccaccatggactacagagtgaacgtgttcctgagacagcagtggaacgaccccagactgagctacagagagtaccccgacgacagcctggacctggaccccagcatgctggacagcatctggaagcccgacctgttcttcgccaacgagaagggcgccaacttccacgaggtgaccaccgacaacaagctgctgagaatcttcaagaacggcaacgtgctgtacagcatcagactgaccctgatcctgagctgcctgatggacctgaagaacttccccatggacatccagacctgcaccatgcagctggagagcttcggctacaccatgaaggacctggtgttcgagtggctggaggacgcccccgccgtgcaggtggccgagggcctgaccctgccccagttcatcctgagagacgagaaggacctgggctgctgcaccaagcactacaacaccggcaagttcacctgcatcgaggtgaagttccacctggagagacagatgggctactacctgatccagatgtacatccccagcctgctgatcgtgatcctgagctgggtgagcttctggatcaacatggacgccgcccccgccagagtgggcctgggcatcaccaccgtgctgaccatgaccacccagagcagcggcagcagagccagcctgcccaaggtgagctacgtgaaggccatcgacatctggatggccgtgtgcctgctgttcgtgttcgccgccctgctggagtacgccgccatcaacttcgtgagcagacagcacaaggagttcatcagactgagaagaagacagagaagacagagactggaggaggacatcatccaggagagcagattctacttcagaggctacggcctgggccactgcctgcaggccagagacggcggccccatggagggcagcggcatctacagcccccagccccccgcccccctgctgagagagggcgagaccaccagaaagctgtacgtggactag

SEQ ID NO: 18616 - DNA, 1002 bp, Artificial Sequence
  Description of Artificial Sequence: Synthetic coding sequence
atgttcaagctgtgcagcaacaagatggtgagccaggagggcagcgaggtggagctgctggtgagccccggcgccagaagcgagcacggcagatacctgcaggaccccatcgtgagcatcgacctgagcgagtggctgagaatcatcgagttcctgctgcagggcctgaaggtgtacggcagcgtgtaccacatcaaccacggcaaccccttcaacatggaggtgctggtggacagctggcccgagtaccagatggtgatcatcagaccccagaagcaggagatgaccgacgacatggacagctacaccaacgtgtacagaatgttcagcaaggagccccagaagagcgaggaggtgctgaagaactgcgagatcgtgaactggaagcagagactgcagatccagggcctgcaggagagcctgggcgagggcatcagagtggccaccttcagcaagagcgtgaaggtggagcacagcagagccctgctgctggtgaccgaggacatcctgaagctgaacgccagcagcaagagcaagctgggcagctgggccgagaccggccaccccgacgacgagttcgagagcgagacccccaacttcaagtacgcccagctggacgtgagctacagcggcctggtgaacgacaactggaagagaggcaagaacgagagaagcctgcactacatcaagagatgcatcgaggacctgcccgccgcctgcatgctgggccccgagggcgtgcccgtgagctgggtgaccatggaccccagctgcgaggtgggcatggcctacagcatggagaagtacagaagaaccggcaacatggccagagtgatggtgagatacatgaagtacctgagacagaagaacatccccttctacatcagcgtgctggaggagaacgaggacagcagaagattcgtgggccagttcggcttcttcgaggccagctgcgagtggcaccagtggacctgctacccccagaacctggtgcccttctag

SEQ ID NO: 18617 - DNA, 909 bp, Artificial Sequence
  Description of Artificial Sequence: Synthetic coding sequence
atgatcctgctgaacaacagccacaagctgctggccctgtacaagagcctggccagaagcatccccgagagcctgaaggtgtacggcagcgtgtaccacatcaaccacggcaaccccttcaacatggaggtgctggtggacagctggcccgagtaccagatggtgatcatcagaccccagaagcaggagatgaccgacgacatggacagctacaccaacgtgtacagaatgttcagcaaggagccccagaagagcgaggaggtgctgaagaactgcgagatcgtgaactggaagcagagactgcagatccagggcctgcaggagagcctgggcgagggcatcagagtggccaccttcagcaagagcgtgaaggtggagcacagcagagccctgctgctggtgaccgaggacatcctgaagctgaacgccagcagcaagagcaagctgggcagctgggccgagaccggccaccccgacgacgagttcgagagcgagacccccaacttcaagtacgcccagctggacgtgagctacagcggcctggtgaacgacaactggaagagaggcaagaacgagagaagcctgcactacatcaagagatgcatcgaggacctgcccgccgcctgcatgctgggccccgagggcgtgcccgtgagctgggtgaccatggaccccagctgcgaggtgggcatggcctacagcatggagaagtacagaagaaccggcaacatggccagagtgatggtgagatacatgaagtacctgagacagaagaacatccccttctacatcagcgtgctggaggagaacgaggacagcagaagattcgtgggccagttcggcttcttcgaggccagctgcgagtggcaccagtggacctgctacccccagaacctggtgcccttctag

SEQ ID NO: 18618 - DNA, 840 bp, Artificial Sequence
  Description of Artificial Sequence: Synthetic coding sequence
atgatcctgctgaacaacagccacaagctgctggccctgtacaagagcctggccagaagcatccccgagagcctgaaggtgtacggcagcgtgtaccacatcaaccacggcaaccccttcaacatggaggtgctggtggacagctggcccgagtaccagatggtgatcatcagaccccagaagagcgaggaggtgctgaagaactgcgagatcgtgaactggaagcagagactgcagatccagggcctgcaggagagcctgggcgagggcatcagagtggccaccttcagcaagagcgtgaaggtggagcacagcagagccctgctgctggtgaccgaggacatcctgaagctgaacgccagcagcaagagcaagctgggcagctgggccgagaccggccaccccgacgacgagttcgagagcgagacccccaacttcaagtacgcccagctggacgtgagctacagcggcctggtgaacgacaactggaagagaggcaagaacgagagaagcctgcactacatcaagagatgcatcgaggacctgcccgccgcctgcatgctgggccccgagggcgtgcccgtgagctgggtgaccatggaccccagctgcgaggtgggcatggcctacagcatggagaagtacagaagaaccggcaacatggccagagtgatggtgagatacatgaagtacctgagacagaagaacatccccttctacatcagcgtgctggaggagaacgaggacagcagaagattcgtgggccagttcggcttcttcgaggccagctgcgagtggcaccagtggacctgctacccccagaacctggtgcccttctag

SEQ ID NO: 18619 - DNA, 207 bp, Artificial Sequence
  Description of Artificial Sequence: Synthetic coding sequence
atgatcctgctgaacaacagccacaagctgctggccctgtacaagagcctggccagaagcatccccgagagcctgaaggtgtacggcagcgtgtaccacatcaaccacggcaaccccttcaacatggaggtgctggtggacagctggcccgagtaccagatggtgatcatcagaccccagaagcaggagatgaccgacgacatgtag

SEQ ID NO: 18620 - DNA, 240 bp, Artificial Sequence
  Description of Artificial Sequence: Synthetic coding sequence
atgatcctgctgaacaacagccacaagctgctggccctgtacaagagcctggccagaagcatccccgagagcctgaaggtgtacggcagcgtgtaccacatcaaccacggcaaccccttcaacatggaggtgctggtggacagctggcccgagtaccagatggtgatcatcagaccccagaagcaggagatgaccgacgacatggacagctacaccaacgtgtacagaatgttcagctag

SEQ ID NO: 18621 - DNA, 885 bp, Artificial Sequence
  Description of Artificial Sequence: Synthetic coding sequence
atgctggtgctgcacaacagccagaagctgcagatcctgtacaagagcctggagaagagcatccccgagagcatcaaggtgtacggcgccatcttcaacatcaaggacaagaaccccttcaacatggaggtgctggtggacgcctggcccgactaccagatcgtgatcaccagaccccagaagcaggagatgaaggacgaccaggaccactacaccaacacctaccacatcttcaccaaggcccccgacaagctggaggaggtgctgagctacagcaacgtgatcagctgggagcagaccctgcagatccagggctgccaggagggcctggacgaggccatcagaaaggtggccaccagcaagagcgtgcaggtggactacatgaagaccatcctgttcatccccgagctgcccaagaagcacaagaccagcagcaacgacaagatggagctgttcgaggtggacgacgacaacaaggagggcaacttcagcaacatgttcctggacgccagccacgccggcctggtgaacgagcactgggccttcggcaagaacgagagaagcctgaagtacatcgagagatgcctgcaggacttcctgggcttcggcgtgctgggccccgagggccagctggtgagctggatcgtgatggagcagagctgcgagctgagaatgggctacaccgtgcccaagtacagacaccagggcaacatgctgcagatcggctaccacctggagaagtacctgagccagaaggagatccccttctacttccacgtggccgacaacaacgagaagagcctgcaggccctgaacaacctgggcttcaagatctgcccctgcggctggcaccagtggaagtgcacccccaagaagtactgctag

SEQ ID NO: 18622 - DNA, 885 bp, Artificial Sequence; identical to SEQ ID NO: 18621
  Description of Artificial Sequence: Synthetic coding sequence

SEQ ID NO: 18623 - DNA, 867 bp, Artificial Sequence
  Description of Artificial Sequence: Synthetic coding sequence
atgctggtgctgaactgcagcaccaagctgctgatcctggagaagatgctgaagagctgcttccccgagagcctgaaggtgtacggcgccgtgatgaacatcaacagaggcaaccccttccagaaggaggtggtgctggacagctggcccgacttcaaggccgtgatcaccagaagacagagagaggccgagaccgacaacctggaccactacaccaacgcctacgccgtgttctacaaggacgtgagagcctacagacagctgctggaggagtgcgacgtgttcaactgggaccaggtgttccagatccagggcctgcagagcgagctgtacgacgtgagcaaggccgtggccaacagcaagcagctgaacatcaagctgaccagcttcaaggccgtgcacttcagccccgtgagcagcctgcccgacaccagcttcctgaagggccccagccccagactgacctacctgagcgtggccaacgccgacctgctgaacagaacctggagcagaggcggcaacgagcagtgcctgagatacatcgccaacctgatcagctgcttccccagcgtgtgcgtgagagacgagaagggcaaccccgtgagctggagcatcaccgaccagttcgccaccatgtgccacggctacaccctgcccgagcacagaagaaagggctacagcagactggtggccctgaccctggccagaaagctgcagagcagaggcttccccagccagggcaacgtgctggacgacaacaccgccagcatcagcctgctgaagagcctgcacgccgagttcctgccctgcagattccacagactgatcctgacccccgccaccttcagcggcctgccccacctgtag

SEQ ID NO: 18624 - DNA, 471 bp, Artificial Sequence
  Description of Artificial Sequence: Synthetic coding sequence
atgctggtgctgaactgcagcaccaagctgctgatcctggagaagatgctgaagagctgcttccccgagagcctgaaggtgtacggcgccgtgatgaacatcaacagaggcaaccccttccagaaggaggtggtgctggacagctggcccgacttcaaggccgtgatcaccagaagacagagagaggccgagaccgacaacctggaccactacaccaacgcctacgccgtgttctacaaggacgtgagagcctacagacagctgctggaggagtgcgacgtgttcaactgggaccaggtgttccagatccagggcctgcagagcgagctgtacgacgtgagcaaggccgtggccaacagcaagcagctgaacatcaagctgaccagcttcaaggccgtgcacttcagccccgtgagcagcctgcccgacaccagcttcctgaagggccccagccccagactgacctactag

SEQ ID NO: 18625 - DNA, 1683 bp, Artificial Sequence
  Description of Artificial Sequence: Synthetic coding sequence
atggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacgagaagctgtaccccgtgtggaagagaggcgacatgagatggaagaacagctggaagggcggcagagtgcaggccgtgctgaccagcgacagccccgccctggtgggcagcaacatcaccttcgccgtgaacctgatcttccccagatgccagaaggaggacgccaacggcaacatcgtgtacgagaagaactgcagaaacgaggccggcctgagcgccgacccctacgtgtacaactggaccgcctggagcgaggacagcgacggcgagaacggcaccggccagagccaccacaacgtgttccccgacggcaagcccttcccccaccaccccggctggagaagatggaacttcatctacgtgttccacaccctgggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctgggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18626 - DNA, 1719 bp, Artificial Sequence
  Description of Artificial Sequence: Synthetic coding sequence
atggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacgagaagctgtaccccgtgtggaagagaggcgacatgagatggaagaacagctggaagggcggcagagtgcaggccgtgctgaccagcgacagccccgccctggtgggcagcaacatcaccttcgccgtgaacctgatcttccccagatgccagaaggaggacgccaacggcaacatcgtgtacgagaagaactgcagaaacgaggccggcctgagcgccgacccctacgtgtacaactggaccgcctggagcgaggacagcgacggcgagaacggcaccggccagagccaccacaacgtgttccccgacggcaagcccttcccccaccaccccggctggagaagatggaacttcatctacgtgttccacaccctgggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctggccaccaccctgaagagctacgacagcaacacccccggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18627 - DNA, 621 bp, Artificial Sequence
  Description of Artificial Sequence: Synthetic coding sequence
atggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacgagaagctgtaccccgtgtggaagagaggcgacatgagatggaagaacagctggaagggcggcagagtgcaggccgtgctgaccagcgacagccccgccctggtgggcagcaacatcaccttcgccgtgaacctgatcttccccagatgccagaaggaggacgccaacggcaacatcgtgtacgagaagaactgcagaaacgaggccggcctgagcgccgacccctacgtgtacaactggaccgcctggagcgaggacagcgacggcgagaacggcaccggccagagccaccacaacgtgttccccgacggcaagcccttcccccaccaccccggctggagaagatggaacttcatctacgtgttccacaccctgggctggctgctgcagacccccaagctgctgctgtacctgagcctgaagttccagcccagcctgttcctgctgtacaactag

SEQ ID NO: 18628 - DNA, 1368 bp, Artificial Sequence
  Description of Artificial Sequence: Synthetic coding sequence
atggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacttcatctacgtgttccacaccctgggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctggccaccaccctgaagagctacgacagcaacacccccggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18629 - DNA, 1824 bp, Artificial Sequence
  Description of Artificial Sequence: Synthetic coding sequence
atgatcctgcccgaggccctgtacctgatcaagatcgagagagaggccccccagatgcccgaggagcactgctgcagctggtggaccggccccgaggagttcagcatggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacgagaagctgtaccccgtgtggaagagaggcgacatgagatggaagaacagctggaagggcggcagagtgcaggccgtgctgaccagcgacagccccgccctggtgggcagcaacatcaccttcgccgtgaacctgatcttccccagatgccagaaggaggacgccaacggcaacatcgtgtacgagaagaactgcagaaacgaggccggcctgagcgccgacccctacgtgtacaactggaccgcctggagcgaggacagcgacggcgagaacggcaccggccagagccaccacaacgtgttccccgacggcaagcccttcccccaccaccccggctggagaagatggaacttcatctacgtgttccacaccctgggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctggccaccaccctgaagagctacgacagcaacacccccggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18630 - DNA, 1545 bp, Artificial Sequence
  Description of Artificial Sequence: Synthetic coding sequence
atggagtgcctgtactacttcctgggcttcctgctgctggccgccagactgcccctggacgccgccaagagattccacgacgtgctgggcaacgagagacccagcgcctacatgagagagcacaaccagctgaacggctggagcagcgacgagaacgactggaacgagaagctgtaccccgtgtggaagagaggcgacatgagatggaagaacagctggaagggcggcagagtgcaggccgtgctgaccagcgacagccccgccctggtgggcagcaacatcaccttcgccgtgaacctgatcttccccagatgccagaaggaggacgccaacggcaacatcgtgtacgagaagaactgcagaaacggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctggccaccaccctgaagagctacgacagcaacacccccggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18631 - DNA, 1386 bp, Artificial Sequence
  Description of Artificial Sequence: Synthetic coding sequence
atggagtgcctgtactacttcctgggcttcctgctgctggccgccagactgcccctggacgccgccaagcaggccggcctgagcgccgacccctacgtgtacaactggaccgcctggagcgaggacagcgacggcgagaacggcaccggccagagccaccacaacgtgttccccgacggcaagcccttcccccaccaccccggctggagaagatggaacttcatctacgtgttccacaccctgggccagtacttccagaagctgggcagatgcagcgtgagagtgagcgtgaacaccgccaacgtgaccctgggcccccagctgatggaggtgaccgtgtacagaagacacggcagagcctacgtgcccatcgcccaggtgaaggacgtgtacgtggtgaccgaccagatccccgtgttcgtgaccatgttccagaagaacgacagaaacagcagcgacgagaccttcctgaaggacctgcccatcatgttcgacgtgctgatccacgaccccagccacttcctgaactacagcaccatcaactacaagtggagcttcggcgacaacaccggcctgttcgtgagcaccaaccacaccgtgaaccacacctacgtgctgaacggcaccttcagcctgaacctgaccgtgaaggccgccgcccccggcccctgccccccccccccccccccccccagacccagcaagcccacccccagcctgggccccgccggcgacaaccccctggagctgagcagaatccccgacgagaactgccagatcaacagatacggccacttccaggccaccatcaccatcgtggagggcatcctggaggtgaacatcatccagatgaccgacgtgctgatgcccgtgccctggcccgagagcagcctgatcgacttcgtggtgacctgccagggcagcatccccaccgaggtgtgcaccatcatcagcgaccccacctgcgagatcacccagaacaccgtgtgcagccccgtggacgtggacgagatgtgcctgctgaccgtgagaagaaccttcaacggcagcggcacctactgcgtgaacctgaccctgggcgacgacaccagcctggccctgaccagcaccctgatcagcgtgcccgacagagaccccgccagccccctgagaatggccaacagcgccctgatcagcgtgggctgcctggccatcttcgtgaccgtgatcagcctgctggtgtacaagaagcacaaggagtacaaccccatcgagaacagccccggcaacgtggtgagaagcaagggcctgagcgtgttcctgaacagagccaaggccgtgttcttccccggcaaccaggagaaggaccccctgctgaagaaccaggagttcaagggcgtgagctag

SEQ ID NO: 18632 - DNA, 960 bp, Artificial Sequence
  Description of Artificial Sequence: Synthetic coding sequence
atggtgggcaagatgtggcccgtgctgtggaccctgtgcgccgtgagagtgaccgtggacgccatcagcgtggagaccccccaggacgtgctgagagccagccagggcaagagcgtgaccctgccctgcacctaccacaccagcaccagcagcagagagggcctgatccagtgggacaagctgctgctgacccacaccgagagagtggtgatctggcccttcagcaacaagaactacatccacggcgagctgtacaagaacagagtgagcatcagcaacaacgccgagcagagcgacgccagcatcaccatcgaccagctgaccatggccgacaacggcacctacgagtgcagcgtgagcctgatgagcgacctggagggcaacaccaagagcagagtgagactgctggtgctggtgccccccagcaagcccgagtgcggcatcgagggcgagaccatcatcggcaacaacatccagctgacctgccagagcaaggagggcagccccaccccccagtacagctggaagagatacaacatcctgaaccaggagcagcccctggcccagcccgccagcggccagcccgtgagcctgaagaacatcagcaccgacaccagcggctactacatctgcaccagcagcaacgaggagggcacccagttctgcaacatcaccgtggccgtgagaagccccagcatgaacgtggccctgtacgtgggcatcgccgtgggcgtggtggccgccctgatcatcatcggcatcatcatctactgctgctgctgcagaggcaaggacgacaacaccgaggacaaggaggacgccagacccaacagagaggcctacgaggagccccccgagcagctgagagagctgagcagagagagagaggaggaggacgactacagacaggaggagcagagaagcaccggcagagagagccccgaccacctggaccagtag

SEQ ID NO: 18633 - DNA, 1683 bp, Artificial Sequence
  Description of Artificial Sequence: Synthetic coding sequence
atgctgagaggcaccctgctgtgcgccgtgctgggcctgctgagagcccagcccttcccctgcccccccgcctgcaagtgcgtgttcagagacgccgcccagtgcagcggcggcgacgtggccagaatcagcgccctgggcctgcccaccaacctgacccacatcctgctgttcggcatgggcagaggcgtgctgcagagccagagcttcagcggcatgaccgtgctgcagagactgatgatcagcgacagccacatcagcgccgtggcccccggcaccttcagcgacctgatcaagctgaagaccctgagactgagcagaaacaagatcacccacctgcccggcgccctgctggacaagatggtgctgctggagcagctgttcctggaccacaacgccctgagaggcatcgaccagaacatgttccagaagctggtgaacctgcaggagctggccctgaaccagaaccagctggacttcctgcccgccagcctgttcaccaacctggagaacctgaagctgctggacctgagcggcaacaacctgacccacctgcccaagggcctgctgggcgcccaggccaagctggagagactgctgctgcacagcaacagactggtgagcctggacagcggcctgctgaacagcctgggcgccctgaccgagctgcagttccacagaaaccacatcagaagcatcgcccccggcgccttcgacagactgcccaacctgagcagcctgaccctgagcagaaaccacctggccttcctgcccagcgccctgttcctgcacagccacaacctgaccctgctgaccctgttcgagaaccccctggccgagctgcccggcgtgctgttcggcgagatgggcggcctgcaggagctgtggctgaacagaacccagctgagaaccctgcccgccgccgccttcagaaacctgagcagactgagatacctgggcgtgaccctgagccccagactgagcgccctgccccagggcgccttccagggcctgggcgagctgcaggtgctggccctgcacagcaacggcctgaccgccctgcccgacggcctgctgagaggcctgggcaagctgagacaggtgagcctgagaagaaacagactgagagccctgcccagagccctgttcagaaacctgagcagcctggagagcgtgcagctggaccacaaccagctggagaccctgcccggcgacgtgttcggcgccctgcccagactgaccgaggtgctgctgggccacaacagctggagatgcgactgcggcctgggccccttcctgggctggctgagacagcacctgggcctggtgggcggcgaggagccccccagatgcgccggccccggcgcccacgccggcctgcccctgtgggccctgcccggcggcgacgccgagtgccccggccccagaggccccccccccagacccgccgccgacagcagcagcgaggcccccgtgcaccccgccctggcccccaacagcagcgagccctgggtgtgggcccagcccgtgaccaccggcaagggccaggaccacagccccttctggggcttctacttcctgctgctggccgtgcaggccatgatcaccgtgatcatcgtgttcgccatgatcaagatcggccagctgttcagaaagctgatcagagagagagccctgggctag

SEQ ID NO: 18634 - DNA, 1683 bp, Artificial Sequence; identical to SEQ ID NO: 18633
  Description of Artificial Sequence: Synthetic coding sequence

SEQ ID NO: 18635 - DNA, 1869 bp, Artificial Sequence
  Description of Artificial Sequence: Synthetic coding sequence
atggccgccgcccccagagccggcagaagaagaggccagcccctgctggccctgctgctgctgctgctggcccccctgccccccggcgccccccccggcgccgacgcctacttccccgaggagagatggagccccgagagccccctgcaggcccccagagtgctgatcgccctgctggccagaaacgccgcccacgccctgcccaccaccctgggcgccctggagagactgagacaccccagagagagaaccgccctgtgggtggccaccgaccacaacatggacaacaccagcaccgtgctgagagagtggctggtggccgtgaagagcctgtaccacagcgtggagtggagacccgccgaggagcccagaagctaccccgacgaggagggccccaagcactggagcgacagcagatacgagcacgtgatgaagctgagacaggccgccctgaagagcgccagagacatgtgggccgactacatcctgttcgtggacgccgacaacctgatcctgaaccccgacaccctgagcctgctgatcgccgagaacaagaccgtggtggcccccatgctggacagcagagccgcctacagcaacttctggtgcggcatgaccagccagggctactacaagagaacccccgcctacatccccatcagaaagagagacagaagaggctgcttcgccgtgcccatggtgcacagcaccttcctgatcgacctgagaaaggccgccagcagaaacctggccttctaccccccccaccccgactacacctggagcttcgacgacatcatcgtgttcgccttcagctgcaagcaggccgaggtgcagatgtacgtgtgcaacaaggaggagtacggcttcctgcccgtgcccctgagagcccacagcaccctgcaggacgaggccgagagcttcatgcacgtgcagctggaggtgatggtgaagcacccccccgccgagcccagcagattcatcagcgcccccaccaagacccccgacaagatgggcttcgacgaggtgttcatgatcaacctgagaagaagacaggacagaagagagagaatgctgagagccctgcaggcccaggagatcgagtgcagactggtggaggccgtggacggcaaggccatgaacaccagccaggtggaggccctgggcatccagatgctgcccggctacagagacccctaccacggcagacccctgaccaagggcgagctgggctgcttcctgagccactacaacatctggaaggaggtggtggacagaggcctgcagaagagcctggtgttcgaggacgacctgagattcgagatcttcttcaagagaagactgatgaacctgatgagagacgtggagagagagggcctggactgggacctgatctacgtgggcagaaagagaatgcaggtggagcaccccgagaaggccgtgcccagagtgagaaacctggtggaggccgactacagctactggaccctggcctacgtgatcagcctgcagggcgccagaaagctgctggccgccgagcccctgagcaagatgctgcccgtggacgagttcctgcccgtgatgttcgacaagcaccccgtgagcgagtacaaggcccacttcagcctgagaaacctgcacgccttcagcgtggagcccctgctgatctaccccacccactacaccggcgacgacggctacgtgagcgacaccgagaccagcgtggtgtggaacaacgagcacgtgaagaccgactgggacagagccaagagccagaagatgagagagcagcaggccctgagcagagaggccaagaacagcgacgtgctgcagagccccctggacagcgccgccagagacgagctgtag

SEQ ID NO: 18636 - DNA, 702 bp, Artificial Sequence
  Description of Artificial Sequence: Synthetic coding sequence
atggtgcacagcaccttcctgatcgacctgagaaaggccgccagcagaaacctggccttctaccccccccaccccgactacacctggagcttcgacgacatcatcgtgttcgccttcagctgcaagcaggccgtgaagcacccccccgccgagcccagcagattcatcagcgcccccaccaagacccccgacaagatgggcttcgacgaggtgttcatgatcaacctgagaagaagacaggacagaagagagagaatgctgagagccctgcaggcccaggagatcgagtgcagactggtggaggccgtggacggcaaggccatgaacaccagccaggtggaggccctgggcatccagatgctgcccggctacagagacccctaccacggcagacccctgaccaagggcgagctgggctgcttcctgagccactacaacatctggaaggaggtggtggacagaggcctgcagaagagcctggtgttcgaggacgacctgagattcgagatcttcttcaagagaagactgatgaacctgatgagagacgtggagagagagggcctggactgggacctgatctacgtgggcagaaagagaatgcaggtggagcaccccgagaaggccgtgcccagagtgagaaacctggtggaggccgactacagctactggaccgtgctgcccggcatgaacagcgagggctag

SEQ ID NO: 18637 - DNA, 1881 bp, Artificial Sequence
  Description of Artificial Sequence: Synthetic coding sequence
atggccgccagacccgccgccaccctggcctggagcctgctgctgctgagcagcgccctgctgagagagggctgcagagccagattcgtggccgagagagacagcgaggacgacggcgaggagcccgtggtgttccccgagagccccctgcagagccccaccgtgctggtggccgtgctggccagaaacgccgcccacaccctgccccacttcctgggctgcctggagagactggactaccccaagagcagaatggccatctgggccgccaccgaccacaacgtggacaacaccaccgagatcttcagagagtggctgaagaacgtgcagagactgtaccactacgtggagtggagacccatggacgagcccgagagctaccccgacgagatcggccccaagcactggcccaccagcagattcgcccacgtgatgaagctgagacaggccgccctgagaaccgccagagagaagtggagcgactacatcctgttcatcgacgtggacaacttcctgaccaacccccagaccctgaacctgctgatcgccgagaacaagaccatcgtggcccccatgctggagagcagaggcctgtacagcaacttctggtgcggcatcacccccaagggcttctacaagagaacccccgactacgtgcagatcagagagtggaagagaaccggctgcttccccgtgcccatggtgcacagcaccttcctgatcgacctgagaaaggaggccagcgacaagctgaccttctaccccccccaccaggactacacctggaccttcgacgacatcatcgtgttcgccttcagcagcagacaggccggcatccagatgtacctgtgcaacagagagcactacggctacctgcccatccccctgaagccccaccagaccctgcaggaggacatcgagaacctgatccacgtgcagatcgaggccatgatcgacagaccccccatggagcccagccagtacgtgagcgtggtgcccaagtaccccgacaagatgggcttcgacgagatcttcatgatcaacctgaagagaagaaaggacagaagagacagaatgctgagaaccctgtacgagcaggagatcgaggtgaagatcgtggaggccgtggacggcaaggccctgaacaccagccagctgaaggccctgaacatcgagatgctgcccggctacagagacccctacagcagcagacccctgaccagaggcgagatcggctgcttcctgagccactacagcgtgtggaaggaggtgatcgacagagagctggagaagaccctggtgatcgaggacgacgtgagattcgagcaccagttcaagaagaagctgatgaagctgatggacaacatcgaccaggcccagctggactgggagctgatctacatcggcagaaagagaatgcaggtgaaggagcccgagaaggccgtgcccaacgtggccaacctggtggaggccgactacagctactggaccctgggctacgtgatcagcctggagggcgcccagaagctggtgggcgccaaccccttcggcaagatgctgcccgtggacgagttcctgcccgtgatgtacaacaagcaccccgtggccgagtacaaggagtactacgagagcagagacctgaaggccttcagcgccgagcccctgctgatctaccccacccactacaccggccagcccggctacctgagcgacaccgagaccagcaccatctgggacaacgagaccgtggccaccgactgggacagaacccacgcctggaagagcagaaagcagagcagaatctacagcaacgccaagaacaccgaggccctgcccccccccaccagcctggacaccgtgcccagcagagacgagctgtag

SEQ ID NO: 18638 - DNA, 1092 bp, Artificial Sequence
  Description of Artificial Sequence: Synthetic coding sequence
atgttcagcgactgctggctgtgccccagcctgggcagcagcggcatccagatgtacctgtgcaacagagagcactacggctacctgcccatccccctgaagccccaccagaccctgcaggaggacatcgagaacctgatccacgtgcagatcgaggccatgatcgacagaccccccatggagcccagccagtacgtgagcgtggtgcccaagtaccccgacaagatgggcttcgacgagatcttcatgatcaacctgaagagaagaaaggacagaagagacagaatgctgagaaccctgtacgagcaggagatcgaggtgaagatcgtggaggccgtggacggcaaggccctgaacaccagccagctgaaggccctgaacatcgagatgctgcccggctacagagacccctacagcagcagacccctgaccagaggcgagatcggctgcttcctgagccactacagcgtgtggaaggaggtgatcgacagagagctggagaagaccctggtgatcgaggacgacgtgagattcgagcaccagttcaagaagaagctgatgaagctgatggacaacatcgaccaggcccagctggactgggagctgatctacatcggcagaaagagaatgcaggtgaaggagcccgagaaggccgtgcccaacgtggccaacctggtggaggccgactacagctactggaccctgggctacgtgatcagcctggagggcgcccagaagctggtgggcgccaaccccttcggcaagatgctgcccgtggacgagttcctgcccgtgatgtacaacaagcaccccgtggccgagtacaaggagtactacgagagcagagacctgaaggccttcagcgccgagcccctgctgatctaccccacccactacaccggccagcccggctacctgagcgacaccgagaccagcaccatctgggacaacgagaccgtggccaccgactgggacagaacccacgcctggaagagcagaaagcagagcagaatctacagcaacgccaagaacaccgaggccctgcccccccccaccagcctggacaccgtgcccagcagagacgagctgtag

SEQ ID NO: 18639 - DNA, 705 bp, Artificial Sequence
  Description of Artificial Sequence: Synthetic coding sequence
atgctgcccggctacagagacccctacagcagcagacccctgaccagaggcgagatcggctgcttcctgagccactacagcgtgtggaaggaggtgatcgacagagagctggagaagaccctggtgatcgaggacgacgtgagattcgagcaccagttcaagaagaagctgatgaagctgatggacaacatcgaccaggcccagctggactgggagctgatctacatcggcagaaagagaatgcaggtgaaggagcccgagaaggccgtgcccaacgtggccaacctggtggaggccgactacagctactggaccctgggctacgtgatcagcctggagggcgcccagaagctggtgggcgccaaccccttcggcaagatgctgcccgtggacgagttcctgcccgtgatgtacaacaagcaccccgtggccgagtacaaggagtactacgagagcagagacctgaaggccttcagcgccgagcccctgctgatctaccccacccactacaccggccagcccggctacctgagcgacaccgagaccagcaccatctgggacaacgagaccgtggccaccgactgggacagaacccacgcctggaagagcagaaagcagagcagaatctacagcaacgccaagaacaccgaggccctgcccccccccaccagcctggacaccgtgcccagcagagacgagctgtag

SEQ ID NO: 18640 - DNA, 1665 bp, Artificial Sequence
  Description of Artificial Sequence: Synthetic coding sequence
atggccgccagacccgccgccaccctggcctggagcctgctgctgctgagcagcgccctgctgagagagggctgcagagccagattcgtggccgagagagacagcgaggacgacggcgaggagcccgtggtgttccccgagagccccctgcagagccccaccgtgctggtggccgtgctggccagaaacgccgcccacaccctgccccacttcctgggctgcctggagagactggactaccccaagagcagaatggccatctgggccgccaccgaccacaacgtggacaacaccaccgagatcttcagagagtggctgaagaacgtgcagagactgtaccactacgtggagtggagacccatggacgagcccgagagctaccccgacgagatcggccccaagcactggcccaccagcagattcgcccacgtgatgaagctgagacaggccgccctgagaaccgccagagagaagtggagcgactacatcctgttcatcgacgtggacaacttcctgaccaacccccagaccctgaacctgctgatcgccgagaacaagaccatcgtggcccccatgctggagagcagaggcctgtacagcaacttctggtgcggcatcacccccaagggcttctacaagagaacccccgactacgtgcagatcagagagtggaagagaaccggctgcttccccgtgcccatggtgcacagcaccttcctgatcgacctgagaaaggaggccagcgacaagctgaccttctaccccccccaccaggactacacctggaccttcgacgacatcatcgtgttcgccttcagcagcagacaggccggcatccagatgtacctgtgcaacagagagcactacggctacctgcccatccccctgaagccccaccagaccctgcaggaggacatcgagaacctgatccacgtgcagatcgaggccatgatcgacagaccccccatggagcccagccagtacgtgagcgtggtgcccaagtaccccgacaagatgggcttcgacgagatcttcatgatcaacctgaagagaagaaaggacagaagagacagaatgctgagaaccctgtacgagcaggagatcgaggtgaagatcgtggaggccgtggacggcaaggccctgaacaccagccagctgaaggccctgaacatcgagatgctgcccggctacagagacccctacagcagcagacccctgaccagaggcgagatcggctgcttcctgagccactacagcgtgtggaaggaggtgatcgacagagagctggagaagaccctggtgatcgaggacgacgtgagattcgagcaccagttcaagaagaagctgatgaagctgatggacaacatcgaccaggcccagctggactgggagctgatctacatcggcagaaagagaatgcaggtgaaggagcccgagaaggccgtgcccaacgtggccaacctggtggaggccgactacagctactggaccctgggctacgtgatcagcctggagggcgcccagaagctggtgggcgccaaccccttcggcaagatgctgcccgtggacgagttcctgcccgtgatgtacaacaagcaccccgtgctgctgagcagcccccactgccacctgttccagaccctgagcgacgactgccagagatag

SEQ ID NO: 18641 - DNA, 1050 bp, Artificial Sequence
  Description of Artificial Sequence: Synthetic coding sequence
atggccctgctgagaaagatcaaccaggtgctgctgttcctgctgatcgtgaccctgtgcgtgatcctgtacaagaaggtgcacaagggcaccgtgcccaagaacgacgccgacgacgagagcgagacccccgaggagctggaggaggagatccccgtggtgatctgcgccgccgccggcagaatgggcgccaccatggccgccatcaacagcatctacagcaacaccgacgccaacatcctgttctacgtggtgggcctgagaaacaccctgaccagaatcagaaagtggatcgagcacagcaagctgagagagatcaacttcaagatcgtggagttcaaccccatggtgctgaagggcaagatcagacccgacagcagcagacccgagctgctgcagcccctgaacttcgtgagattctacctgcccctgctgatccaccagcacgagaaggtgatctacctggacgacgacgtgatcgtgcagggcgacatccaggagctgtacgacaccaccctggccctgggccacgccgccgccttcagcgacgactgcgacctgcccagcgcccaggacatcaacagactggtgggcctgcagaacacctacatgggctacctggactacagaaagaaggccatcaaggacctgggcatcagccccagcacctgcagcttcaaccccggcgtgatcgtggccaacatgaccgagtggaagcaccagagaatcaccaagcagctggagaagtggatgcagaagaacgtggaggagaacctgtacagcagcagcctgggcggcggcgtggccaccagccccatgctgatcgtgttccacggcaagtacagcaccatcaaccccctgtggcacatcagacacctgggctggaaccccgacgccagatacagcgagcacttcctgcaggaggccaagctgctgcactggaacggcagacacaagccctgggacttccccagcgtgcacaacgacctgtgggagagctggttcgtgcccgaccccgccggcatcttcaagctgaaccaccacagctag

SEQ ID NO: 18642 - DNA, 1050 bp, Artificial Sequence; identical to SEQ ID NO: 18641
  Description of Artificial Sequence: Synthetic coding sequence

SEQ ID NO: 18643 - DNA, 1050 bp, Artificial Sequence; identical to SEQ ID NO: 18641
  Description of Artificial Sequence: Synthetic coding sequence

SEQ ID NO: 18644 - DNA, 942 bp, Artificial Sequence
  Description of Artificial Sequence: Synthetic coding sequence
atggccgccagaagagccctgcacttcgtgttcaaggtgggcaacagattccagaccgccagattctacagagacgtgctgggcatgaaggtggagagctgcagcgtggccagactggagtgcagcggcgccatcagcgcccactgcagcgactacaccagaatcaccgaggacagcttcagcaagccctacgacggcaagtggagcaagaccatggtgggcttcggccccgaggacgaccacttcgtggccgagctgacctacaactacggcgtgggcgactacaagctgggcaacgacttcatgggcatcaccctggccagcagccaggccgtgagcaacgccagaaagctggagtggcccctgaccgaggtggccgagggcgtgttcgagaccgaggcccccggcggctacaagttctacctgcagaacagaagcctgccccagagcgaccccgtgctgaaggtgaccctggccgtgagcgacctgcagaagagcctgaactactggtgcaacctgctgggcatgaagatctacgagaaggacgaggagaagcagagagccctgctgggctacgccgacaaccagtgcaagctggagctgcagggcgtgaagggcggcgtggaccacgccgccgccttcggcagaatcgccttcagctgcccccagaaggagctgcccgacctggaggacctgatgaagagagagaaccagaagatcctgacccccctggtgagcctggacacccccggcaaggccaccgtgcaggtggtgatcctggccgaccccgacggccacgagatctgcttcgtgggcgacgaggccttcagagagctgagcaagatggaccccgagggcagcaagctgctggacgacgccatggccgccgacaagagcgacgagtggttcgccaagcacaacaagcccaaggccagcggctag

SEQ ID NO: 18645 - DNA, 897 bp, Artificial Sequence
  Description of Artificial Sequence: Synthetic coding sequence
atggccgccagaagagccctgcacttcgtgttcaaggtgggcaacagattccagaccgccagattctacagagacgtgctgggcatgaaggtgctgagacacgaggagttcgaggagggctgcaaggccgcctgcaacggcccctacgacggcaagtggagcaagaccatggtgggcttcggccccgaggacgaccacttcgtggccgagctgacctacaactacggcgtgggcgactacaagctgggcaacgacttcatgggcatcaccctggccagcagccaggccgtgagcaacgccagaaagctggagtggcccctgaccgaggtggccgagggcgtgttcgagaccgaggcccccggcggctacaagttctacctgcagaacagaagcctgccccagagcgaccccgtgctgaaggtgaccctggccgtgagcgacctgcagaagagcctgaactactggtgcaacctgctgggcatgaagatctacgagaaggacgaggagaagcagagagccctgctgggctacgccgacaaccagtgcaagctggagctgcagggcgtgaagggcggcgtggaccacgccgccgccttcggcagaatcgccttcagctgcccccagaaggagctgcccgacctggaggacctgatgaagagagagaaccagaagatcctgacccccctggtgagcctggacacccccggcaaggccaccgtgcaggtggtgatcctggccgaccccgacggccacgagatctgcttcgtgggcgacgaggccttcagagagctgagcaagatggaccccgagggcagcaagctgctggacgacgccatggccgccgacaagagcgacgagtggttcgccaagcacaacaagcccaaggccagcggctag

SEQ ID NO: 18646 - DNA, 1506 bp, Artificial Sequence
  Description of Artificial Sequence: Synthetic coding sequence
atgagactgacccccttcagcctgagcaccggcaacagcttcagatacagcagaagactgaagaagaacatcttcggcaccgcccccgccctgagagccagcgagatgagcctgagacccagcagcagaatcttcccctgcttcagcagaaacggcctggacttcaccatcgtgatcaccctgctgcagccccccgtgcccggcatcagcttcatcgtggccaagcccagactgttccccggcgccggcagcgccggctgcggcctgctggagagactgttcctgagcctgctgctgggcaccggcctgagatggtgcagaggctgcttccccggcgccagattctgcagcaccaccagccccgagggcaacaccaccttcaccggcctgagaagaagcgccagaacccagagactgcagggccccaagcccggcccccccgccgccaccgtggccagacagaccagcagagtgagccccgcccccccctgcagcctgagacccggcctgagacacgagagcgcccccagcgccgccagcgacgtgaccgccagaggcgccctgagaggcctgggctgcaccgtgagagtgaccgccgcctgcggcggcaaccacggctgcagccagctgcacttcgtgttcaaggtgggcaacagattccagaccgccagattctacagagacgtgctgggcatgaaggtgctgagacacgaggagttcgaggagggctgcaaggccgcctgcaacggcccctacgacggcaagtggagcaagaccatggtgggcttcggccccgaggacgaccacttcgtggccgagctgacctacaactacggcgtgggcgactacaagctgggcaacgacttcatgggcatcaccctggccagcagccaggccgtgagcaacgccagaaagctggagtggcccctgaccgaggtggccgagggcgtgttcgagaccgaggcccccggcggctacaagttctacctgcagaacagaagcctgccccagagcgaccccgtgctgaaggtgaccctggccgtgagcgacctgcagaagagcctgaactactggtgcaacctgctgggcatgaagatctacgagaaggacgaggagaagcagagagccctgctgggctacgccgacaaccagtgcaagctggagctgcagggcgtgaagggcggcgtggaccacgccgccgccttcggcagaatcgccttcagctgcccccagaaggagctgcccgacctggaggacctgatgaagagagagaaccagaagatcctgacccccctggtgagcctggacacccccggcaaggccaccgtgcaggtggtgatcctggccgaccccgacggccacgagatctgcttcgtgggcgacgaggccttcagagagctgagcaagatggaccccgagggcagcaagctgctggacgacgccatggccgccgacaagagcgacgagtggttcgccaagcacaacaagcccaaggccagcggctag

SEQ ID NO: 18647 - DNA, 870 bp, Artificial Sequence
  Description of Artificial Sequence: Synthetic coding sequence
atgagaaacctgaagaaggccgccaagctgcccgtgatgggcatgatcccctgcttcctgaagagccccctgggcagcgactacaccagaatcaccgaggacagcttcagcaagccctacgacggcaagtggagcaagaccatggtgggcttcggccccgaggacgaccacttcgtggccgagctgacctacaactacggcgtgggcgactacaagctgggcaacgacttcatgggcatcaccctggccagcagccaggccgtgagcaacgccagaaagctggagtggcccctgaccgaggtggccgagggcgtgttcgagaccgaggcccccggcggctacaagttctacctgcagaacagaagcctgccccagagcgaccccgtgctgaaggtgaccctggccgtgagcgacctgcagaagagcctgaactactggtgcaacctgctgggcatgaagatctacgagaaggacgaggagaagcagagagccctgctgggctacgccgacaaccagtgcaagctggagctgcagggcgtgaagggcggcgtggaccacgccgccgccttcggcagaatcgccttcagctgcccccagaaggagctgcccgacctggaggacctgatgaagagagagaaccagaagatcctgacccccctggtgagcctggacacccccggcaaggccaccgtgcaggtggtgatcctggccgaccccgacggccacgagatctgcttcgtgggcgacgaggccttcagagagctgagcaagatggaccccgagggcagcaagctgctggacgacgccatggccgccgacaagagcgacgagtggttcgccaagcacaacaagcccaaggccagcggctag

SEQ ID NO: 18648 - DNA, 5850 bp, Artificial Sequence
  Description of Artificial Sequence: Synthetic coding sequence
atgggcaacagctacgccggccagctgaagaccaccagattcgaggaggtgctgcacaacagcatcgaggccagcctgagaagcaacaacctggtgcccagacccatcttcagccagctgtacctggaggccgagcagcagctggccgccctggagggcggcagcagagtggacaacgaggaggaggaggaggagggcgagggcggcctggagaccaacggcccccccaaccccttccagctgcaccccctgcccgagggctgctgcaccaccgacggcttctgccaggccggcaaggacctgagactggtgagcatcagcaacgagcccatggacgtgcccgccggcttcctgctggtgggcgtgaagagccccagcctgcccgaccacctgctggtgtgcgccgtggacaagagattcctgcccgacgacaacggccacaacgccctgctgggcttcagcggcaactgcgtgggctgcggcaagaagggcttctgctacttcaccgagttcagcaaccacatcaacctgaagctgaccacccagcccaagaagcagaagcacctgaagtactacctggtgagaaacgcccagggcaccctgaccaagggccccctgatctgctggaagggcagcgagttcagaagcagacagatccccgccagcacctgcagcagcagcctgttccccgccctggagagcaccgccgccttccccagcgagcccgtgcccggcaccaaccccagcatcctgatgggcgcccagcaggccggccccgccagcgaccaccccagcctgaacgccgccatgggccccgccgtgttcaacggcaaggacagccccaagtgccagcagctggccaagaacaacctgctggccctgcccagacccagcgccctgggcatcctgagcaacagcggcccccccaagaagagacacaagggctggagccccgagagccccagcgcccccgacggcggctgcccccagggcggcggcaacagagccaagtacgagagcgccggcatgagctgcgtgccccaggtgggcctggtgggccccgccagcgtgaccttccccgtggtggccagcggcgagcccgtgagcgtgcccgacaacctgctgaagatctgcaaggccaagcccgtgatcttcaagggccacggcaacttcccctacctgtgcggcaacctgaacgacgtggtggtgagccccctgctgtacacctgctaccagaacagccagagcgtgagcagagcctacgagcagtacggcgccagcgccatccagcccatcagcgaggagatgcagctgctgctgaccgtgtactacctggtgcagctggccgccgaccaggtgcccctgatggaggacctggagcagatcttcctgagaagctggagagagagccacctgaccgagatcagacagtaccagcaggcccccccccagcccttcccccccgcccccagcgccgccgcccccgtgaccagcgcccagctgccctggctggccagcctggccgccagcagctgcaacgacagcgtgcacgtgatcgagtgcgcctacagcctggccgagggcctgagcgagatgttcagactgctggtggagggcaagctggccaagaccaactacgtggtgatcatctgcgcctgcagaagcgccgccatcgacagctgcatcgccgtgaccggcaagtaccaggccagaatcctgagcgagagcctgctgacccccgccgagtaccagaaggaggtgaactacgagctggtgaccggcaaggtggacagcctgggcgccttcttcagcaccctgtgccccgagggcgacatcgacatcctgctggacaagttccaccaggagaaccagggccacatcagcagcagcctggccgccagcagcgtgaccaaggccgccagcctggacgtgagcggcacccccgtgtgcaccagctacaacctggagccccacagcatcagacccttccagctggccgtggcccagaagctgctgagccacgtgtgcagcatcgccgacagcagcacccagaacctggacctgggcagcttcgagaaggtggacttcctgatctgcatcccccccagcgaggtgacctaccagcagaccctgctgcacgtgtggcacagcggcgtgctgctggagctgggcctgaagaaggagcacatgaccaagcagagagtggagcagtacgtgctgaagctggacaccgaggcccagaccaagttcaaggccttcctgcagaacagcttccagaacccccacaccctgttcgtgctgatccacgaccacgcccactgggacctggtgagcagcaccgtgcacaacctgtacagccagagcgaccccagcgtgggcctggtggacagactgctgaactgcagagaggtgaaggaggcccccaacatcgtgaccctgcacgtgaccagcttcccctacgccctgcagacccagcacaccctgatcagcccctacaacgagatccactggcccgccagctgcagcaacggcgtggacctgtaccacgagaacaagaagtacttcggcctgagcgagttcatcgagagcaccctgagcggccacagcctgcccctgctgagatacgacagcagcttcgaggccatggtgaccgccctgggcaagagattccccagactgcacagcgccgtgatcagaaccttcgtgctggtgcagcactacgccgccgccctgatggccgtgagcggcctgccccagatgaagaactacaccagcgtggagaccctggagatcacccagaacctgctgaacagccccaagcagtgcccctgcggccacggcctgatggtgctgctgagagtgccctgcagccccctggccgtggtggcctacgagagactggcccacgtgagagccagactggccctggaggagcacttcgagatcatcctgggcagccccagcagcggcgtgaccgtgggcaagcacttcgtgaagcagctgagaatgtggcagaagatcgaggacgtggagtggagaccccagacctacctggagctggagggcctgccctgcatcctgatcttcagcggcatggacccccacggcgagagcctgcccagaagcctgagatactgcgacctgagactgatcaacagcagctgcctggtgagaaccgccctggagcaggagctgggcctggccgcctacttcgtgagcaacgaggtgcccctggagaagggcgccagaaacgaggccctggagagcgacgccgagaagctgagcagcaccgacaacgaggacgaggagctgggcaccgagggcagcaccagcgagaagagaagccccatgaagagagagagaagcagaagccacgacagcgccagcagcagcctgagcagcaaggccagcggcagcgccctgggcggcgagagcagcgcccagcccaccgccctgccccagggcgagcacgccagaagcccccagcccagaggccccgccgaggagggcagagcccccggcgagaagcagagacccagagccagccagggcccccccagcgccatcagcagacacagccccggccccaccccccagcccgactgcagcctgagaaccggccagagaagcgtgcaggtgagcgtgaccagcagctgcagccagctgagcagcagcagcggcagcagcagcagcagcgtggcccccgccgccggcacctgggtgctgcaggccagccagtgcagcctgaccaaggcctgcagacagccccccatcgtgttcctgcccaagctggtgtacgacatggtggtgagcaccgacagcagcggcctgcccaaggccgccagcctgctgcccagccccagcgtgatgtgggccagcagcttcagacccctgctgagcaagaccatgaccagcaccgagcagagcctgtactacagacagtggaccgtgcccagacccagccacatggactacggcaacagagccgagggcagagtggacggcttccaccccagaagactgctgctgagcggccccccccagatcggcaagaccggcgcctacctgcagttcctgagcgtgctgagcagaatgctggtgagactgaccgaggtggacgtgtacgacgaggaggagatcaacatcaacctgagagaggagagcgactggcactacctgcagctgagcgacccctggcccgacctggagctgttcaagaagctgcccttcgactacatcatccacgaccccaagtacgaggacgccagcctgatctgcagccactaccagggcatcaagagcgaggacagaggcatgagcagaaagcccgaggacctgtacgtgagaagacagaccgccagaatgagactgagcaagtacgccgcctacaacacctaccaccactgcgagcagtgccaccagtacatgggcttccaccccagataccagctgtacgagagcaccctgcacgccttcgccttcagctacagcatgctgggcgaggagatccagctgcacttcatcatccccaagagcaaggagcaccacttcgtgttcagccagcccggcggccagctggagagcatgagactgcccctggtgaccgacaagagccacgagtacatcaagagccccaccttcacccccaccaccggcagacacgagcacggcctgttcaacctgtaccacgccatggacggcgccagccacctgcacgtgctggtggtgaaggagtacgagatggccatctacaagaagtactggcccaaccacatcatgctggtgctgcccagcatcttcaacagcgccggcgtgggcgccgcccacttcctgatcaaggagctgagctaccacaacctggagctggagagaaacagacaggaggagctgggcatcaagccccaggacatctggcccttcatcgtgatcagcgacgacagctgcgtgatgtggaacgtggtggacgtgaacagcgccggcgagagaagcagagagttcagctggagcgagagaaacgtgagcctgaagcacatcatgcagcacatcgaggccgcccccgacatcatgcactacgccctgctgggcctgagaaagtggagcagcaagaccagagccagcgaggtgcaggagcccttcagcagatgccacgtgcacaacttcatcatcctgaacgtggacctgacccagaacgtgcagtacaaccagaacagattcctgtgcgacgacgtggacttcaacctgagagtgcacagcgccggcctgctgctgtgcagattcaacagattcagcgtgatgaagaagcagatcgtggtgggcggccacagaagcttccacatcaccagcaaggtgagcgacaacagcgccgccgtggtgcccgcccagtacatctgcgcccccgacagcaagcacaccttcctggccgcccccgcccagctgctgctggagaagttcctgcagcaccacagccacctgttcttccccctgagcctgaagaaccacgaccaccccgtgctgagcgtggactgctacctgaacctgggcagccagatcagcgtgtgctacgtgagcagcagaccccacagcctgaacatcagctgcagcgacctgctgttcagcggcctgctgctgtacctgtgcgacagcttcgtgggcgccagcttcctgaagaagttccacttcctgaagggcgccaccctgtgcgtgatctgccaggacagaagcagcctgagacagaccgtggtgagactggagctggaggacgagtggcagttcagactgagagacgagttccagaccgccaacgccagagaggacagacccctgttcttcctgaccggcagacacatctag

SEQ ID NO: 18649 - DNA, 1395 bp, Artificial Sequence
  Description of Artificial Sequence: Synthetic coding sequence
atgagagagggcagcagcaccctgagcgagatcagaaagctgaagcccggcatcatggtgtgcacctgcaaccccagctacagcaaccaggagaccgaggtgcaggagaacagccccggccacagagccggcctggagcccttcttcgacttcatcgtgagcatcaacggcagcagactgaacaaggacaacgacaccctgaaggacctgctgaaggccaacgtggagaagcccgtgaagatgctgatctacagcagcaagaccctggagctgagagagaccagcgtgacccccagcaacctgtggggcggccagggcctgctgggcgtgagcatcagattctgcagcttcgacggcgccaacgagaacgtgtggcacgtgctggaggtggagagcaacagccccgccgccctggccggcctgagaccccacagcgactacatcatcggcgccgacaccgtgatgaacgagagcgaggacctgttcagcctgatcgagacccacgaggccaagcccctgaagctgtacgtgtacaacaccgacaccgacaactgcagagaggtgatcatcacccccaacagcgcctggggcggcgagggcagcctgggctgcggcatcggctacggctacctgcacagaatccccaccagacccttcgaggagggcaagaagatcagcctgcccggccagatggccggcacccccatcacccccctgaaggacggcttcaccgaggtgcagctgagcagcgtgaacccccccagcctgagcccccccggcaccaccggcatcgagcagagcctgaccggcctgagcatcagcagcaccccccccgccgtgagcagcgtgctgagcaccggcgtgcccaccgtgcccctgctgcccccccaggtgaaccagagcctgaccagcgtgccccccatgaaccccgccaccaccctgcccggcctgatgcccctgcccgccggcctgcccaacctgcccaacctgaacctgaacctgcccgccccccacatcatgcccggcgtgggcctgcccgagctggtgaaccccggcctgccccccctgcccagcatgccccccagaaacctgcccggcatcgcccccctgcccctgcccagcgagttcctgcccagcttccccctggtgcccgagagcagcagcgccgccagcagcggcgagctgctgagcagcctgccccccaccagcaacgcccccagcgaccccgccaccaccaccgccaaggccgacgccgccagcagcctgaccgtggacgtgaccccccccaccgccaaggcccccaccaccgtggaggacagagtgggcgacagcacccccgtgagcgagaagcccgtgagcgccgccgtggacgccaacgccagcgagagcccctag

SEQ ID NO: 18650 - DNA, 399 bp, Artificial Sequence
  Description of Artificial Sequence: Synthetic coding sequence
atgatcagcatcaccgagtggcagaagatcggcgtgggcatcaccggcttcggcatcttcttcatcctgttcggcaccctgctgtacttcgacagcgtgctgctggccttcggcaacctgctgttcctgaccggcctgagcctgatcatcggcctgagaaagaccttctggttcttcttccagagacacaagctgaagggcaccagcttcctgctgggcggcgtggtgatcgtgctgctgagatggcccctgctgggcatgttcctggagacctacggcttcttcagcctgttcaagggcttcttccccgtggccttcggcttcctgggcaacgtgtgcaacatccccttcctgggcgccctgttcagaagactgcagggcaccagcagcatggtgtag

SEQ ID NO: 18651 - DNA, 918 bp, Artificial Sequence
  Description of Artificial Sequence: Synthetic coding sequence
atgagcgtggaccccgcctgcccccagagcctgccctgcttcgaggccagcgactgcaaggagagcagccccatgcccgtgatctgcggccccgaggagaactaccccagcctgcagatgagcagcgccgagatgccccacaccgagaccgtgagccccctgcccagcagcatggacctgctgatccaggacagccccgacagcagcaccagccccaagggcaagcagcccaccagcgccgagaagagcgtggccaagaaggaggacaaggtgcccgtgaagaagcagaagaccagaaccgtgttcagcagcacccagctgtgcgtgctgaacgacagattccagagacagaagtacctgagcctgcagcagatgcaggagctgagcaacatcctgaacctgagctacaagcaggtgaagacctggttccagaaccagagaatgaagagcaagagatggcagaagaacaactggcccaagaacagcaacggcgtgacccagaaggccagcgcccccacctaccccagcctgtacagcagctaccaccagggctgcctggtgaaccccaccggcaacctgcccatgtggagcaaccagacctggaacaacagcacctggagcaaccagacccagaacatccagagctggagcaaccacagctggaacacccagacctggtgcacccagagctggaacaaccaggcctggaacagccccttctacaactgcggcgaggagagcctgcagagctgcatgcagttccagcccaacagccccgccagcgacctggaggccgccctggaggccgccggcgagggcctgaacgtgatccagcagaccaccagatacttcagcaccccccagaccatggacctgttcctgaactacagcatgaacatgcagcccgaggacgtgtag

SEQ ID NO: 18652 - DNA, 1842 bp, Artificial Sequence
  Description of Artificial Sequence: Synthetic coding sequence
atggccgccaccgccgtggccgccgccgtggccggcaccgagagcgcccagggcccccccggccccgccgccagcctggagctgtggctgaacaaggccaccgaccccagcatgagcgagcaggactggagcgccatccagaacttctgcgagcaggtgaacaccgaccccaacggccccacccacgccccctggctgctggcccacaagatccagagcccccaggagaaggaggccctgtacgccctgaccgtgctggagatgtgcatgaaccactgcggcgagaagttccacagcgaggtggccaagttcagattcctgaacgagctgatcaaggtgctgagccccaagtacctgggcagctgggccaccggcaaggtgaagggcagagtgatcgagatcctgttcagctggaccgtgtggttccccgaggacatcaagatcagagacgcctaccagatgctgaagaagcagggcatcatcaagcaggaccccaagctgcccgtggacaagatcctgcccccccccagcccctggcccaagagcagcatcttcgacgccgacgaggagaagagcaagctgctgaccagactgctgaagagcaaccaccccgaggacctgcaggccgccaacagactgatcaagaacctggtgaaggaggagcaggagaagagcgagaaggtgagcaagagagtgagcgccgtggaggaggtgagaagccacgtgaaggtgctgcaggagatgctgagcatgtacagaagacccggccaggccccccccgaccaggaggccctgcaggtggtgtacgagagatgcgagaagctgagacccaccctgttcagactggccagcgacaccaccgacgacgacgacgccctggccgagatcctgcaggccaacgacctgctgacccagggcgtgctgctgtacaagcaggtgatggagggcagagtgaccttcggcaacagagtgaccagcagcctgggcgacatccccgtgagcagagtgttccagaaccccgccggctgcatgaagacctgccccctgatcgacctggaggtggacaacggccccgcccagatgggcaccgtggtgcccagcctgctgcaccaggacctggccgccctgggcatcagcgacgcccccgtgaccggcatggtgagcggccagaactgctgcgaggagaagagaaaccccagcagcagcaccctgcccggcggcggcgtgcagaaccccagcgccgacagaaacctgctggacctgctgagcgcccagcccgccccctgccccctgaactacgtgagccagaagagcgtgcccaaggaggtgccccccggcaccaagagcagccccggctggagctgggaggccggccccctggcccccagccccagcagccagaacacccccctggcccaggtgttcgtgcccctggagagcgtgaagcccagcagcctgccccccctgatcgtgtacgacagaaacggcttcagaatcctgctgcacttcagccagaccggcgcccccggccaccccgaggtgcaggtgctgctgctgaccatgatgagcaccgccccccagcccgtgtgggacatcatgttccaggtggccgtgcccaagagcatgagagtgaagctgcagcccgccagcagcagcaagctgcccgccttcagccccctgatgccccccgccgtgatcagccagatgctgctgctggacaacccccacaaggagcccatcagactgagatacaagctgaccttcaaccagggcggccagcccttcagcgaggtgggcgaggtgaaggacttccccgacctggccgtgctgggcgccgcctag

SEQ ID NO: 18653 - DNA, 522 bp, Artificial Sequence
  Description of Artificial Sequence: Synthetic coding sequence
atgaccttcagcaagctgctgatctgcctggacttcctggacgtgctggagagaatgggcgtggccctgctgttcatctggaagcaggtggagctgctgctgggcatcagcctgtacagcttcctgaccggcatcagcgacgcccccgtgaccggcatggtgagaatgcccttccccggccccggcgagagaatgggcggcagccagacctgcccctgcgaggccgccctgcccggcgagcagagaggcgcccccgccctgagcagatgggaccacggcctgggcggccccaagcccctgccccacccctactgcctggccgacacctggggcagacaggtggcccccggcagctgcttcctggaggtgtgccccggcgccgcctgcgacctggccctgagcttccccagctgccccaagagatgccaccagagcggcccccagcagctgggctgggcccaggagagctgcgccctggtgctgctgtggctgatggtgatccacaccctggtgctgttctag

SEQ ID NO: 18654 - DNA, 861 bp, Artificial Sequence
  Description of Artificial Sequence: Synthetic coding sequence
atggccgtgccccagcccatgcccagcatccccgaggacctggagagcagagaggccatggtggccttcttcaacagcgccgtggccagcgccgaggaggagcaggccagactgagaggccagctgaaggagcagagagtgagatgcagaagactggcccacctgctggccagcgcccagaaggagcccgaggccgccgcccccgcccccggcaccggcggcgacagcgtgtgcggcgagacccacagagccctgcagggcgccatggagaagctgcagagcagattcatggagctgatgcaggagaaggccgacctgaaggagagagtggaggagctggagcacagatgcatccagctgagcggcgagaccgacaccatcggcgagtacatcgccctgtaccagagccagagagccgtgctgaaggagagacacagagagaaggaggagtacatcagcagactggcccaggacaaggaggagatgaaggtgaagctgctggagctgcaggagctggtgctgagactggtgggcgacagaaacgagtggcacggcagattcctggccgccgcccagaaccccgccgacgagcccaccagcggcgcccccgccccccaggagctgggcgccgccaaccagcagggcgacctgtgcgaggtgagcctggccggcagcgtggagcccgcccagggcgaggccagagagggcagccccagagacaaccccaccgcccagcagatcatgcagctgctgagagagatgcagaaccccagagagagacccggcctgggcagcaacccctgcatccccttcttctacagagccgacgagaacgacgaggtgaagatcaccgtgatctag

SEQ ID NO: 18655 - DNA, 3009 bp, Artificial Sequence
  Description of Artificial Sequence: Synthetic coding sequence
atgtggccccagcccagactgccccccagacccgccatgagcgaggagaccagacagagcaagctggccgccgccaagaagaagctgagagagtaccagcagagaaacagccccggcgtgcccaccggcgccaagaagaagaagaagatcaagaacggcagcaaccccgagaccaccaccagcggcggctgccacagccccgaggacacccccaaggacaacgccgccaccctgcagcccagcgacgacaccgtgctgcccggcggcgtgcccagccccggcgccagcctgaccagcatggccgccagccagaaccacgacgccgacaacgtgcccaacctgatggacgagaccaagaccttcagcagcaccgagagcctgagacagctgagccagcagctgaacggcctggtgtgcgagagcgccacctgcgtgaacggcgagggccccgccagcagcgccaacctgaaggacctggagagcagataccagcagctggccgtggccctggacagcagctacgtgaccaacaagcagctgaacatcaccatcgagaagctgaagcagcagaaccaggagatcaccgaccagctggaggaggagaagaaggagtgccaccagaagcagggcgccctgagagagcagctgcaggtgcacatccagaccatcggcatcctggtgagcgagaaggccgagctgcagaccgccctggcccacacccagcacgccgccagacagaaggagggcgagagcgaggacctggccagcagactgcagtacagcagaagaagagtgggcgagctggagagagccctgagcgccgtgagcacccagcagaagaaggccgacagatacaacaaggagctgaccaaggagagagacgccctgagactggagctgtacaagaacacccagagcaacgaggacctgaagcaggagaagagcgagctggaggagaagctgagagtgctggtgaccgagaaggccggcatgcagctgaacctggaggagctgcagaagaagctggagatgaccgagctgctgctgcagcagttcagcagcagatgcgaggcccccgacgccaaccagcagctgcagcaggccatggaggagagagcccagctggaggcccacctgggccaggtgatggagagcgtgagacagctgcagatggagagagacaagtacgccgagaacctgaagggcgagagcgccatgtggagacagagaatgcagcagatgagcgagcaggtgcacaccctgagagaggagaaggagtgcagcatgagcagagtgcaggagctggagaccagcctggccgagctgagaaaccagatggccgagccccccccccccgagccccccgccggccccagcgaggtggagcagcagctgcaggccgaggccgagcacctgagaaaggagctggagggcctggccggccagctgcaggcccaggtgcaggacaacgagggcctgagcagactgaacagagagcaggaggagagactgctggagctggagagagccgccgagctgtggggcgagcaggccgaggccagaagacagatcctggagaccatgcagaacgacagaaccaccatcagcagagccctgagccagaacagagagctgaaggagcagctggccgagctgcagagcggcttcgtgaagctgaccaacgagaacatggagatcaccagcgccctgcagagcgagcagcacgtgaagagagagctgggcaagaagctgggcgagctgcaggagaagctgagcgagctgaaggagaccgtggagctgaagagccaggaggcccagagcctgcagcagcagagagaccagtacctgggccacctgcagcagtacgtggccgcctaccagcagctgaccagcgagaaggaggtgctgcacaaccagctgctgctgcagacccagctggtggaccagctgcagcagcaggaggcccagggcaaggccgtggccgagatggccagacaggagctgcaggagacccaggagagactggaggccgccacccagcagaaccagcagctgagagcccagctgagcctgatggcccaccccggcgagggcgacggcctggacagagaggaggaggaggacgaggaggaggaggaggaggaggccgtggccgtgccccagcccatgcccagcatccccgaggacctggagagcagagaggccatggtggccttcttcaacagcgccgtggccagcgccgaggaggagcaggccagactgagaggccagctgaaggagcagagagtgagatgcagaagactggcccacctgctggccagcgcccagaaggagcccgaggccgccgcccccgcccccggcaccggcggcgacagcgtgtgcggcgagacccacagagccctgcagggcgccatggagaagctgcagagcagattcatggagctgatgcaggagaaggccgacctgaaggagagagtggaggagctggagcacagatgcatccagctgagcggcgagaccgacaccatcggcgagtacatcgccctgtaccagagccagagagccgtgctgaaggagagacacagagagaaggaggagtacatcagcagactggcccaggacaaggaggagatgaaggtgaagctgctggagctgcaggagctggtgctgagactggtgggcgacagaaacgagtggcacggcagattcctggccgccgcccagaaccccgccgacgagcccaccagcggcgcccccgccccccaggagctgggcgccgccaaccagcagggcgacctgtgcgaggtgagcctggccggcagcgtggagcccgcccagggcgaggccagagagggcagccccagagacaaccccaccgcccagcagatcatgcagctgctgagagagatgcagaaccccagagagagacccggcctgggcagcaacccctgcatccccttcttctacagagccgacgagaacgacgaggtgaagatcaccgtgatctag

SEQ ID NO: 18656 - DNA, 1422 bp, Artificial Sequence
  Description of Artificial Sequence: Synthetic coding sequence
atgtggccccagcccagactgccccccagacccgccatgagcgaggagaccagacagagcaagctggccgccgccaagaagaagctgagagagtaccagcagagaaacagccccggcgtgcccaccggcgccaagaagaagaagaagatcaagaacggcagcaaccccgagaccaccaccagcggcggctgccacagccccgaggacatccaggacatcctgaaggtgctggtgagcgacctgaacagaagcaacggcgtggccctgccccccctggacaagtggaagacccccaaggacaacgccgccaccctgcagcccagcgacgacaccgtgctgcccggcggcgtgcccagccccggcgccagcctgaccagcatggccgccagccagaaccacgacgccgacaacgtgcccaacctgatggacgagaccaagaccttcagcagcaccgagagcctgagacagctgagccagcagctgaacggcctggtgtgcgagagcgccacctgcgtgaacggcgagggccccgccagcagcgccaacctgaaggacctggagagcagataccagcagctggccgtggccctggacagcagctacgtgaccaacaagcagctgaacatcaccatcgagaagctgaagcagcagaaccaggagatcaccgaccagctggaggaggagaagaaggagtgccaccagaagcagggcgccctgagagagcagctgcaggtgcacatccagaccatcggcatcctggtgagcgagaaggccgagctgcagaccgccctggcccacacccagcacgccgccagacagaaggagggcgagagcgaggacctggccagcagactgcagtacagcagaagaagagtgggcgagctggagagagccctgagcgccgtgagcacccagcagaagaaggccgacagatacaacaaggagctgaccaaggagagagacgccctgagactggagctgtacaagaacacccagagcaacgaggacctgaagcaggagaagagcgagctggaggagaagctgagagtgctggtgaccgagaaggccggcatgcagctgaacctggaggagctgcagaagaagctggagatgaccgagctgctgctgcagcagttcagcagcagatgcgaggcccccgacgccaaccagcagctgcagcaggccatggaggagagagcccagctggaggcccacctgggccaggtgatggagagcgtgagacagctgcagatggagagagacaagtacgccgagaacctgaagggcgagagcgccatgtggagacagagaatgcagcagatgagcgagcaggtgcacaccctgagagaggagaaggagtgcagcatgagcagagtgcaggagctggagaccagcctggccgagctgagaaaccagatgtag

SEQ ID NO: 18657 - DNA, 414 bp, Artificial Sequence
  Description of Artificial Sequence: Synthetic coding sequence
atgagaccccagcaggcccccgtgagcggcaaggtgttcatccagagagactacagcagcggcaccagatgccagttccagaccaagttccccgccgagctggagaacagaatcgacagacagcagttcgaggagaccgtgagaaccctgaacaacctgtacgccgaggccgagaagctgggcggccagagctacctggagggctgcctggcctgcctgaccgcctacaccatcttcctgtgcatggagacccactacgagaaggtgctgaagaaggtgagcaagtacatccaggagcagaacgagaagatctacgccccccagggcctgctgctgaccgaccccatcgagagaggcctgagagtgatcgagatcaccatctacgaggacagaggcatgagcagcggcagatag

SEQ ID NO: 18658 - DNA, 405 bp, Artificial Sequence
  Description of Artificial Sequence: Synthetic coding sequence
atgagaccccagcaggcccccgtgagcggcaaggtgttcatccagagagactacagcagcggcaccagatgccagttccagaccaagttccccgccgagctggagaacagaatcgacagacagcagttcgaggagaccgtgagaaccctgaacaacctgtacgccgaggccgagaagctgggcggccagagctacctggagggctgcctggcctgcctgaccgcctacaccatcttcctgtgcatggagacccactacgagaaggtgctgaagaaggtgagcaagtacatccaggagcagaacgagaagatctacgccccccagggcctgctgctgaccgaccccatcgagagaggcctgagagtgttcagactgaagctgcccttcatgaagaccgaggcctag

SEQ ID NO: 18659 - DNA, 414 bp, Artificial Sequence; identical to SEQ ID NO: 18657
  Description of Artificial Sequence: Synthetic coding sequence

SEQ ID NO: 18660 - DNA, 414 bp, Artificial Sequence; identical to SEQ ID NO: 18657
  Description of Artificial Sequence: Synthetic coding sequence

SEQ ID NO: 18661 - DNA, 501 bp, Artificial Sequence
  Description of Artificial Sequence: Synthetic coding sequence
atggacgaccagagatgccccctggacgacggccaggccggcgccgccgaggccaccgccgcccccaccctggaggacagaatcgcccagcccagcatgaccgccagcccccagaccgaggagttcttcgacctgatcgccagcagccagagcagaagactggacgaccagagagccagcgtgggcagcctgcccggcctgagaatcacccacagcaacgccggccacctgagaggccacggcgagccccaggagcccggcgacgacttcttcaacatgctgatcaagtaccagagcagcagaatcgacgaccagagatgccccccccccgacgtgctgcccagaggccccaccatgcccgacgaggacttcttcagcctgatccagagagtgcaggccaagagaatggacgagcagagagtggacctggccggcggccccgagcagggcgccggcggcccccccgagccccagcagcagtgccagcccggcgccagctag

SEQ ID NO: 18662 - DNA, 1959 bp, Artificial Sequence
  Description of Artificial Sequence: Synthetic coding sequence
atggaggccagctgcctggagctggccctggagggcgagagactgtgcaaggccggcgacttcaagaccggcgtggccttcttcgaggccgccgtgcaggtgggcaccgaggacctgaagaccctgagcgccatctacagccagctgggcaacgcctacttctacctgaaggagcacggcagagccctggagtaccacaagcacgacctgctgctggccagaaccatcggcgacagaatgggcgaggccaaggccagcggcaacctgggcaacaccctgaaggtgctgggcagattcgacgaggccgccgtgtgctgccagagacacctgagcatcgcccaggagcagggcgacaaggtgggcgaggccagagccctgtacaacatcggcaacgtgtaccacgccaagggcaagcagctgagctggaacgccgccaacgccacccaggaccccggccacctgccccccgacgtgagagagaccctgtgcaaggccagcgagttctacgagagaaacctgagcctggtgaaggagctgggcgacagagccgcccagggcagagcctacggcaacctgggcaacacccactacctgctgggcaacttcaccgaggccaccaccttccacaaggagagactggccatcgccaaggagttcggcgacaaggccgccgagagaagagcctacagcaacctgggcaacgcccacgtgttcctgggcagattcgacgtggccgccgagtactacaagaagaccctgcagctgagcagacagctgagagaccaggccgtggaggcccaggcctgctacagcctgggcaacacctacaccctgctgcaggactacgagagagccgccgagtaccacctgagacacctgctgatcgcccaggagctggccgacagagtgggcgagggcagagcctgctggagcctgggcaacgcctacgtgagcatgggcagacccgcccaggccctgaccttcgccaagaagcacctgcagatcagccaggagatcggcgacagacacggcgagctgaccgccagaatgaacgtggcccagctgcagctggtgctgggcagactgaccagccccgccgccagcgagaagcccgacctggccggctacgaggcccagggcgccagacccaagagaacccagagactgagcgccgagacctgggacctgctgagactgcccctggagagagagcagaacggcgacagccaccacagcggcgactggagaggccccagcagagacagcctgcccctgcccgtgagaagcagaaagtaccaggagggccccgacgccgagagaagacccagagagggcagccacagccccctggacagcgccgacgtgagagtgcacgtgcccagaaccagcatccccagagcccccagcagcgacgaggagtgcttcttcgacctgctgaccaagttccagagcagcagaatggacgaccagagatgccccctggacgacggccaggccggcgccgccgaggccaccgccgcccccaccctggaggacagaatcgcccagcccagcatgaccgccagcccccagaccgaggagttcttcgacctgatcgccagcagccagagcagaagactggacgaccagagagccagcgtgggcagcctgcccggcctgagaatcacccacagcaacgccggccacctgagaggccacggcgagccccaggagcccggcgacgacttcttcaacatgctgatcaagtaccagagcagcagaatcgacgaccagagatgccccccccccgacgtgctgcccagaggccccaccatgcccgacgaggacttcttcagcctgatccagagagtgcaggccaagagaatggacgagcagagagtggacctggccggcggccccgagcagggcgccggcggcccccccgagccccagcagcagtgccagcccggcgccagctag

SEQ ID NO: 18663 - DNA, 501 bp, Artificial Sequence; identical to SEQ ID NO: 18661
  Description of Artificial Sequence: Synthetic coding sequence

SEQ ID NO: 18664 - DNA, 1374 bp, Artificial Sequence
  Description of Artificial Sequence: Synthetic coding sequence
atggccggccccgccccccccgtggccgacgagctgcccggccccgccgccagaagactgtacagcagaatggaggccagctgcctggagctggccctggagggcgagagactgtgcaaggccggcgacttcaagaccggcgtggccttcttcgaggccgccgtgcaggtgggcaccgaggacctgaagaccctgagcgccatctacagccagctgggcaacgcctacttctacctgaaggagcacggcagagccctggagtaccacaagcacgacctgctgctggccagaaccatcggcgacagaatgggcgaggccaaggccagcggcaacctgggcaacaccctgaaggtgctgggcagattcgacgaggccgccgtgtgctgccagagacacctgagcatcgcccaggagcagggcgacaaggtgggcgaggccagagccctgtacaacatcggcaacgtgtaccacgccaagggcaagcagctgagctggaacgccgccaacgccacccaggaccccggccacctgccccccgacgtgagagagaccctgtgcaaggccagcgagttctacgagagaaacctgagcctggtgaaggagctgggcgacagagccgcccagggcagagcctacggcaacctgggcaacacccactacctgctgggcaacttcaccgaggccaccaccttccacaaggagagactggccatcgccaaggagttcggcgacaaggccgccgagagaagagcctacagcaacctgggcaacgcccacgtgttcctgggcagattcgacgtggccgccgagtactacaagaagaccctgcagctgagcagacagctgagagaccaggccgtggaggcccaggcctgctacagcctgggcaacacctacaccctgctgcaggactacgagagagccgccgagtaccacctgagacacctgctgatcgcccaggagctggccgacagagtgggcgagggcagagcctgctggagcctgggcaacgcctacgtgagcatgggcagacccgcccaggccctgaccttcgccaagaagcacctgcagatcagccaggagatcggcgacagacacggcgagctgaccgccagaatgaacgtggcccagctgcagctggtgctgggcagactgaccagccccgccgccagcgagaagcccgacctggccggctacgaggcccagggcgagttccagggctgcggcggcgtgctgctgcccaccggcaccgacagaatcagaagctgcggcggcgtgggcagcagacccggccagcacggcggcggcggcagcagacagaagatggcccccaccagccagttcttcctggccagcggcaccgcccaggcctag

SEQ ID NO: 18665 - DNA, 501 bp, Artificial Sequence; identical to SEQ ID NO: 18661
  Description of Artificial Sequence: Synthetic coding sequence

SEQ ID NO: 18666 - DNA, 2028 bp, Artificial Sequence
  Description of Artificial Sequence: Synthetic coding sequence
atggccggccccgccccccccgtggccgacgagctgcccggccccgccgccagaagactgtacagcagaatggaggccagctgcctggagctggccctggagggcgagagactgtgcaaggccggcgacttcaagaccggcgtggccttcttcgaggccgccgtgcaggtgggcaccgaggacctgaagaccctgagcgccatctacagccagctgggcaacgcctacttctacctgaaggagcacggcagagccctggagtaccacaagcacgacctgctgctggccagaaccatcggcgacagaatgggcgaggccaaggccagcggcaacctgggcaacaccctgaaggtgctgggcagattcgacgaggccgccgtgtgctgccagagacacctgagcatcgcccaggagcagggcgacaaggtgggcgaggccagagccctgtacaacatcggcaacgtgtaccacgccaagggcaagcagctgagctggaacgccgccaacgccacccaggaccccggccacctgccccccgacgtgagagagaccctgtgcaaggccagcgagttctacgagagaaacctgagcctggtgaaggagctgggcgacagagccgcccagggcagagcctacggcaacctgggcaacacccactacctgctgggcaacttcaccgaggccaccaccttccacaaggagagactggccatcgccaaggagttcggcgacaaggccgccgagagaagagcctacagcaacctgggcaacgcccacgtgttcctgggcagattcgacgtggccgccgagtactacaagaagaccctgcagctgagcagacagctgagagaccaggccgtggaggcccaggcctgctacagcctgggcaacacctacaccctgctgcaggactacgagagagccgccgagtaccacctgagacacctgctgatcgcccaggagctggccgacagagtgggcgagggcagagcctgctggagcctgggcaacgcctacgtgagcatgggcagacccgcccaggccctgaccttcgccaagaagcacctgcagatcagccaggagatcggcgacagacacggcgagctgaccgccagaatgaacgtggcccagctgcagctggtgctgggcagactgaccagccccgccgccagcgagaagcccgacctggccggctacgaggcccagggcgccagacccaagagaacccagagactgagcgccgagacctgggacctgctgagactgcccctggagagagagcagaacggcgacagccaccacagcggcgactggagaggccccagcagagacagcctgcccctgcccgtgagaagcagaaagtaccaggagggccccgacgccgagagaagacccagagagggcagccacagccccctggacagcgccgacgtgagagtgcacgtgcccagaaccagcatccccagagcccccagcagcgacgaggagtgcttcttcgacctgctgaccaagttccagagcagcagaatggacgaccagagatgccccctggacgacggccaggccggcgccgccgaggccaccgccgcccccaccctggaggacagaatcgcccagcccagcatgaccgccagcccccagaccgaggagttcttcgacctgatcgccagcagccagagcagaagactggacgaccagagagccagcgtgggcagcctgcccggcctgagaatcacccacagcaacgccggccacctgagaggccacggcgagccccaggagcccggcgacgacttcttcaacatgctgatcaagtaccagagcagcagaatcgacgaccagagatgccccccccccgacgtgctgcccagaggccccaccatgcccgacgaggacttcttcagcctgatccagagagtgcaggccaagagaatggacgagcagagagtggacctggccggcggccccgagcagggcgccggcggcccccccgagccccagcagcagtgccagcccggcgccagctag

SEQ ID NO: 18667 - DNA, 2175 bp, Artificial Sequence
  Description of Artificial Sequence: Synthetic coding sequence
atgttcgacaccaccccccacagcggcagaagcacccccagcagcagccccagcctgagaaagagactgcagctgctgccccccagcagacccccccccgagcccgagcccggcaccatggtggagaagggcagcgacagcagcagcgagaagggcggcgtgcccggcacccccagcacccagagcctgggcagcagaaacttcatcagaaacagcaagaagatgcagagctggtacagcatgctgagccccacctacaagcagagaaacgaggacttcagaaagctgttcagcaagctgcccgaggccgagagactgatcgtggactacagctgcgccctgcagagagagatcctgctgcagggcagactgtacctgagcgagaactggatctgcttctacagcaacatcttcagatgggagaccaccatcagcatccagctgaaggaggtgacctgcctgaagaaggagaagaccgccaagctgatccccaacgccatccagatctgcaccgagagcgagaagcacttcttcaccagcttcggcgccagagacagatgcttcctgctgatcttcagactgtggcagaacgccctgctggagaagaccctgagccccagagagctgtggcacctggtgcaccagtgctacggcagcgagctgggcctgaccagcgaggacgaggactacgtgagccccctgcagctgaacggcctgggcacccccaaggaggtgggcgacgtgatcgccctgagcgacatcaccagcagcggcgccgccgacagaagccaggagcccagccccgtgggcagcagaagaggccacgtgacccccaacctgagcagagccagcagcgacgccgaccacggcgccgaggaggacaaggaggagcaggtggacagccagcccgacgccagcagcagccagaccgtgacccccgtggccgagccccccagcaccgagcccacccagcccgacggccccaccaccctgggccccctggacctgctgcccagcgaggagctgctgaccgacaccagcaacagcagcagcagcaccggcgaggaggccgacctggccgccctgctgcccgacctgagcggcagactgctgatcaacagcgtgttccacgtgggcgccgagagactgcagcagatgctgttcagcgacagccccttcctgcagggcttcctgcagcagtgcaagttcaccgacgtgaccctgagcccctggagcggcgacagcaagtgccaccagagaagagtgctgacctacaccatccccatcagcaaccccctgggccccaagagcgccagcgtggtggagacccagaccctgttcagaagaggcccccaggccggcggctgcgtggtggacagcgaggtgctgacccagggcatcccctaccaggactacttctacaccgcccacagatactgcatcctgggcctggccagaaacaaggccagactgagagtgagcagcgagatcagatacagaaagcagccctggagcctggtgaagagcctgatcgagaagaacagctggagcggcatcgaggactacttccaccacctggagagagagctggccaaggccgagaagctgagcctggaggagggcggcaaggacgccagaggcctgctgagcggcctgagaagaagaaagagacccctgagctggagagcccacggcgacggcccccagcaccccgaccccgacccctgcgccagagccggcatccacaccagcggcagcctgagcagcagattcagcgagcccagcgtggaccagggccccggcgccggcatccccagcgccctggtgctgatcagcatcgtgatctgcgtgagcctgatcatcctgatcgccctgaacgtgctgctgttctacagactgtggagcctggagagaaccgcccacaccttcgagagctggcacagcctggccctggccaagggcaagttcccccagaccgccaccgagtgggccgagatcctggccctgcagaagcagttccacagcgtggaggtgcacaagtggagacagatcctgagagccagcgtggagctgctggacgagatgaagttcagcctggagaagctgcaccagggcatcaccgtgagcgacccccccttcgacacccagcccagacccgacgacagcttcagctag

SEQ ID NO: 18668 - DNA, 2142 bp, Artificial Sequence
  Description of Artificial Sequence: Synthetic coding sequence
atgttcgacaccaccccccacagcggcagaagcacccccagcagcagccccagcctgagaaagagactgcagctgctgccccccagcagacccccccccgagcccgagcccggcaccatggtggagaagggcagcgacagcagcagcgagaagggcggcgtgcccggcacccccagcacccagagcctgggcagcagaaacttcatcagaaacagcaagatgctgagccccacctacaagcagagaaacgaggacttcagaaagctgttcagcaagctgcccgaggccgagagactgatcgtggactacagctgcgccctgcagagagagatcctgctgcagggcagactgtacctgagcgagaactggatctgcttctacagcaacatcttcagatgggagaccaccatcagcatccagctgaaggaggtgacctgcctgaagaaggagaagaccgccaagctgatccccaacgccatccagatctgcaccgagagcgagaagcacttcttcaccagcttcggcgccagagacagatgcttcctgctgatcttcagactgtggcagaacgccctgctggagaagaccctgagccccagagagctgtggcacctggtgcaccagtgctacggcagcgagctgggcctgaccagcgaggacgaggactacgtgagccccctgcagctgaacggcctgggcacccccaaggaggtgggcgacgtgatcgccctgagcgacatcaccagcagcggcgccgccgacagaagccaggagcccagccccgtgggcagcagaagaggccacgtgacccccaacctgagcagagccagcagcgacgccgaccacggcgccgaggaggacaaggaggagcaggtggacagccagcccgacgccagcagcagccagaccgtgacccccgtggccgagccccccagcaccgagcccacccagcccgacggccccaccaccctgggccccctggacctgctgcccagcgaggagctgctgaccgacaccagcaacagcagcagcagcaccggcgaggaggccgacctggccgccctgctgcccgacctgagcggcagactgctgatcaacagcgtgttccacgtgggcgccgagagactgcagcagatgctgttcagcgacagccccttcctgcagggcttcctgcagcagtgcaagttcaccgacgtgaccctgagcccctggagcggcgacagcaagtgccaccagagaagagtgctgacctacaccatccccatcagcaaccccctgggccccaagagcgccagcgtggtggagacccagaccctgttcagaagaggcccccaggccggcggctgcgtggtggacagcgaggtgctgacccagggcatcccctaccaggactacttctacaccgcccacagatactgcatcctgggcctggccagaaacaaggccagactgagagtgagcagcgagatcagatacagaaagcagccctggagcctggtgaagagcctgatcgagaagaacagctggagcggcatcgaggactacttccaccacctggagagagagctggccaaggccgagaagctgagcctggaggagggcggcaaggacgccagaggcctgctgagcggcctgagaagaagaaagagacccctgagctggagagcccacggcgacggcccccagcaccccgaccccgacccctgcgccagagccggcatccacaccagcggcagcctgagcagcagattcagcgagcccagcgtggaccagggccccggcgccggcatccccagcgccctggtgctgatcagcatcgtgctgatcatcctgatcgccctgaacgtgctgctgttctacagactgtggagcctggagagaaccgcccacaccttcgagagctggcacagcctggccctggccaagggcaagttcccccagaccgccaccgagtgggccgagatcctggccctgcagaagcagttccacagcgtggaggtgcacaagtggagacagatcctgagagccagcgtggagctgctggacgagatgaagttcagcctggagaagctgcaccagggcatcaccgtgagcgacccccccttcgacacccagcccagacccgacgacagcttcagctag

SEQ ID NO: 18669 - DNA, 2421 bp, Artificial Sequence
  Description of Artificial Sequence: Synthetic coding sequence
atggacgacgtgctgcccctgatgccctgggagaccctgctggcccagggcagcccccagggcagccccgacctgcccgccggccagagaaagcagcagccccagggcgacagagcccagggcctggccagcgagagctggaagctgctggaggtgcccatcatccacatcacccccagcagcgacggcgagagccccgcctgcacccccacccccagaagaagacagcagcagagaatgcccgacccccagagcctgagccaggacagcaccaccccccacagcggcagaagcacccccagcagcagccccagcctgagaaagagactgcagctgctgccccccagcagacccccccccgagcccgagcccggcaccatggtggagaagggcagcgacagcagcagcgagaagggcggcgtgcccggcacccccagcacccagagcctgggcagcagaaacttcatcagaaacagcaagaagatgcagagctggtacagcatgctgagccccacctacaagcagagaaacgaggacttcagaaagctgttcagcaagctgcccgaggccgagagactgatcgtggactacagctgcgccctgcagagagagatcctgctgcagggcagactgtacctgagcgagaactggatctgcttctacagcaacatcttcagatgggagaccaccatcagcatccagctgaaggaggtgacctgcctgaagaaggagaagaccgccaagctgatccccaacgccatccagatctgcaccgagagcgagaagcacttcttcaccagcttcggcgccagagacagatgcttcctgctgatcttcagactgtggcagaacgccctgctggagaagaccctgagccccagagagctgtggcacctggtgcaccagtgctacggcagcgagctgggcctgaccagcgaggacgaggactacgtgagccccctgcagctgaacggcctgggcacccccaaggaggtgggcgacgtgatcgccctgagcgacatcaccagcagcggcgccgccgacagaagccaggagcccagccccgtgggcagcagaagaggccacgtgacccccaacctgagcagagccagcagcgacgccgaccacggcgccgaggaggacaaggaggagcaggtggacagccagcccgacgccagcagcagccagaccgtgacccccgtggccgagccccccagcaccgagcccacccagcccgacggccccaccaccctgggccccctggacctgctgcccagcgaggagctgctgaccgacaccagcaacagcagcagcagcaccggcgaggaggacctggccgccctgctgcccgacctgagcggcagactgctgatcaacagcgtgttccacgtgggcgccgagagactgcagcagatgctgttcagcgacagccccttcctgcagggcttcctgcagcagtgcaagttcaccgacgtgaccctgagcccctggagcggcgacagcaagtgccaccagagaagagtgctgacctacaccatccccatcagcaaccccctgggccccaagagcgccagcgtggtggagacccagaccctgttcagaagaggcccccaggccggcggctgcgtggtggacagcgaggtgctgacccagggcatcccctaccaggactacttctacaccgcccacagatactgcatcctgggcctggccagaaacaaggccagactgagagtgagcagcgagatcagatacagaaagcagccctggagcctggtgaagagcctgatcgagaagaacagctggagcggcatcgaggactacttccaccacctggagagagagctggccaaggccgagaagctgagcctggaggagggcggcaaggacgccagaggcctgctgagcggcctgagaagaagaaagagacccctgagctggagagcccacggcgacggcccccagcaccccgaccccgacccctgcgccagagccggcatccacaccagcggcagcctgagcagcagattcagcgagcccagcgtggaccagggccccggcgccggcatccccagcgccctggtgctgatcagcatcgtgctgatcatcctgatcgccctgaacgtgctgctgttctacagactgtggagcctggagagaaccgcccacaccttcgagagctggcacagcctggccctggccaagggcaagttcccccagaccgccaccgagtgggccgagatcctggccctgcagaagcagttccacagcgtggaggtgcacaagtggagacagatcctgagagccagcgtggagctgctggacgagatgaagttcagcctggagaagctgcaccagggcatcaccgtgagcgacccccccttcgacacccagcccagacccgacgacagcttcagctag

SEQ ID NO: 18670 - DNA, 1461 bp, Artificial Sequence
  Description of Artificial Sequence: Synthetic coding sequence
atgcactgcctgaagagaacccccaaggaggtgggcgacgtgatcgccctgagcgacatcaccagcagcggcgccgccgacagaagccaggagcccagccccgtgggcagcagaagaggccacgtgacccccaacctgagcagagccagcagcgacgccgaccacggcgccgaggaggacaaggaggagcaggtggacagccagcccgacgccagcagcagccagaccgtgacccccgtggccgagccccccagcaccgagcccacccagcccgacggccccaccaccctgggccccctggacctgctgcccagcgaggagctgctgaccgacaccagcaacagcagcagcagcaccggcgaggaggccgacctggccgccctgctgcccgacctgagcggcagactgctgatcaacagcgtgttccacgtgggcgccgagagactgcagcagatgctgttcagcgacagccccttcctgcagggcttcctgcagcagtgcaagttcaccgacgtgaccctgagcccctggagcggcgacagcaagtgccaccagagaagagtgctgacctacaccatccccatcagcaaccccctgggccccaagagcgccagcgtggtggagacccagaccctgttcagaagaggcccccaggccggcggctgcgtggtggacagcgaggtgctgacccagggcatcccctaccaggactacttctacaccgcccacagatactgcatcctgggcctggccagaaacaaggccagactgagagtgagcagcgagatcagatacagaaagcagccctggagcctggtgaagagcctgatcgagaagaacagctggagcggcatcgaggactacttccaccacctggagagagagctggccaaggccgagaagctgagcctggaggagggcggcaaggacgccagaggcctgctgagcggcctgagaagaagaaagagacccctgagctggagagcccacggcgacggcccccagcaccccgaccccgacccctgcgccagagccggcatccacaccagcggcagcctgagcagcagattcagcgagcccagcgtggaccagggccccggcgccggcatccccagcgccctggtgctgatcagcatcgtgctgatcatcctgatcgccctgaacgtgctgctgttctacagactgtggagcctggagagaaccgcccacaccttcgagagctggcacagcctggccctggccaagggcaagttcccccagaccgccaccgagtgggccgagatcctggccctgcagaagcagttccacagcgtggaggtgcacaagtggagacagatcctgagagccagcgtggagctgctggacgagatgaagttcagcctggagaagctgcaccagggcatcaccgtgagcgacccccccttcgacacccagcccagacccgacgacagcttcagctag

SEQ ID NO: 18671 - DNA, 2217 bp, Artificial Sequence
  Description of Artificial Sequence: Synthetic coding sequence
atgaagggcttcaagctgagctgcaccgccagcaacagcaacagaagcacccccgcctgcagccccatcctgagaaagagaagcagaagccccaccccccagaaccaggacggcgacaccatggtggagaagggcagcgaccacagcagcgacaagagccccagcacccccgagcagggcgtgcagagaagctgcagcagccagagcggcagaagcggcggcaagaacagcaagaagagccagagctggtacaacgtgctgagccccacctacaagcagagaaacgaggacttcagaaagctgttcaagcagctgcccgacaccgagagactgatcgtggactacagctgcgccctgcagagagacatcctgctgcagggcagactgtacctgagcgagaactggatctgcttctacagcaacatcttcagatgggagaccctgctgaccgtgagactgaaggacatctgcagcatgaccaaggagaagaccgccagactgatccccaacgccatccaggtgtgcaccgacagcgagaagcacttcttcaccagcttcggcgccagagacagaacctacatgatgatgttcagactgtggcagaacgccctgctggagaagcccctgtgccccaaggagctgtggcacttcgtgcaccagtgctacggcaacgagctgggcctgaccagcgacgacgaggactacgtgccccccgacgacgacttcaacaccatgggctactgcgaggagatccccgtggaggagaacgaggtgaacgacagcagcagcaagagcagcatcgagaccaagcccgacgccagcccccagctgcccaagaagagcatcaccaacagcaccctgaccagcaccggcagcagcgaggcccccgtgagcttcgacggcctgcccctggaggaggaggccctggagggcgacggcagcctggagaaggagctggccatcgacaacatcatgggcgagaagatcgagatgatcgcccccgtgaacagccccagcctggacttcaacgacaacgaggacatccccaccgagctgagcgacagcagcgacacccacgacgagggcgaggtgcaggccttctacgaggacctgagcggcagacagtacgtgaacgaggtgttcaacttcagcgtggacaagctgtacgacctgctgttcaccaacagccccttccagagagacttcatggagcagagaagattcagcgacatcatcttccacccctggaagaaggaggagaacggcaaccagagcagagtgatcctgtacaccatcaccctgaccaaccccctggcccccaagaccgccaccgtgagagagacccagaccatgtacaaggccagccaggagagcgagtgctacgtgatcgacgccgaggtgctgacccacgacgtgccctaccacgactacttctacaccatcaacagatacaccctgaccagagtggccagaaacaagagcagactgagagtgagcaccgagctgagatacagaaagcagccctggggcctggtgaagaccttcatcgagaagaacttctggagcggcctggaggactacttcagacacctggagagcgagctggccaagaccgagagcacctacctggccgagatgcacagacagagccccaaggagaaggccagcaagaccaccaccgtgagaagaagaaagagaccccacgcccacctgagagtgccccacctggaggaggtgatgagccccgtgaccacccccaccgacgaggacgtgggccacagaatcaagcacgtggccggcagcacccagaccagacacatccccgaggacacccccaacggcttccacctgcagagcgtgagcaagctgctgctggtgatcagctgcgtggtgagcttcagcctggtgctgctggtgatcctgaacatgatgctgttctacaagctgtggatgctggagtacaccacccagaccctgaccgcctggcagggcctgagactgcaggagagactgccccagagccagaccgagtgggcccagctgctggagagccagcagaagtaccacgacaccgagctgcagaagtggagagagatcatcaagagcagcgtgatgctgctggaccagatgaaggacagcctgatcaacctgcagaacggcatcagaagcagagactacaccagcgagagcgaggagaagagaaacagataccactag

SEQ ID NO: 18672 - DNA, 2217 bp, Artificial Sequence
  Description of Artificial Sequence: Synthetic coding sequence
atgaagggcttcaagctgagctgcaccgccagcaacagcaacagaagcacccccgcctgcagccccatcctgagaaagagaagcagaagccccaccccccagaaccaggacggcgacaccatggtggagaagggcagcgaccacagcagcgacaagagccccagcacccccgagcagggcgtgcagagaagctgcagcagccagagcggcagaagcggcggcaagaacagcaagaagagccagagctggtacaacgtgctgagccccacctacaagcagagaaacgaggacttcagaaagctgttcaagcagctgcccgacaccgagagactgatcgtggactacagctgcgccctgcagagagacatcctgctgcagggcagactgtacctgagcgagaactggatctgcttctacagcaacatcttcagatgggagaccctgctgaccgtgagactgaaggacatctgcagcatgaccaaggagaagaccgccagactgatccccaacgccatccaggtgtgcaccgacagcgagaagcacttcttcaccagcttcggcgccagagacagaacctacatgatgatgttcagactgtggcagaacgccctgctggagaagcccctgtgccccaaggagctgtggcacttcgtgcaccagtgctacggcaacgagctgggcctgaccagcgacgacgaggactacgtgccccccgacgacgacttcaacaccatgggctactgcgaggagatccccgtggaggagaacgaggtgaacgacagcagcagcaagagcagcatcgagaccaagcccgacgccagcccccagctgcccaagaagagcatcaccaacagcaccctgaccagcaccggcagcagcgaggcccccgtgagcttcgacggcctgcccctggaggaggaggccctggagggcgacggcagcctggagaaggagctggccatcgacaacatcatgggcgagaagatcgagatgatcgcccccgtgaacagccccagcctggacttcaacgacaacgaggacatccccaccgagctgagcgacagcagcgacacccacgacgagggcgaggtgcaggccttctacgaggacctgagcggcagacagtacgtgaacgaggtgttcaacttcagcgtggacaagctgtacgacctgctgttcaccaacagccccttccagagagacttcatggagcagagaagattcagcgacatcatcttccacccctggaagaaggaggagaacggcaaccagagcagagtgatcctgtacaccatcaccctgaccaaccccctggcccccaagaccgccaccgtgagagagacccagaccatgtacaaggccagccaggagagcgagtgctacgtgatcgacgccgaggtgctgacccacgacgtgccctaccacgactacttctacaccatcaacagatacaccctgaccagagtggccagaaacaagagcagactgagagtgagcaccgagctgagatacagaaagcagccctggggcctggtgaagaccttcatcgagaagaacttctggagcggcctggaggactacttcagacacctggagagcgagctggccaagaccgagagcacctacctggccgagatgcacagacagagccccaaggagaaggccagcaagaccaccaccgtgagaagaagaaagagaccccacgcccacctgagagtgccccacctggaggaggtgatgagccccgtgaccacccccaccgacgaggacgtgggccacagaatcaagcacgtggccggcagcacccagaccagacacatccccgaggacacccccaacggcttccacctgcagagcgtgagcaagctgctgctggtgatcagctgcgtgatctgcttcagcctggtgctgctggtgatcctgaacatgatgctgttctacaagctgtggatgctggagtacaccacccagaccctgaccgcctggcagggcctgagactgcaggagagactgccccagagccagaccgagtgggcccagctgctggagagccagcagaagtaccacgacaccgagctgcagaagtggagagagatcatcaagagcagcgtgatgctgctggaccagatgaaggacagcctgatcaacctgcagaacggcatcagaagcagagactacaccagcgagagcgaggagaagagaaacagataccactag

SEQ ID NO: 18673 - DNA, 2238 bp, Artificial Sequence
  Description of Artificial Sequence: Synthetic coding sequence
atgaagggcttcaagctgagctgcaccgccagcaacagcaacagaagcacccccgcctgcagccccatcctgagaaagagaagcagaagccccaccccccagaaccaggacggcgacaccatggtggagaagggcagcgaccacagcagcgacaagagccccagcacccccgagcagggcgtgcagagaagctgcagcagccagagcggcagaagcggcggcaagaacagcaagagccacaagagactgagcaagaagagccagagctggtacaacgtgctgagccccacctacaagcagagaaacgaggacttcagaaagctgttcaagcagctgcccgacaccgagagactgatcgtggactacagctgcgccctgcagagagacatcctgctgcagggcagactgtacctgagcgagaactggatctgcttctacagcaacatcttcagatgggagaccctgctgaccgtgagactgaaggacatctgcagcatgaccaaggagaagaccgccagactgatccccaacgccatccaggtgtgcaccgacagcgagaagcacttcttcaccagcttcggcgccagagacagaacctacatgatgatgttcagactgtggcagaacgccctgctggagaagcccctgtgccccaaggagctgtggcacttcgtgcaccagtgctacggcaacgagctgggcctgaccagcgacgacgaggactacgtgccccccgacgacgacttcaacaccatgggctactgcgaggagatccccgtggaggagaacgaggtgaacgacagcagcagcaagagcagcatcgagaccaagcccgacgccagcccccagctgcccaagaagagcatcaccaacagcaccctgaccagcaccggcagcagcgaggcccccgtgagcttcgacggcctgcccctggaggaggaggccctggagggcgacggcagcctggagaaggagctggccatcgacaacatcatgggcgagaagatcgagatgatcgcccccgtgaacagccccagcctggacttcaacgacaacgaggacatccccaccgagctgagcgacagcagcgacacccacgacgagggcgaggtgcaggccttctacgaggacctgagcggcagacagtacgtgaacgaggtgttcaacttcagcgtggacaagctgtacgacctgctgttcaccaacagccccttccagagagacttcatggagcagagaagattcagcgacatcatcttccacccctggaagaaggaggagaacggcaaccagagcagagtgatcctgtacaccatcaccctgaccaaccccctggcccccaagaccgccaccgtgagagagacccagaccatgtacaaggccagccaggagagcgagtgctacgtgatcgacgccgaggtgctgacccacgacgtgccctaccacgactacttctacaccatcaacagatacaccctgaccagagtggccagaaacaagagcagactgagagtgagcaccgagctgagatacagaaagcagccctggggcctggtgaagaccttcatcgagaagaacttctggagcggcctggaggactacttcagacacctggagagcgagctggccaagaccgagagcacctacctggccgagatgcacagacagagccccaaggagaaggccagcaagaccaccaccgtgagaagaagaaagagaccccacgcccacctgagagtgccccacctggaggaggtgatgagccccgtgaccacccccaccgacgaggacgtgggccacagaatcaagcacgtggccggcagcacccagaccagacacatccccgaggacacccccaacggcttccacctgcagagcgtgagcaagctgctgctggtgatcagctgcgtggtgagcttcagcctggtgctgctggtgatcctgaacatgatgctgttctacaagctgtggatgctggagtacaccacccagaccctgaccgcctggcagggcctgagactgcaggagagactgccccagagccagaccgagtgggcccagctgctggagagccagcagaagtaccacgacaccgagctgcagaagtggagagagatcatcaagagcagcgtgatgctgctggaccagatgaaggacagcctgatcaacctgcagaacggcatcagaagcagagactacaccagcgagagcgaggagaagagaaacagataccactag

SEQ ID NO: 18674 - DNA, 1989 bp, Artificial Sequence
  Description of Artificial Sequence: Synthetic coding sequence
atggagggcgcccccaccgtgagacaggtgatgaacgagggcgacagcagcctggccaccgacctgcaggaggacgtggaggagaaccccagccccaccgtggaggagaacaacgtggtggtgaagaagcagggccccaacctgcacaactggagcggcgactggagcttctggatcagcagcagcacctacaaggacagaaacgaggagtacagaagacagttcacccacctgcccgacaccgagagactgatcgccgactacgcctgcgccctgcagagagacatcctgctgcagggcagactgtacctgagcgagaactggctgtgcttctacagcaacatcttcagatgggagaccaccatcagcatcgccctgaagaacatcaccttcatgaccaaggagaagaccgccagactgatccccaacgccatccagatcgtgaccgagagcgagaagttcttcttcaccagcttcggcgccagagacagaagctacctgagcatcttcagactgtggcagaacgtgctgctggacaagagcctgaccagacaggagttctggcagctgctgcagcagaactacggcaccgagctgggcctgaacgccgaggagatggagaacctgagcctgagcatcgaggacgtgcagcccagaagccccggcagaagcagcctggacgacagcggcgagagagacgagaagctgagcaagagcatcagcttcaccagcgagagcatcagcagagtgagcgagaccgagagcttcgacggcaacagcagcaagggcggcctgggcaaggaggagagccagaacgagaagcagaccaagaagagcctgctgcccaccctggagaagaagctgaccagagtgcccagcaagagcctggacctgaacaagaacgagtacctgagcctggacaagagcagcaccagcgacagcgtggacgaggagaacgtgcccgagaaggacctgcacggcagactgttcatcaacagaatcttccacatcagcgccgacagaatgttcgagctgctgttcaccagcagcagattcatgcagaagttcgccagcagcagaaacatcatcgacgtggtgagcaccccctggaccgccgagctgggcggcgaccagctgagaaccatgacctacaccatcgtgctgaacagccccctgaccggcaagtgcaccgccgccaccgagaagcagaccctgtacaaggagagcagagaggccagattctacctggtggacagcgaggtgctgacccacgacgtgccctaccacgactacttctacaccgtgaacagatactgcatcatcagaagcagcaagcagaagtgcagactgagagtgagcaccgacctgaagtacagaaagcagccctggggcctggtgaagagcctgatcgagaagaacagctggagcagcctggaggactacttcaagcagctggagagcgacctgctgatcgaggagagcgtgctgaaccaggccatcgaggaccccggcaagctgaccggcctgagaagaagaagaagaaccttcaacagaaccgccgagaccgtgcccaagctgagcagccagcacagcagcggcgacgtgggcctgggcgccaagggcgacatcaccggcaagaagaaggagatggagaactacaacgtgaccctgatcgtggtgatgagcatcttcgtgctgctgctggtgctgctgaacgtgaccctgttcctgaagctgagcaagatcgagcacgccgcccagagcttctacagactgagactgcaggaggagaagagcctgaacctggccagcgacatggtgagcagagccgagaccatccagaagaacaaggaccaggcccacagactgaagggcgtgctgagagacagcatcgtgatgctggagcagctgaagagcagcctgatcatgctgcagaagaccttcgacctgctgaacaagaacaagaccggcatggccgtggagagctag

SEQ ID NO: 18675 - DNA, 1374 bp, Artificial Sequence
  Description of Artificial Sequence: Synthetic coding sequence
atggagaacctgagcctgagcatcgaggacgtgcagcccagaagccccggcagaagcagcctggacgacagcggcgagagagacgagaagctgagcaagagcatcagcttcaccagcgagagcatcagcagagtgagcgagaccgagagcttcgacggcaacagcagcaagggcggcctgggcaaggaggagagccagaacgagaagcagaccaagaagagcctgctgcccaccctggagaagaagctgaccagagtgcccagcaagagcctggacctgaacaagaacgagtacctgagcctggacaagagcagcaccagcgacagcgtggacgaggagaacgtgcccgagaaggacctgcacggcagactgttcatcaacagaatcttccacatcagcgccgacagaatgttcgagctgctgttcaccagcagcagattcatgcagaagttcgccagcagcagaaacatcatcgacgtggtgagcaccccctggaccgccgagctgggcggcgaccagctgagaaccatgacctacaccatcgtgctgaacagccccctgaccggcaagtgcaccgccgccaccgagaagcagaccctgtacaaggagagcagagaggccagattctacctggtggacagcgaggtgctgacccacgacgtgccctaccacgactacttctacaccgtgaacagatactgcatcatcagaagcagcaagcagaagtgcagactgagagtgagcaccgacctgaagtacagaaagcagccctggggcctggtgaagagcctgatcgagaagaacagctggagcagcctggaggactacttcaagcagctggagagcgacctgctgatcgaggagagcgtgctgaaccaggccatcgaggaccccggcaagctgaccggcctgagaagaagaagaagaaccttcaacagaaccgccgagaccgtgcccaagctgagcagccagcacagcagcggcgacgtgggcctgggcgccaagggcgacatcaccggcaagaagaaggagatggagaactacaacgtgaccctgatcgtggtgatgagcatcttcgtgctgctgctggtgctgctgaacgtgaccctgttcctgaagctgagcaagatcgagcacgccgcccagagcttctacagactgagactgcaggaggagaagagcctgaacctggccagcgacatggtgagcagagccgagaccatccagaagaacaaggaccaggcccacagactgaagggcgtgctgagagacagcatcgtgatgctggagcagctgaagagcagcctgatcatgctgcagaagaccttcgacctgctgaacaagaacaagaccggcatggccgtggagagctag

SEQ ID NO: 18676 - DNA, 1176 bp, Artificial Sequence
  Description of Artificial Sequence: Synthetic coding sequence
atgaacatcttcctgtggaccaaggccgccctgcagatcctgctgatgaagtacgccgccggccacggcctggtgatcagatgcctgcccgagttcagaaccctgggcagaagcaccctggcccccagcggccagatcgagaacgtgcccgagaaggacctgcacggcagactgttcatcaacagaatcttccacatcagcgccgacagaatgttcgagctgctgttcaccagcagcagattcatgcagaagttcgccagcagcagaaacatcatcgacgtggtgagcaccccctggaccgccgagctgggcggcgaccagctgagaaccatgacctacaccatcgtgctgaacagccccctgaccggcaagtgcaccgccgccaccgagaagcagaccctgtacaaggagagcagagaggccagattctacctggtggacagcgaggtgctgacccacgacgtgccctaccacgactacttctacaccgtgaacagatactgcatcatcagaagcagcaagcagaagtgcagactgagagtgagcaccgacctgaagtacagaaagcagccctggggcctggtgaagagcctgatcgagaagaacagctggagcagcctggaggactacttcaagcagctggagagcgacctgctgatcgaggagagcgtgctgaaccaggccatcgaggaccccggcaagctgaccggcctgagaagaagaagaagaaccttcaacagaaccgccgagaccgtgcccaagctgagcagccagcacagcagcggcgacgtgggcctgggcgccaagggcgacatcaccggcaagaagaaggagatggagaactacaacgtgaccctgatcgtggtgatgagcatcttcgtgctgctgctggtgctgctgaacgtgaccctgttcctgaagctgagcaagatcgagcacgccgcccagagcttctacagactgagactgcaggaggagaagagcctgaacctggccagcgacatggtgagcagagccgagaccatccagaagaacaaggaccaggcccacagactgaagggcgtgctgagagacagcatcgtgatgctggagcagctgaagagcagcctgatcatgctgcagaagaccttcgacctgctgaacaagaacaagaccggcatggccgtggagagctag

SEQ ID NO: 18677 - DNA, 1143 bp, Artificial Sequence
  Description of Artificial Sequence: Synthetic coding sequence
atggagaacctgagcctgagcatcgaggacgtgcagcccagaagccccggcagaagcagcctggacgacagcggcgagagagacgagaagctgagcaagagcatcagcttcaccagcgagagcatcagcagagtgagcgagaccgagagcttcgacggcaacagcagcaagggcggcctgggcaaggaggagagccagaacgagaagcagaccaagaagagcctgctgcccaccctggagaagaagctgaccagagtgcccagcaagagcctggacctgaacaagaacgagtacctgagcctggacaagagcagcaccagcgacagcgtggacgaggagaacgtgcccgagaaggacctgcacggcagactgttcatcaacagaatcttccacatcagcgccgacagaatgttcgagctgctgttcaccagcagcagattcatgcagaagttcgccagcagcagaaacatcatcgacgtggtgagcaccccctggaccgccgagctgggcggcgaccagctgagaaccatgacctacaccatcgtgctgaacagccccctgaccggcaagtgcaccgccgccaccgagaagcagaccctgtacaaggagagcagagaggccagattctacctggtggacagcgaggtgctgacccacgacgtgccctaccacgactacttctacaccgtgaacagatactgcatcatcagaagcagcaagcagaagtgcagactgagagtgagcaccgacctgaagtacagaaagcagccctggggcctggtgaagagcctgatcgagaagaacagctggagcagcctggaggactacttcaagcagctggagagcgacctgctgatcgaggagagcgtgctgaaccaggccatcgaggaccccggcaagctgaccggcctgagaagaagaagaagaaccttcaacagaaccgccgagaccgtgcccaagctgagcagccagcacagcagcggcgacgtgggcctgggcgccaagggcgacatcaccggcaagaagaaggagatggagaactacaacgtgaccctgatcgtggtgatgagcatcttcgtgctgctgctggtgctgctgaacgtgaccctgttcctgaagctgagcaagatcgagcacgcctag

SEQ ID NO: 18678 - DNA, 1065 bp, Artificial Sequence
  Description of Artificial Sequence: Synthetic coding sequence
atgaccgccctgagcagaagcgaggccaccgaggagggcggcaaccagcagatgcacagaaagaccgccagcctgaacagccccgtgagctgcaaggagaagcccgacagagtggaggagccccccgactacagcctgcactggcccgagggcctgaagggcgaggagatcaagaagtgcggcagagagggcatcaccctgaacaagtacaaccagcagtaccacaagctgttcaaggacgtgcccctggaggaggtggtgctgaaggtgtgcagctgcgccctgcagagagacttcctgctgcagggcagactgtacatcagccccaactggctgtgcttccacgccagcctgttcggcaaggacatcaaggtggtgatccccgtggtgagcgtgcagatgatcaagaagcacaagatggccagactgctgcccaacggcctggccatcaccaccaacaccagccagaagtacatcttcgtgagcctgctgagcagagacagcgtgtacgacctgctgagaagagtgtgcacccacctgcagcccagcagcaagaagagcctgagcgtgagagagttcagcggcgagcccgagagcctggaggtgctgatccccgagatgaagtggagaaaggtgtgccccagcagcagaagcctgagcctgcccgacaacatcccctgcatcccccccagcagcgtggacagcaccgacagcttcttccccagcagaaagccccccatgagcgagaagagcagagcccaggtggccagcgagaacggcggcagatgggcctggcccatgcccggctggggccccgcctgccccaagaagatgcccaactgcagccccaccgccaagaacgccgtgtacgaggaggacgagctggaggaggagcccagaagcaccggcgagctgagactgtgggactacagactgctgaaggtgttcttcgtgctgatctgcttcctggtgatgagcagcagctacctggccttcagaatcagcagactggagcagcagctgtgcagcctgagctgggacgaccccgtgcccggccacagatag

SEQ ID NO: 18679 - DNA, 474 bp, Artificial Sequence
  Description of Artificial Sequence: Synthetic coding sequence
atgagcaagagctgcggcaacaacctggccgccatcagcgtgggcatcagcctgctgctgctgctggtggtgtgcggcatcggctgcgtgtggcactggaagcacagagtggccaccagattcaccctgcccagattcctgcagagaagaagcagcagaagaaaggtgtgcaccaagaccttcctgggccccagaatcatcggcctgagacacgagatcagcgtggagacccaggaccacaagagcgccgtgagaggcaacaacacccacgacaactacgagaacgtggaggccggcccccccaaggccaagggcaagaccgacaaggagctgtacgagaacaccggccagagcaacttcgaggagcacatctacggcaacgagaccagcagcgactactacaacttccagaagcccagacccagcgaggtgccccaggacgaggacatctacatcctgcccgacagctactag

SEQ ID NO: 18680 - DNA, 474 bp, Artificial Sequence; identical to SEQ ID NO: 18679
  Description of Artificial Sequence: Synthetic coding sequence

SEQ ID NO: 18681 - DNA, 207 bp, Artificial Sequence
  Description of Artificial Sequence: Synthetic coding sequence
atgagcaagagctgcggcaacaacctggccgccatcagcgtgggcatcagcctgctgctgctgctggtggtgtgcggcatcggctgcgtgtggcactggaagcacagagtggccaccagattcaccctgcccagattcctgcagagaagaagcagcagaagaaaggtgtgcaccaagaccttcctgggccccagaatcatcggctag

SEQ ID NO: 18682 - DNA, 210 bp, Artificial Sequence
  Description of Artificial Sequence: Synthetic coding sequence
atgagcaagagctgcggcaacaacctggccgccatcagcgtgggcatcagcctgctgctgctgctggtggtgtgcggcatcggctgcgtgtggcactggaagcacagagtggccaccagattcaccctgcccagattcctgcagagaagaagcagcagaagaaaggtgtgcaccaagaccttcctgggccccagaatcatcggcctgtag

SEQ ID NO: 18683 - DNA, 753 bp, Artificial Sequence
  Description of Artificial Sequence: Synthetic coding sequence
atgatccagagcagccagcccatgagcctgaagctgacctgcagcgccttcagactgcagagagccctgagattcctgctgggcagactgccctggagagtggccagcggcgccagaagattcagaagatggctgaacagatacagctacaccgtgctgagcagctggcccgagagagccctgatcagcctgaagaacagaagcagattcctggtgagacccaacaccagaaacagagccttcagctggacctgcagagccgccagaagcaagcccagacccagaagaagcaccgccctgcccagaagccaggccagcagcagcagacacagctgggccgagttcctgaagttcagaaagagcttccagatgagcaacaccagccagcccgaccccagcagacccggcaccgagagaaccagcagcaaggaggccggctgcagacccctgggccagctggacagcttcagctgggccgccagacccccccccggcgccgccggcctggccgtgagcgagggcttcttcagaaagatcagaagcagcgcccccagcagccccagcttcagcagagccctgatgagcaacacctacctgtgcttcctgaccaccggccccagaagcagcagagagaacacccagaagagcttccccgccaccagccccagagagcccgtgaccagcagactgagaggcaaggcccccgccctgagccccagcagagagctgagcttcaccagcgcccccttctag

SEQ ID NO: 18684 - DNA, 978 bp, Artificial Sequence
  Description of Artificial Sequence: Synthetic coding sequence
atgctggccgccagactggtgtgcctgagaaccctgcccagcagagtgttccaccccgccttcaccaaggccagccccgtggtgaagaacagcatcaccaagaaccagtggctgctgacccccagcagagagtacgccaccaagaccagaatcggcatcagaagaggcagaaccggccaggagctgaaggaggccgccctggagcccagcatggagaagatcttcaagatcgaccagatgggcagatggttcgtggccggcggcgccatcgagaaggccgtgatctggccccagtacgtgaaggacagaatccacagcacctacatgtacctggccggcagcatcggcctgaccgccctgagcgccatcgccatcagcagaacccccgtgctgatgaacttcatgatgagaggcagctgggtgaccatcggcgtgaccttcgccgccatggtgggcgccggcatgctggtgagaagcatcccctacgaccagagccccggccccaagcacctggcctggctgctgcacagcggcgtgatgggcgccgtggtggcccccctgaccatcctgggcggccccctgctgatcagagccgcctggtacaccgccggcatcgtgggcggcctgagcaccgtggccatgtgcgcccccagcgagaagttcctgaacatgggcgcccccctgggcgtgggcctgggcctggtgttcgtgagcagcctgggcagcatgttcctgccccccaccaccgtggccggcgccaccctgtacagcgtggccatgtacggcggcctggtgctgttcagcatgttcctgctgtacgacacccagaaggtgatcaagagagccgaggtgagccccatgtacggcgtgcagaagtacgaccccatcaacagcatgctgagcatctacatggacaccctgaacatcttcatgagagtggccaccatgctggccaccggcggcaacagaaagaagtag

SEQ ID NO: 18685 - DNA, 1038 bp, Artificial Sequence
  Description of Artificial Sequence: Synthetic coding sequence
atgctggccgccagactggtgtgcctgagaaccctgcccagcagagtgttccaccccgccttcaccaaggccagccccgtggtgaagaacagcatcaccaagaaccagtggctgctgacccccagcagagagtacgccaccaagaccagaatcggcatcagaagaggcagaaccggccaggagctgaaggaggccgccctggagcccagcatggagaagatcttcaagatcgaccagatgggcagatggttcgtggccggcggcgccgccgtgggcctgggcgccctgtgctactacggcctgggcctgagcaacgagatcggcgccatcgagaaggccgtgatctggccccagtacgtgaaggacagaatccacagcacctacatgtacctggccggcagcatcggcctgaccgccctgagcgccatcgccatcagcagaacccccgtgctgatgaacttcatgatgagaggcagctgggtgaccatcggcgtgaccttcgccgccatggtgggcgccggcatgctggtgagaagcatcccctacgaccagagccccggccccaagcacctggcctggctgctgcacagcggcgtgatgggcgccgtggtggcccccctgaccatcctgggcggccccctgctgatcagagccgcctggtacaccgccggcatcgtgggcggcctgagcaccgtggccatgtgcgcccccagcgagaagttcctgaacatgggcgcccccctgggcgtgggcctgggcctggtgttcgtgagcagcctgggcagcatgttcctgccccccaccaccgtggccggcgccaccctgtacagcgtggccatgtacggcggcctggtgctgttcagcatgttcctgctgtacgacacccagaaggtgatcaagagagccgaggtgagccccatgtacggcgtgcagaagtacgaccccatcaacagcatgctgagcatctacatggacaccctgaacatcttcatgagagtggccaccatgctggccaccggcggcaacagaaagaagtag

SEQ ID NO: 18686 - DNA, 960 bp, Artificial Sequence
  Description of Artificial Sequence: Synthetic coding sequence
atgctggccgccagactggtgtgcctgagaaccctgcccagcagagtgttccaccccgccttcaccaaggccagccccgtggtgaagaacagcatcaccaagaaccagtggctgctgacccccagcagagagtacgccaccaagaccagaatcggcatcagaagaggcagaaccggccaggagctgaaggaggccgccctggagcccagcatggagaagatcttcaagatcgaccagatgggcagatggttcgtggccggcggcgccgccgtgggcctgggcgccctgtgctactacggcctgggcctgagcaacgagatcggcgccatcgagaaggccgtgatctggccccagtacgtgaaggacagaatccacagcacctacatgtacctggccggcagcatcggcctgaccgccctgagcgccatcgccatcagcagaacccccgtgctgatgaacttcatgatgagaggcagctgggtgaccatcggcgtgaccttcgccgccatggtgggcgccggcatgctggtgagaagcatcccctacgaccagagccccggccccaagcacctggcctggctgctgcacagcggcgtgatgggcgccgtggtggcccccctgaccatcctgggcggccccctgctgatcagagccgcctggtacaccgccggcatcgtgggcggcctgagcaccgtggccatgtgcgcccccagcgagaagttcctgaacatgggcgcccccctgggcgtgggcctgggcctggtgttcgtgagcagcctgggcagcatgttcctgccccccaccaccgtggccggcgccaccctgtacagcgtggccatgtacggcggcctggtgctgttcagcatgttcctgctgtacgacacccagaaggtgagcagcgtgcagaagtaccaccagtgcatggagttcaagaacatgatccccctgaccagatgctag

SEQ ID NO: 18687 - DNA, 999 bp, Artificial Sequence
  Description of Artificial Sequence: Synthetic coding sequence
atgctggccgccagactggtgtgcctgagaaccctgcccttcgtgaagaacagcatcaccaagaaccagtggctgctgacccccagcagagagtacgccaccaagaccagaatcggcatcagaagaggcagaaccggccaggagctgaaggaggccgccctggagcccagcatggagaagatcttcaagatcgaccagatgggcagatggttcgtggccggcggcgccgccgtgggcctgggcgccctgtgctactacggcctgggcctgagcaacgagatcggcgccatcgagaaggccgtgatctggccccagtacgtgaaggacagaatccacagcacctacatgtacctggccggcagcatcggcctgaccgccctgagcgccatcgccatcagcagaacccccgtgctgatgaacttcatgatgagaggcagctgggtgaccatcggcgtgaccttcgccgccatggtgggcgccggcatgctggtgagaagcatcccctacgaccagagccccggccccaagcacctggcctggctgctgcacagcggcgtgatgggcgccgtggtggcccccctgaccatcctgggcggccccctgctgatcagagccgcctggtacaccgccggcatcgtgggcggcctgagcaccgtggccatgtgcgcccccagcgagaagttcctgaacatgggcgcccccctgggcgtgggcctgggcctggtgttcgtgagcagcctgggcagcatgttcctgccccccaccaccgtggccggcgccaccctgtacagcgtggccatgtacggcggcctggtgctgttcagcatgttcctgctgtacgacacccagaaggtgatcaagagagccgaggtgagccccatgtacggcgtgcagaagtacgaccccatcaacagcatgctgagcatctacatggacaccctgaacatcttcatgagagtggccaccatgctggccaccggcggcaacagaaagaagtag

SEQ ID NO: 18688 - DNA, 5445 bp, Artificial Sequence
  Description of Artificial Sequence: Synthetic coding sequence
atgggcaacagctacgccggccagctgaagagcgccagattcgaggaggccctgcacaacagcatcgaggccagcctgagatgcagcagcgtggtgcccagacccatcttcagccagctgtacctggaccccgaccagcaccccttcagcagcgccgacgtgaagcccaaggtggaggacctggacaaggacctggtgaacagatacacccagaacggcagcctggacttcagcaacaacctgaccgtgaacgagatggaggacgacgaggacgacgaggagatgagcgacagcaacagcccccccatcccctacagccagaagcccgcccccgagggcagctgcaccaccgacggcttctgccaggccggcaaggacctgagactggtgagcctgtgcatggagcagatcgacatccccgccggcttcctgctggtgggcgccaagagccccaacctgcccgagcacatcctggtgtgcgccgtggacaagagattcctgcccgacgaccacggcaagaacgccctgctgggcttcagcggcaactgcatcggctgcggcgagagaggcttcagatacttcaccgagttcagcaaccacatcaacctgaagctgaccacccagcccaagaagcagaagcacctgaagtactacctggtgagaagcagccagggcgtgctgagcaagggccccctgatctgctggaaggagtgcagaagcagacagagcagcgccagctgccacagcatcaagcccagcagcagcgtgagcagcaccgtgacccccgagaacggcaccaccaacggctacaagagcggcttcacccagaccgacgccgccaacggcaacagcagccacggcggcaagggcagcgccagcagcagcacccccgcccacaccggcaactacagcctgagccccagacccagctacgccagcggcgaccaggccaccatgttcatcagcggcccccccaagaagagacacagaggctggtaccccggcagccccctgccccagcccggcctggtggtgcccgtgcccaccgtgagacccctgagcagaaccgagcccctgctgagcgcccccgtgccccagacccccctgaccggcatcctgcagcccagacccatccccgccggcgagaccgtgatcgtgcccgagaacctgctgagcaacagcggcgtgagacccgtgatcctgatcggctacggcaccctgccctacttctacggcaacgtgggcgacatcgtggtgagccccctgctggtgaactgctacaagatcccccagctggagaacaaggacctggagaagctgggcctgaccggcagccagttcctgagcgtggagaacatgatcctgctgaccatccagtacctggtgagactgggccagcaccagagcagagccctggccgagagcatgctgaccaccagcgagttcctgaaggagatcagctacgagctgatcaccggcaaggtgagcttcctggccagccacttcaagaccaccagcctgggcgacgacctggacaagctgctggagaagatgcagcagagaagaggcgacagcgtggtgacccccttcgacggcgacctgaacgagtgcgtgagcccccaggaggccgccgccatgatccccacccagaacctggacctggacaacgagaccttccacatctaccagccccagctgaccgtggccagaaagctgctgagccaggtgtgcgccatcgccgacagcggcagccagagcctggacctgggccacttcagcaaggtggacttcatcatcatcgtgcccagaagcgaggtgctggtgcagcagaccctgcagagaatcagacagagcggcgtgctggtggacctgggcctggaggagaacggcaccgcccaccagagagccgagaagtacgtggtgagactggacaacgagatccagaccaagttcgaggtgttcatgagaagagtgaagcagaacccctacaccctgttcgtgctggtgcacgacaacagccacgtggagctgaccagcgtgatcagcggcagcctgagccacagcgagcccagccacggcctggccgacagagtgatcaactgcagagaggtgctggaggccttcaacctgctggtgctgcaggtgagcagcttcccctacaccctgcagacccagcagagcagaatcagcagcagcaacgaggtgcactggatccagctggacaccggcgaggacgtgggctgcgaggagaagctgtacttcggcctgagcgagtacagcaagagcctgcagtggggcatcaccagccccctgctgagatgcgacgagaccttcgagaagatggtgaacaccctgctggagagataccccagactgcacagcatggtggtgagatgctacctgctgatccagcagtacagcgaggccctgatggccctgaccaccatggccagcctgagagaccacagcacccccgagaccctgagcatcatggacgacctgatcagcagccccggcaagaacaagagcggcagaggccacatgctgatcatcagagtgcccagcgtgcagctggccatgctggccaaggagagactgcaggaggtgagagacaagctgggcctgcagtacagattcgagatcatcctgggcaaccccgccaccgagctgagcgtggccacccacttcgtggccagactgaagagctggagaggcaacgagcccgaggagtggatccccagaacctaccaggacctggacggcctgccctgcatcgtgatcctgaccggcaaggaccccctgggcgagaccttccccagaagcctgaagtactgcgacctgagactgatcgacagcagctacctgaccagaaccgccctggagcaggaggtgggcctggcctgctgctacgtgagcaaggaggtgatcagaggccccaccgtggccctggacctgagcggcaaggagcaggagagagccgccgtgagcgagaacgacagcgacgagctgctgatcgacctggagagaccccagagcaacagcagcgccgtgaccggcaccagcggcagcatcatggagaacggcgtgagcagcagcagcaccgccgacaagagccagaagcagagcctgacccccagcttccagagccccgccaccagcctgggcctggacgagggcgtgagcgccagcagcgccggcgccggcgccggcgagaccctgaagcaggagtgcgacagcctgggcccccagatggccagcagcaccaccagcaagcccagcagcagcagcagcggccccagaaccctgccctggcccggccagcccatcagaggctgcagaggcccccaggccgccctgccccccgtggtgatcctgagcaaggccgcctacagcctgctgggcagccagaagagcggcaagctgcccagcagcagcagcctgctgccccacgccgacgtggcctgggtgagcagcctgagacccctgctgaacaaggacatgagcagcgaggagcagagcctgtactacagacagtggaccctggccagacagcaccacgccgactacagcaaccagctggaccccgccagcggcaccagaaacttccaccccagaagactgctgctgaccggccccccccaggtgggcaagaccggcagctacctgcagttcctgagaatcctgttcagaatgctgatcagactgctggaggtggacgtgtacgacgaggaggagatcaacaccgaccacaacgagagcagcgaggtgagccagagcgagggcgagccctggcccgacatcgagagcttcagcaagatgcccttcgacgtgagcgtgcacgaccccaagtacagcctgatgagcctggtgtacaccgagaagctggccggcgtgaagcaggaggtgatcaaggagagcaaggtggaggagcccagaaagagagagaccgtgagcatcatgctgaccaagtacgccgcctacaacaccttccaccactgcgagcagtgcagacagtacatggacttcaccagcgccagccagatgagcgacagcaccctgcacgccttcaccttcagcagcagcatgctgggcgaggaggtgcagctgtacttcatcatccccaagagcaaggagagccacttcgtgttcagcaagcagggcaagcacctggagagcatgagactgcccctggtgagcgacaagaacctgaacgccgtgaagagccccatcttcacccccagcagcggcagacacgagcacggcctgctgaacctgttccacgccatggagggcatcagccacctgcacctgctggtggtgaaggagtacgagatgcccctgtacagaaagtactggcccaaccacatcatgctggtgctgcccggcatgttcaacaacgccggcgtgggcgccgccagattcctgatcaaggagctgagctaccacaacctggagctggagagaaacagactggaggagctgggcatcaagagacagtgcgtgtggcccttcatcgtgatgatggacgacagctgcgtgctgtggaacatccacagcgtgcaggagcccagcagccagcccatggaggtgggcgtgagcagcaagaacgtgagcctgaagaccgtgctgcagcacatcgaggccacccccaagatcgtgcactacgccatcctgggcatccagaagtggagcagcaagctgaccagccagagcctgaaggcccccttcagcagatgccacgtgcacgacttcatcctgctgaacaccgacctgacccagaacgtgcagtacgacttcaacagatacttctgcgaggacgccgacttcaacctgagaaccaacagcagcggcctgctgatctgcagattcaacaacttcagcctgatgaagaagcacgtgcaggtgggcggccagagagacttcatcatcaagcccaagatcatggtgagcgagagcctggcccccatcctgcccctgcagtacatctgcgcccccgacagcgagcacaccctgctggccgcccccgcccagttcctgctggagaagttcctgcagcacgccagctacaagctgttccccaaggccatccacaacttcagaagccccgtgctggccatcgactgctacctgaacatcggccccgaggtggccatctgctacatcagcagcagaccccacagcagcaacgtgaactgcgagggcgtgttcttcagcggcctgctgctgtacctgtgcgacagcttcgtgggcgccgacctgaagaagttcaagttcctgaagggcgccaccctgtgcgtgatctgccaggacagaagcagcctgagacagaccatcgtgagactggagctggaggacgagtggcagttcagactgagagacgagttccagaccgccaacagcagcgacgacaagcccctgtacttcctgaccggcagacacgtgtag

SEQ ID NO: 18689 - DNA, 2229 bp, Artificial Sequence
  Description of Artificial Sequence: Synthetic coding sequence
atgggcaacagctacgccggccagctgaagagcgccagattcgaggaggccctgcacaacagcatcgaggccagcctgagatgcagcagcgtggtgcccagacccatcttcagccagctgtacctggaccccgaccagcaccccttcagcagcgccgacgtgaagcccaaggtggaggacctggacaaggacctggtgaacagatacacccagaacggcagcctggacttcagcaacaacctgaccgtgaacgagatggaggacgacgaggacgacgaggagatgagcgacagcaacagcccccccatcccctacagccagaagcccgcccccgagggcagctgcaccaccgacggcttctgccaggccggcaaggacctgagactggtgagcctgtgcatggagcagatcgacatccccgccggcttcctgctggtgggcgccaagagccccaacctgcccgagcacatcctggtgtgcgccgtggacaagagattcctgcccgacgaccacggcaagaacgccctgctgggcttcagcggcaactgcatcggctgcggcgagagaggcttcagatacttcaccgagttcagcaaccacatcaacctgaagctgaccacccagcccaagaagcagaagcacctgaagtactacctggtgagaagcagccagggcgtgctgagcaagggccccctgatctgctggaaggagtgcagaagcagacagagcagcgccagctgccacagcatcaagcccagcagcagcgtgagcagcaccgtgacccccgagaacggcaccaccaacggctacaagagcggcttcacccagaccgacgccgccaacggcaacagcagccacggcggcaagggcagcgccagcagcagcacccccgcccacaccggcaactacagcctgagccccagacccagctacgccagcggcgaccaggccaccatgttcatcagcggcccccccaagaagagacacagaggctggtaccccggcagccccctgccccagcccggcctggtggtgcccgtgcccaccgtgagacccctgagcagaaccgagcccctgctgagcgcccccgtgccccagacccccctgaccggcatcctgcagcccagacccatccccgccggcgagaccgtgatcgtgcccgagaacctgctgagcaacagcggcgtgagacccgtgatcctgatcggctacggcaccctgccctacttctacggcaacgtgggcgacatcgtggtgagccccctgctggtgaactgctacaagatcccccagctggagaacaaggacctggagaagctgggcctgaccggcagccagttcctgagcgtggagaacatgatcctgctgaccatccagtacctggtgagactgggccccgaccaggtgcccctgagagaggagttcgagcagatcatgctgaaggccatgcaggagttcaccctgagagagagagccctgcagatcggcgcccagtgcgtgcccgtgagccccggccagctgccctggctggccagactgatcgccagcgtgagccaggacctggtgcacgtggtggtgacccagaacagcctggccgagggcatcagcgagaccctgagaaccctgagcgagatgagacactaccagagactgcccgactacgtggtggtgatctgcgccagcaagatcagaggcaacgagttctgcgtggtggtgctgggccagcaccagagcagagccctggccgagagcatgctgaccaccagcgagttcctgaaggagatcagctacgagctgatcaccggcaaggtgagcttcctggccagccacttcaagaccaccagcctgggcgacgacctggacaagctgctggagaagatgcagcagagaagaggcgacagcgtggtgacccccttcgacggcgacctgaacgagtgcgtgagcccccaggaggccgccgccatgatccccacccagaacctggacctggacaacgagaccttccacatctaccagccccagctgaccgtggccagaaagctgctgagccaggtgtgcgccatcgccgacagcggcagccagagcctggacctgggccacttcagcaaggtggacttcatcatcatcgtgcccagaagcgaggtgctggtgcagcagaccctgcagagaatcagacagagcgtgagcttccaggccctgtgccacatcgccaaccccgtgatgggctag

SEQ ID NO: 18690 - DNA, 5772 bp, Artificial Sequence
  Description of Artificial Sequence: Synthetic coding sequence
atgggcaacagctacgccggccagctgaagagcgccagattcgaggaggccctgcacaacagcatcgaggccagcctgagatgcagcagcgtggtgcccagacccatcttcagccagctgtacctggaccccgaccagcaccccttcagcagcgccgacgtgaagcccaaggtggaggacctggacaaggacctggtgaacagatacacccagaacggcagcctggacttcagcaacaacctgaccgtgaacgagatggaggacgacgaggacgacgaggagatgagcgacagcaacagcccccccatcccctacagccagaagcccgcccccgagggcagctgcaccaccgacggcttctgccaggccggcaaggacctgagactggtgagcctgtgcatggagcagatcgacatccccgccggcttcctgctggtgggcgccaagagccccaacctgcccgagcacatcctggtgtgcgccgtggacaagagattcctgcccgacgaccacggcaagaacgccctgctgggcttcagcggcaactgcatcggctgcggcgagagaggcttcagatacttcaccgagttcagcaaccacatcaacctgaagctgaccacccagcccaagaagcagaagcacctgaagtactacctggtgagaagcagccagggcgtgctgagcaagggccccctgatctgctggaaggagtgcagaagcagacagagcagcgccagctgccacagcatcaagcccagcagcagcgtgagcagcaccgtgacccccgagaacggcaccaccaacggctacaagagcggcttcacccagaccgacgccgccaacggcaacagcagccacggcggcaagggcagcgccagcagcagcacccccgcccacaccggcaactacagcctgagccccagacccagctacgccagcggcgaccaggccaccatgttcatcagcggcccccccaagaagagacacagaggctggtaccccggcagccccctgccccagcccggcctggtggtgcccgtgcccaccgtgagacccctgagcagaaccgagcccctgctgagcgcccccgtgccccagacccccctgaccggcatcctgcagcccagacccatccccgccggcgagaccgtgatcgtgcccgagaacctgctgagcaacagcggcgtgagacccgtgatcctgatcggctacggcaccctgccctacttctacggcaacgtgggcgacatcgtggtgagccccctgctggtgaactgctacaagatcccccagctggagaacaaggacctggagaagctgggcctgaccggcagccagttcctgagcgtggagaacatgatcctgctgaccatccagtacctggtgagactgggccccgaccaggtgcccctgagagaggagttcgagcagatcatgctgaaggccatgcaggagttcaccctgagagagagagccctgcagatcggcgcccagtgcgtgcccgtgagccccggccagctgccctggctggccagactgatcgccagcgtgagccaggacctggtgcacgtggtggtgacccagaacagcctggccgagggcatcagcgagaccctgagaaccctgagcgagatgagacactaccagagactgcccgactacgtggtggtgatctgcgccagcaagatcagaggcaacgagttctgcgtggtggtgctgggccagcaccagagcagagccctggccgagagcatgctgaccaccagcgagttcctgaaggagatcagctacgagctgatcaccggcaaggtgagcttcctggccagccacttcaagaccaccagcctgggcgacgacctggacaagctgctggagaagatgcagcagagaagaggcgacagcgtggtgacccccttcgacggcgacctgaacgagtgcgtgagcccccaggaggccgccgccatgatccccacccagaacctggacctggacaacgagaccttccacatctaccagccccagctgaccgtggccagaaagctgctgagccaggtgtgcgccatcgccgacagcggcagccagagcctggacctgggccacttcagcaaggtggacttcatcatcatcgtgcccagaagcgaggtgctggtgcagcagaccctgcagagaatcagacagagcggcgtgctggtggacctgggcctggaggagaacggcaccgcccaccagagagccgagaagtacgtggtgagactggacaacgagatccagaccaagttcgaggtgttcatgagaagagtgaagcagaacccctacaccctgttcgtgctggtgcacgacaacagccacgtggagctgaccagcgtgatcagcggcagcctgagccacagcgagcccagccacggcctggccgacagagtgatcaactgcagagaggtgctggaggccttcaacctgctggtgctgcaggtgagcagcttcccctacaccctgcagacccagcagagcagaatcagcagcagcaacgaggtgcactggatccagctggacaccggcgaggacgtgggctgcgaggagaagctgtacttcggcctgagcgagtacagcaagagcctgcagtggggcatcaccagccccctgctgagatgcgacgagaccttcgagaagatggtgaacaccctgctggagagataccccagactgcacagcatggtggtgagatgctacctgctgatccagcagtacagcgaggccctgatggccctgaccaccatggccagcctgagagaccacagcacccccgagaccctgagcatcatggacgacctgatcagcagccccggcaagaacaagagcggcagaggccacatgctgatcatcagagtgcccagcgtgcagctggccatgctggccaaggagagactgcaggaggtgagagacaagctgggcctgcagtacagattcgagatcatcctgggcaaccccgccaccgagctgagcgtggccacccacttcgtggccagactgaagagctggagaggcaacgagcccgaggagtggatccccagaacctaccaggacctggacggcctgccctgcatcgtgatcctgaccggcaaggaccccctgggcgagaccttccccagaagcctgaagtactgcgacctgagactgatcgacagcagctacctgaccagaaccgccctggagcaggaggtgggcctggcctgctgctacgtgagcaaggaggtgatcagaggccccaccgtggccctggacctgagcggcaaggagcaggagagagccgccgtgagcgagaacgacagcgacgagctgctgatcgacctggagagaccccagagcaacagcagcgccgtgaccggcaccagcggcagcatcatggagaacggcgtgagcagcagcagcaccgccgacaagagccagaagcagagcctgacccccagcttccagagccccgccaccagcctgggcctggacgagggcgtgagcgccagcagcgccggcgccggcgccggcgagaccctgaagcaggagtgcgacagcctgggcccccagatggccagcagcaccaccagcaagcccagcagcagcagcagcggccccagaaccctgccctggcccggccagcccatcagaggctgcagaggcccccaggccgccctgccccccgtggtgatcctgagcaaggccgcctacagcctgctgggcagccagaagagcggcaagctgcccagcagcagcagcctgctgccccacgccgacgtggcctgggtgagcagcctgagacccctgctgaacaaggacatgagcagcgaggagcagagcctgtactacagacagtggaccctggccagacagcaccacgccgactacagcaaccagctggaccccgccagcggcaccagaaacttccaccccagaagactgctgctgaccggccccccccaggtgggcaagaccggcagctacctgcagttcctgagaatcctgttcagaatgctgatcagactgctggaggtggacgtgtacgacgaggaggagatcaacaccgaccacaacgagagcagcgaggtgagccagagcgagggcgagccctggcccgacatcgagagcttcagcaagatgcccttcgacgtgagcgtgcacgaccccaagtacagcctgatgagcctggtgtacaccgagaagctggccggcgtgaagcaggaggtgatcaaggagagcaaggtggaggagcccagaaagagagagaccgtgagcatcatgctgaccaagtacgccgcctacaacaccttccaccactgcgagcagtgcagacagtacatggacttcaccagcgccagccagatgagcgacagcaccctgcacgccttcaccttcagcagcagcatgctgggcgaggaggtgcagctgtacttcatcatccccaagagcaaggagagccacttcgtgttcagcaagcagggcaagcacctggagagcatgagactgcccctggtgagcgacaagaacctgaacgccgtgaagagccccatcttcacccccagcagcggcagacacgagcacggcctgctgaacctgttccacgccatggagggcatcagccacctgcacctgctggtggtgaaggagtacgagatgcccctgtacagaaagtactggcccaaccacatcatgctggtgctgcccggcatgttcaacaacgccggcgtgggcgccgccagattcctgatcaaggagctgagctaccacaacctggagctggagagaaacagactggaggagctgggcatcaagagacagtgcgtgtggcccttcatcgtgatgatggacgacagctgcgtgctgtggaacatccacagcgtgcaggagcccagcagccagcccatggaggtgggcgtgagcagcaagaacgtgagcctgaagaccgtgctgcagcacatcgaggccacccccaagatcgtgcactacgccatcctgggcatccagaagtggagcagcaagctgaccagccagagcctgaaggcccccttcagcagatgccacgtgcacgacttcatcctgctgaacaccgacctgacccagaacgtgcagtacgacttcaacagatacttctgcgaggacgccgacttcaacctgagaaccaacagcagcggcctgctgatctgcagattcaacaacttcagcctgatgaagaagcacgtgcaggtgggcggccagagagacttcatcatcaagcccaagatcatggtgagcgagagcctggcccccatcctgcccctgcagtacatctgcgcccccgacagcgagcacaccctgctggccgcccccgcccagttcctgctggagaagttcctgcagcacgccagctacaagctgttccccaaggccatccacaacttcagaagccccgtgctggccatcgactgctacctgaacatcggccccgaggtggccatctgctacatcagcagcagaccccacagcagcaacgtgaactgcgagggcgtgttcttcagcggcctgctgctgtacctgtgcgacagcttcgtgggcgccgacctgaagaagttcaagttcctgaagggcgccaccctgtgcgtgatctgccaggacagaagcagcctgagacagaccatcgtgagactggagctggaggacgagtggcagttcagactgagagacgagttccagaccgccaacagcagcgacgacaagcccctgtacttcctgaccggcagacacgtgtag

SEQ ID NO: 18691 - DNA, 2244 bp, Artificial Sequence
  Description of Artificial Sequence: Synthetic coding sequence
atgggcaacagctacgccggccagctgaagagcgccagattcgaggaggccctgcacaacagcatcgaggccagcctgagatgcagcagcgtggtgcccagacccatcttcagccagctgtacctggaccccgaccagcaccccttcagcagcgccgacgtgaagcccaaggtggaggacctggacaaggacctggtgaacagatacacccagaacggcagcctggacttcagcaacaacctgaccgtgaacgagatggaggacgacgaggacgacgaggagatgagcgacagcaacagcccccccatcccctacagccagaagcccgcccccgagggcagctgcaccaccgacggcttctgccaggccggcaaggacctgagactggtgagcctgtgcatggagcagatcgacatccccgccggcttcctgctggtgggcgccaagagccccaacctgcccgagcacatcctggtgtgcgccgtggacaagagattcctgcccgacgaccacggcaagaacgccctgctgggcttcagcggcaactgcatcggctgcggcgagagaggcttcagatacttcaccgagttcagcaaccacatcaacctgaagctgaccacccagcccaagaagcagaagcacctgaagtactacctggtgagaagcagccagggcgtgctgagcaagggccccctgatctgctggaaggagtgcagaagcagacagagcagcgccagctgccacagcatcaagcccagcagcagcgtgagcagcaccgtgacccccgagaacggcaccaccaacggctacaagagcggcttcacccagaccgacgccgccaacggcaacagcagccacggcggcaagggcagcgccagcagcagcacccccgcccacaccggcaactacagcctgagccccagacccagctacgccagcggcgaccaggccaccatgttcatcagcggcccccccaagaagagacacagaggctggtaccccggcagccccctgccccagcccggcctggtggtgcccgtgcccaccgtgagacccctgagcagaaccgagcccctgctgagcgcccccgtgccccagacccccctgaccggcatcctgcagcccagacccatccccgccggcgagaccgtgatcgtgcccgagaacctgctgagcaacagcggcgtgagacccgtgatcctgatcggctacggcaccctgccctacttctacggcaacgtgggcgacatcgtggtgagccccctgctggtgaactgctacaagatcccccagctggagaacaaggacctggagaagctgggcctgaccggcagccagttcctgagcgtggagaacatgatcctgctgaccatccagtacctggtgagactgggccccgaccaggtgcccctgagagaggagttcgagcagatcatgctgaaggccatgcaggagttcaccctgagagagagagccctgcagatcggcgcccagtgcgtgcccgtgagccccggccagctgccctggctggccagactgatcgccagcgtgagccaggacctggtgcacgtggtggtgacccagaacagcctggccgagggcatcagcgagaccctgagaaccctgagcgagatgagacactaccagagactgcccgactacgtggtggtgatctgcgccagcaagatcagaggcaacgagttctgcgtggtggtgctgggccagcaccagagcagagccctggccgagagcatgctgaccaccagcgagttcctgaaggagatcagctacgagctgatcaccggcaaggtgagcttcctggccagccacttcaagaccaccagcctgggcgacgacctggacaagctgctggagaagatgcagcagagaagaggcgacagcgtggtgacccccttcgacggcgacctgaacgagtgcgtgagcccccaggaggccgccgccatgatccccacccagaacctggacctggacaacgagaccttccacatctaccagccccagctgaccgtggccagaaagctgctgagccaggtgtgcgccatcgccgacagcggcagccagagcctggacctgggccacttcagcaaggtggacttcatcatcatcgtgcccagaagcgaggtgctggtgcagcagaccctgcagagaatcagacagagcggcagcagccccggcagccacatcgccttcagctacgtgctgttcatcagctgcaacctgtag

SEQ ID NO: 18692 - DNA, 531 bp, Artificial Sequence
  Description of Artificial Sequence: Synthetic coding sequence
atgtgcctggagctgttccacagcagcaacgtgatcgacggcctgaagctgaacgccttcgccgccgtgttcaccgtgctgagcggcctgctgggcatggtggcccacatgatgtacacccaggtgttccaggtgaccgtgagcctgggccccgaggactggagaccccacagctgggactacggctggagcttctgcctggcctggggcagcttcacctgctgcatggccgccagcgtgaccaccctgaacagctacaccaagaccgtgatcgagttcagacacaagagaaaggtgttcgagcagggctacagagaggagcccaccttcatcgaccccgaggccatcaagtacttcagagagagaatggagaagagagacggcagcgaggaggacttccacctggactgcagacacgagagataccccgccagacaccagccccacatggccgacagctggcccagaagcagcgcccaggaggcccccgagctgaacagacagtgctgggtgctgggccactgggtgtag

SEQ ID NO: 18693 - DNA, 585 bp, Artificial Sequence
  Description of Artificial Sequence: Synthetic coding sequence
atgtgcctggagctgttccacagcagcaacgtgatcgacggcctgaagctgaacgccttcgccgccgtgttcaccgtgctgagcggcctgctgggcatggtggcccacatgatgtacacccaggtgttccaggtgaccgtgagcctgggccccgaggactggagaccccacagctgggactacggctggagcttctgcctggcctggggcagcttcacctgctgcatggccgccagcgtgaccaccctgaacagctacaccaagaccgtgatcgagttcagacacaagagaaaggtgttcgagcagggctacagagaggagcccaccttcatcgaccccgaggccatcaagtacttcagagagagatggcagatcgaggcccagagaggcagagccacctgccccagaagccacagctggatggagaagagagacggcagcgaggaggacttccacctggactgcagacacgagagataccccgccagacaccagccccacatggccgacagctggcccagaagcagcgcccaggaggcccccgagctgaacagacagtgctgggtgctgggccactgggtgtag

SEQ ID NO: 18694 - DNA, 843 bp, Artificial Sequence
  Description of Artificial Sequence: Synthetic coding sequence
atgaagaccagcagaagaggcagagccctgctggccgtggccctgaacctgctggccctgctgttcgccaccaccgccttcctgaccacccactggtgccagggcacccagagagtgcccaagcccggctgcggccagggcggcagagccaactgccccaacagcggcgccaacgccaccgccaacggcaccgccgcccccgccgccgccgccgccgccgccaccgccagcggcaacggcccccccggcggcgccctgtacagctgggagaccggcgacgacagattcctgttcagaaacttccacaccggcatctggtacagctgcgaggaggagctgagcggcctgggcgagaagtgcagaagcttcatcgacctggcccccgccagcgagaagggcctgctgggcatggtggcccacatgatgtacacccaggtgttccaggtgaccgtgagcctgggccccgaggactggagaccccacagctgggactacggctggagcttctgcctggcctggggcagcttcacctgctgcatggccgccagcgtgaccaccctgaacagctacaccaagaccgtgatcgagttcagacacaagagaaaggtgttcgagcagggctacagagaggagcccaccttcatcgaccccgaggccatcaagtacttcagagagagaatggagaagagagacggcagcgaggaggacttccacctggactgcagacacgagagataccccgccagacaccagccccacatggccgacagctggcccagaagcagcgcccaggaggcccccgagctgaacagacagtgctgggtgctgggccactgggtgtag

SEQ ID NO: 18695 - DNA, 996 bp, Artificial Sequence
  Description of Artificial Sequence: Synthetic coding sequence
atgaagaccagcagaagaggcagagccctgctggccgtggccctgaacctgctggccctgctgttcgccaccaccgccttcctgaccacccactggtgccagggcacccagagagtgcccaagcccggctgcggccagggcggcagagccaactgccccaacagcggcgccaacgccaccgccaacggcaccgccgcccccgccgccgccgccgccgccgccaccgccagcggcaacggcccccccggcggcgccctgtacagctgggagaccggcgacgacagattcctgttcagaaacttccacaccggcatctggtacagctgcgaggaggagctgagcggcctgggcgagaagtgcagaagcttcatcgacctggcccccgccagcgagaagggcgtgctgtggctgagcgtggtgagcgaggtgctgtacatcctgctgctggtggtgggcttcagcctgatgtgcctggagctgttccacagcagcaacgtgatcgacggcctgaagctgaacgccttcgccgccgtgttcaccgtgctgagcggcctgctgggcatggtggcccacatgatgtacacccaggtgttccaggtgaccgtgagcctgggccccgaggactggagaccccacagctgggactacggctggagcttctgcctggcctggggcagcttcacctgctgcatggccgccagcgtgaccaccctgaacagctacaccaagaccgtgatcgagttcagacacaagagaaaggtgttcgagcagggctacagagaggagcccaccttcatcgaccccgaggccatcaagtacttcagagagagaatggagaagagagacggcagcgaggaggacttccacctggactgcagacacgagagataccccgccagacaccagccccacatggccgacagctggcccagaagcagcgcccaggaggcccccgagctgaacagacagtgctgggtgctgggccactgggtgtag

SEQ ID NO: 18696 - DNA, 1479 bp, Artificial Sequence
  Description of Artificial Sequence: Synthetic coding sequence
atgtggagaggcctgtggaccctggccgcccaggccgccagaggccccagaagactgtgcaccagaagaagcagcggcgcccccgcccccggcagcggcgccaccatcttcgccctgagcagcggccagggcagatgcggcatcgccgtgatcagaaccagcggccccgccagcggccacgccctgagaatcctgaccgcccccagagacctgcccctggccagacacgccagcctgagactgctgagcgaccccagaagcggcgagcccctggacagagccctggtgctgtggttccccggcccccagagcttcaccggcgaggactgcgtggagttccacgtgcacggcggccccgccgtggtgagcggcgtgctgcaggccctgggcagcgtgcccggcctgagacccgccgaggccggcgagttcaccagaagagccttcgccaacggcaagctgaacctgaccgaggtggagggcctggccgacctgatccacgccgagaccgaggcccagagaagacaggccctgagacagctggacggcgagctgggccacctgtgcagaggctgggccgagaccctgaccaaggccctggcccacgtggaggcctacatcgacttcggcgaggacgacaacctggaggagggcgtgctggagcaggccgacatcgaggtgagagccctgcaggtggccctgggcgcccacctgagagacgccagaagaggccagagactgagaagcggcgtgcacgtggtggtgaccggcccccccaacgccggcaagagcagcctggtgaacctgctgagcagaaagcccgtgagcatcgtgagccccgagcccggcaccaccagagacgtgctggagacccccgtggacctggccggcttccccgtgctgctgagcgacaccgccggcctgagagagggcgtgggccccgtggagcaggagggcgtgagaagagccagagagagactggagcaggccgacctgatcctggccatgctggacgccagcgacctggccagccccagcagctgcaacttcctggccaccgtggtggccagcgtgggcgcccagagccccagcgacagcagccagagactgctgctggtgctgaacaagagcgacctgctgagccccgagggccccggccccggccccgacctgcccccccacctgctgctgagctgcctgaccggcgagggcctggacggcctgctggaggccctgagaaaggagctggccgccgtgtgcggcgaccccagcaccgacccccccctgctgaccagagccagacaccagcaccacctgcagggctgcctggacgccctgggccactacaagcagagcaaggacctggccctggccgccgaggccctgagagtggccagaggccacctgaccagactgaccggcggcggcggcaccgaggagatcctggacatcatcttccaggacttctgcgtgggcaagtag

SEQ ID NO: 18697 - DNA, 1575 bp, Artificial Sequence
  Description of Artificial Sequence: Synthetic coding sequence
atgtggagaggcctgtggaccctggccgcccaggccgccagaggccccagaagactgtgcaccagaagaagcagcggcgcccccgcccccggcagcggcgccaccatcttcgccctgagcagcggccagggcagatgcggcatcgccgtgatcagaaccagcggccccgccagcggccacgccctgagaatcctgaccgcccccagagacctgcccctggccagacacgccagcctgagactgctgagcgaccccagaagcggcgagcccctggacagagccctggtgctgtggttccccggcccccagagcttcaccggcgaggactgcgtggagttccacgtgcacggcggccccgccgtggtgagcggcgtgctgcaggccctgggcagcgtgcccggcctgagacccgccgaggccggcgagttcaccagaagagccttcgccaacggcaagctgaacctgaccgaggtggagggcctggccgacctgatccacgccgagaccgaggcccagagaagacaggccctgagacagctggacggcgagctgggccacctgtgcagaggctgggccgagaccctgaccaaggccctggcccacgtggaggcctacatcgacttcggcgaggacgacaacctggaggagggcgtgctggagcagggcggcagcacctggtggtggggcagaaagaccccccacatcagcccccagagactgcccagcctgagcctgagcgcctgcctgctgagccccaccgccgacatcgaggtgagagccctgcaggtggccctgggcgcccacctgagagacgccagaagaggccagagactgagaagcggcgtgcacgtggtggtgaccggcccccccaacgccggcaagagcagcctggtgaacctgctgagcagaaagcccgtgagcatcgtgagccccgagcccggcaccaccagagacgtgctggagacccccgtggacctggccggcttccccgtgctgctgagcgacaccgccggcctgagagagggcgtgggccccgtggagcaggagggcgtgagaagagccagagagagactggagcaggccgacctgatcctggccatgctggacgccagcgacctggccagccccagcagctgcaacttcctggccaccgtggtggccagcgtgggcgcccagagccccagcgacagcagccagagactgctgctggtgctgaacaagagcgacctgctgagccccgagggccccggccccggccccgacctgcccccccacctgctgctgagctgcctgaccggcgagggcctggacggcctgctggaggccctgagaaaggagctggccgccgtgtgcggcgaccccagcaccgacccccccctgctgaccagagccagacaccagcaccacctgcagggctgcctggacgccctgggccactacaagcagagcaaggacctggccctggccgccgaggccctgagagtggccagaggccacctgaccagactgaccggcggcggcggcaccgaggagatcctggacatcatcttccaggacttctgcgtgggcaagtag

SEQ ID NO: 18698 - DNA, 1545 bp, Artificial Sequence
  Description of Artificial Sequence: Synthetic coding sequence
atggtgcacagccccacctgcccccacccctgcttcctgctggtgcccgccagcgagccccagttcccccacctgcagacccccgaccccggcgacgccgtgtggaacgtgagatgggccctgtgcaccagaagaagcagcggcgcccccgcccccggcagcggcgccaccatcttcgccctgagcagcggccagggcagatgcggcatcgccgtgatcagaaccagcggccccgccagcggccacgccctgagaatcctgaccgcccccagagacctgcccctggccagacacgccagcctgagactgctgagcgaccccagaagcggcgagcccctggacagagccctggtgctgtggttccccggcccccagagcttcaccggcgaggactgcgtggagttccacgtgcacggcggccccgccgtggtgagcggcgtgctgcaggccctgggcagcgtgcccggcctgagacccgccgaggccggcgagttcaccagaagagccttcgccaacggcaagctgaacctgaccgaggtggagggcctggccgacctgatccacgccgagaccgaggcccagagaagacaggccctgagacagctggacggcgagctgggccacctgtgcagaggctgggccgagaccctgaccaaggccctggcccacgtggaggcctacatcgacttcggcgaggacgacaacctggaggagggcgtgctggagcaggccgacatcgaggtgagagccctgcaggtggccctgggcgcccacctgagagacgccagaagaggccagagactgagaagcggcgtgcacgtggtggtgaccggcccccccaacgccggcaagagcagcctggtgaacctgctgagcagaaagcccgtgagcatcgtgagccccgagcccggcaccaccagagacgtgctggagacccccgtggacctggccggcttccccgtgctgctgagcgacaccgccggcctgagagagggcgtgggccccgtggagcaggagggcgtgagaagagccagagagagactggagcaggccgacctgatcctggccatgctggacgccagcgacctggccagccccagcagctgcaacttcctggccaccgtggtggccagcgtgggcgcccagagccccagcgacagcagccagagactgctgctggtgctgaacaagagcgacctgctgagccccgagggccccggccccggccccgacctgcccccccacctgctgctgagctgcctgaccggcgagggcctggacggcctgctggaggccctgagaaaggagctggccgccgtgtgcggcgaccccagcaccgacccccccctgctgaccagagccagacaccagcaccacctgcagggctgcctggacgccctgggccactacaagcagagcaaggacctggccctggccgccgaggccctgagagtggccagaggccacctgaccagactgaccggcggcggcggcaccgaggagatcctggacatcatcttccaggacttctgcgtgggcaagtag

SEQ ID NO: 18699 - DNA, 456 bp, Artificial Sequence
  Description of Artificial Sequence: Synthetic coding sequence
atgtggagaggcctgtggaccctggccgcccaggccgccagaggccccagaagactgtgcaccagaagaagcagcggcgcccccgcccccggcagcggcgccaccatcttcgccctgagcagcggccagggcagatgcggcatcgccgtgatcagaaccagcggccccgccagcggccacgccctgagaatcctgaccgcccccagagacctgcccctggccagacacgccagcctgagactgctgagcgaccccagaagcggcgagcccctggacagagccctggtgctgtggttccccggcccccagagcttcaccggcgaggactgcgtggagttccacgtgcacggcggccccgccgtggtgagcggcgtgctgcaggccctgggcagcgtgcccggcctgagacccgccgagcccggcgccggcagaggcagcgcccagggctgcacctag

SEQ ID NO: 18700 - DNA, 1416 bp, Artificial Sequence
  Description of Artificial Sequence: Synthetic coding sequence
atgtggagaggcctgtggaccctggccgcccaggccgccagaggccccagaagactgtgcaccagaagaagcagcggcgcccccgcccccggcagcggcgccaccatcttcgccctgagcagcggccagggcagatgcggcatcgccgtgatcagaaccagcggccccgccagcggccacgccctgagaatcctgaccgcccccagagacctgcccctggccagacacgccagcctgagactgctgagcgaccccagaagcggcgagcccctggacagagccctggtgctgtggttccccggcccccagagcttcaccggcgaggactgcgtggagttccacgtgcacggcggccccgccgtggtgagcggcgtgctgcaggccctgggcagcgtgcccggcctgagacccgccgaggccggcgagttcaccagaagagccttcgccaacggcaagctgaacctgaccgaggtggagggcctggccgacctgatccacgccgagaccgaggcccagagaagacaggccctgagacagctggacggcgagctgggccacctgtgcagaggctgggccgagaccctgaccaaggccctggcccacgtggaggcctacatcgacttcggcgaggacgacaacctggaggagggcgtgctggagcaggccgacatcgaggtgagagccctgcaggtggccctgggcgcccacctgagagacgccagaagaggccagagactgagaagcggcgtgcacgtggtggtgaccggcccccccaacgccggcaagagcagcctggtgaacctgctgagcagaaagcccgtgagcatcgtgagccccgagcccggcaccaccagagacgtgctggagacccccgtggacctggccggcttccccgtgctgctgagcgacaccgccggcctgagagagggcgtgggccccgtggagcaggagggcgtgagaagagccagagagagctgcaacttcctggccaccgtggtggccagcgtgggcgcccagagccccagcgacagcagccagagactgctgctggtgctgaacaagagcgacctgctgagccccgagggccccggccccggccccgacctgcccccccacctgctgctgagctgcctgaccggcgagggcctggacggcctgctggaggccctgagaaaggagctggccgccgtgtgcggcgaccccagcaccgacccccccctgctgaccagagccagacaccagcaccacctgcagggctgcctggacgccctgggccactacaagcagagcaaggacctggccctggccgccgaggccctgagagtggccagaggccacctgaccagactgaccggcggcggcggcaccgaggagatcctggacatcatcttccaggacttctgcgtgggcaagtag

SEQ ID NO: 18701 - DNA, 423 bp, Artificial Sequence
  Description of Artificial Sequence: Synthetic coding sequence
atgagaaaggtgaagttcacccagcagaactaccacgacagactgagccagatcctgaccgacttccccaagctggacgacatccaccccttctacgccgacctgatgaacatcctgtacgacaaggaccactacaagctggccctgggccagatcaacatcgccaagaacctggtggacaacgtggccaaggactacgtgagactgatgaagtacggcgacagcctgtacagatgcaagcagctgaagagagccgccctgggcagaatgtgcaccgtgatcaagagacagaagcagagcctggagtacctggagcaggtgagacagcacctgagcagactgcccaccatcgaccccaacaccagaaccctgctgctgtgcggctaccccaacgtgggcaagagcagcttcatcaacaagtag

SEQ ID NO: 18702 - DNA, 1905 bp, Artificial Sequence
  Description of Artificial Sequence: Synthetic coding sequence
atggcccactacaacttcaagaagatcaccgtggtgcccagcgccaaggacttcatcgacctgaccctgagcaagacccagagaaagacccccaccgtgatccacaagcactaccagatccacagaatcagacacttctacatgagaaaggtgaagttcacccagcagaactaccacgacagactgagccagatcctgaccgacttccccaagctggacgacatccaccccttctacgccgacctgatgaacatcctgtacgacaaggaccactacaagctggccctgggccagatcaacatcgccaagaacctggtggacaacgtggccaaggactacgtgagactgatgaagtacggcgacagcctgtacagatgcaagcagctgaagagagccgccctgggcagaatgtgcaccgtgatcaagagacagaagcagagcctggagtacctggagcaggtgagacagcacctgagcagactgcccaccatcgaccccaacaccagaaccctgctgctgtgcggctaccccaacgtgggcaagagcagcttcatcaacaaggtgaccagagccgacgtggacgtgcagccctacgccttcaccaccaagagcctgttcgtgggccacatggactacaagtacctgagatggcaggtggtggacacccccggcatcctggaccaccccctggaggacagaaacaccatcgagatgcaggccatcaccgccctggcccacctgagagccgccgtgctgtacgtgatggacctgagcgagcagtgcggccacggcctgagagagcagctggagctgttccagaacatcagacccctgttcatcaacaagcccctgatcgtggtggccaacaagtgcgacgtgaagagaatcgccgagctgagcgaggacgaccagaagatcttcaccgacctgcagagcgagggcttccccgtgatcgagaccagcaccctgaccgaggagggcgtgatcaaggtgaagaccgaggcctgcgacagactgctggcccacagagtggagaccaagatgaagggcaacaaggtgaacgaggtgctgaacagactgcacctggccatccccaccagaagagacgacaaggagagaccccccttcatccccgagggcgtggtggccagaagaaagagaatggagaccgaggagagcagaaagaagagagagagagacctggagctggagatgggcgacgactacatcctggacctgcagaagtactgggacctgatgaacctgagcgagaagcacgacaagatccccgagatctgggagggccacaacatcgccgactacatcgaccccgccatcatgaagaagctggaggagctggagaaggaggaggagctgagaaccgccgccggcgagtacgacagcgtgagcgagagcgaggacgaggagatgctggagatcagacagctggccaagcagatcagagagaagaagaagctgaagatcctggagagcaaggagaagaacacccagggccccagaatgcccagaaccgccaagaaggtgcagagaaccgtgctggagaaggagatgagaagcctgggcgtggacatggacgacaaggacgacgcccactacgccgtgcaggccagaagaagcagaagcatcaccagaaagagaaagagagaggacagcgccccccccagcagcgtggccagaagcggcagctgcagcagaacccccagagacgtgagcggcctgagagacgtgaagatggtgaagaaggccaagaccatgatgaagaacgcccagaagaagatgaacagactgggcaagaagggcgaggccgacagacacgtgttcgacatgaagcccaagcacctgctgagcggcaagagaaaggccggcaagaaggacagaagatag

SEQ ID NO: 18703 - DNA, 1557 bp, Artificial Sequence
  Description of Artificial Sequence: Synthetic coding sequence
atgaagtacggcgacagcctgtacagatgcaagcagctgaagagagccgccctgggcagaatgtgcaccgtgatcaagagacagaagcagagcctggagtacctggagcaggtgagacagcacctgagcagactgcccaccatcgaccccaacaccagaaccctgctgctgtgcggctaccccaacgtgggcaagagcagcttcatcaacaaggtgaccagagccgacgtggacgtgcagccctacgccttcaccaccaagagcctgttcgtgggccacatggactacaagtacctgagatggcaggtggtggacacccccggcatcctggaccaccccctggaggacagaaacaccatcgagatgcaggccatcaccgccctggcccacctgagagccgccgtgctgtacgtgatggacctgagcgagcagtgcggccacggcctgagagagcagctggagctgttccagaacatcagacccctgttcatcaacaagcccctgatcgtggtggccaacaagtgcgacgtgaagagaatcgccgagctgagcgaggacgaccagaagatcttcaccgacctgcagagcgagggcttccccgtgatcgagaccagcaccctgaccgaggagggcgtgatcaaggtgaagaccgaggcctgcgacagactgctggcccacagagtggagaccaagatgaagggcaacaaggtgaacgaggtgctgaacagactgcacctggccatccccaccagaagagacgacaaggagagaccccccttcatccccgagggcgtggtggccagaagaaagagaatggagaccgaggagagcagaaagaagagagagagagacctggagctggagatgggcgacgactacatcctggacctgcagaagtactgggacctgatgaacctgagcgagaagcacgacaagatccccgagatctgggagggccacaacatcgccgactacatcgaccccgccatcatgaagaagctggaggagctggagaaggaggaggagctgagaaccgccgccggcgagtacgacagcgtgagcgagagcgaggacgaggagatgctggagatcagacagctggccaagcagatcagagagaagaagaagctgaagatcctggagagcaaggagaagaacacccagggccccagaatgcccagaaccgccaagaaggtgcagagaaccgtgctggagaaggagatgagaagcctgggcgtggacatggacgacaaggacgacgcccactacgccgtgcaggccagaagaagcagaagcatcaccagaaagagaaagagagaggacagcgccccccccagcagcgtggccagaagcggcagctgcagcagaacccccagagacgtgagcggcctgagagacgtgaagatggtgaagaaggccaagaccatgatgaagaacgcccagaagaagatgaacagactgggcaagaagggcgaggccgacagacacgtgttcgacatgaagcccaagcacctgctgagcggcaagagaaaggccggcaagaaggacagaagatag

SEQ ID NO: 18704 - DNA, 1764 bp, Artificial Sequence
  Description of Artificial Sequence: Synthetic coding sequence
atgagaaaggtgaagttcacccagcagaactaccacgacagactgagccagatcctgaccgacttccccaagctggacgacatccaccccttctacgccgacctgatgaacatcctgtacgacaaggaccactacaagctggccctgggccagatcaacatcgccaagaacctggtggacaacgtggccaaggactacgtgagactgatgaagtacggcgacagcctgtacagatgcaagcagctgaagagagccgccctgggcagaatgtgcaccgtgatcaagagacagaagcagagcctggagtacctggagcaggtgagacagcacctgagcagactgcccaccatcgaccccaacaccagaaccctgctgctgtgcggctaccccaacgtgggcaagagcagcttcatcaacaaggtgaccagagccgacgtggacgtgcagccctacgccttcaccaccaagagcctgttcgtgggccacatggactacaagtacctgagatggcaggtggtggacacccccggcatcctggaccaccccctggaggacagaaacaccatcgagatgcaggccatcaccgccctggcccacctgagagccgccgtgctgtacgtgatggacctgagcgagcagtgcggccacggcctgagagagcagctggagctgttccagaacatcagacccctgttcatcaacaagcccctgatcgtggtggccaacaagtgcgacgtgaagagaatcgccgagctgagcgaggacgaccagaagatcttcaccgacctgcagagcgagggcttccccgtgatcgagaccagcaccctgaccgaggagggcgtgatcaaggtgaagaccgaggcctgcgacagactgctggcccacagagtggagaccaagatgaagggcaacaaggtgaacgaggtgctgaacagactgcacctggccatccccaccagaagagacgacaaggagagaccccccttcatccccgagggcgtggtggccagaagaaagagaatggagaccgaggagagcagaaagaagagagagagagacctggagctggagatgggcgacgactacatcctggacctgcagaagtactgggacctgatgaacctgagcgagaagcacgacaagatccccgagatctgggagggccacaacatcgccgactacatcgaccccgccatcatgaagaagctggaggagctggagaaggaggaggagctgagaaccgccgccggcgagtacgacagcgtgagcgagagcgaggacgaggagatgctggagatcagacagctggccaagcagatcagagagaagaagaagctgaagatcctggagagcaaggagaagaacacccagggccccagaatgcccagaaccgccaagaaggtgcagagaaccgtgctggagaaggagatgagaagcctgggcgtggacatggacgacaaggacgacgcccactacgccgtgcaggccagaagaagcagaagcatcaccagaaagagaaagagagaggacagcgccccccccagcagcgtggccagaagcggcagctgcagcagaacccccagagacgtgagcggcctgagagacgtgaagatggtgaagaaggccaagaccatgatgaagaacgcccagaagaagatgaacagactgggcaagaagggcgaggccgacagacacgtgttcgacatgaagcccaagcacctgctgagcggcaagagaaaggccggcaagaaggacagaagatag

SEQ ID NO: 18705 - DNA, 1998 bp, Artificial Sequence
  Description of Artificial Sequence: Synthetic coding sequence
atgagcgagcagagctgccagatgagcgagctgagactgctgctgctgggcaagtgcagaagcggcaagagcgccaccggcaacgccatcctgggcaagcacgtgttcaagagcaagttcagcgaccagaccgtgatcaagatgtgccagagagagagctgggtgctgagagagagaaaggtggtggtgatcgacacccccgacctgttcagcagcatcgcctgcgccgaggacaagcagagaaacatccagcactgcctggagctgagcgcccccagcctgcacgccctgctgctggtgatcgccatcggccacttcaccagagaggacgaggagaccgccaagggcatccagcaggtgttcggcgccgaggccagaagacacatcatcatcgtgttcaccagaaaggacgacctgggcgacgacctgctgcaggacttcatcgagaagaacaagcccctgaagcagctggtgcaggactacgagggcagatactgcatcttcaacaacaagaccaacagcaaggacgagcagatcacccaggtgctggagctgctgagaaaggtggagagcctggtgaacaccaacggcggcccctaccacgtgaacttcaagaccgagggcagcagattccaggactgcgtgaacgaggccgccagccaggagggcgacaagccccagggccccagagagagacagctgcagagcaccggccccgagcagaaccccggcaccagcgagctgaccgtgctgctggtgggcaagagaggcgccggcaagagcgccgccggcaacagcatcctgggcagacaggccttccagaccggcttcagcgagcagagcgtgacccagagcttcctgagcgagagcagaagctggagaaagaagaaggtgagcatcatcgacgcccccgacatcagcagcctgaagaacatcgacagcgaggtgagaaagcacatctgcaccggcccccacgccttcctgctggtgacccccctgggcttctacaccaagaacgacgaggccgtgctgagcaccatccagaacaacttcggcgagaagttcttcgagtacatgatcatcctgctgaccagaaaggaggacctgggcgaccaggacctggacaccttcctgagaaacagcaacaaggccctgtacggcctgatccagaagtgcaagaacagatacagcgccttcaactacagagccaccggcgaggaggagcagagacaggccgacgagctgctggagaagatcgagagcatggtgcaccagaacggcaacaagcactgcgtgttcagagagaaggagaccctgaacatcgtgctggtgggcagaagcggcaccggcaagagcgccaccggcaacagcatcctgggcagcctggtgttcaccagcagactgagagcccagcccgtgaccaagaccagccagagcggcagaagaacctgggacggccaggaggtggtggtggtggacacccccagcttcaaccagatgctggacgtggagaaggaccccagcagactggaggaggaggtgaagagatgcctgagctgctgcgagaagggcgacaccttcttcgtgctggtgttccagctgggcagattcaccgaggaggacaagaccgccgtggccaagctggaggccatcttcggcgccgacttcaccaagtacgccatcatgctgttcaccagaaaggaggacctgggcgccggcaacctggaggacttcatgaagaacagcgacaacaaggccctgagaagaatcttcaagaagtgcggcagaagagtgtgcgccttcaacaacaaggagaccggccaggcccaggagacccaggtgaaggccctgctgaccaaggtgaacgacctgagaaaggagagcggctggagcggctacccccacacccaggagaacgtgagcaagctgatcaagaacgtgcaggagatgagccaggccgagaagctgctgaagaacctgatcggcatcctgcagtag

SEQ ID NO: 18706 - DNA, 924 bp, Artificial Sequence
  Description of Artificial Sequence: Synthetic coding sequence
atggccgcccccggcctgagactgggcgccggcagactgttcgagatgcccgccgtgctggagagactgagcagatacaacagcaccagccaggccttcgccgaggtgctgagactgcccaagcagcagctgagaaagctgctgtaccccctgcaggaggtggagagattcctggccccctacggcagacaggacctgcacctgagaatcttcgaccccagccccgaggacatcgccagagccgacaacatcttcaccgccaccgagagaaacagaatcgactacgtgagcagcgccgtgagaatcgaccacgcccccgacctgcccagacccgaggtgagaggcgacagcaccgtgcacctgagagccggcgtgaccgccctgcccctgcccggcagacccgccagaggcgtgttctacagacagagcaacgtgggcaagagcagcctgatcaagctgtacttccactggcccctgagactgaagagcgagagccccaagaaccaggacacccaggagaacgagttcttcaaggtgggcaagcacttcaccgtggtggacatgcccggctacggcttcagagcccccgaggacttcgtggacatggtggagacctacctgaaggagagaagaaacctgaagagaaccttcctgctggtggacagcgtggtgggcatccagaagaccgacaacatcgccatcgagatgtgcgaggagttcgccctgccctacgtgatcgtgctgaccaagatcgacaagagcagcaagggccacctgctgaagcaggtgctgcagatccagaagttcgtgaacatgaagacccagggctgcttcccccagctgttccccgtgagcgccgtgaccttcagcggcatccacctgctgagatgcttcatcgccagcgtgaccggcagcctggactag

SEQ ID NO: 18707 - DNA, 756 bp, Artificial Sequence
  Description of Artificial Sequence: Synthetic coding sequence
atggccgcccccggcctgagactgggcgccggcagactgttcgagatgcccgccgtgctggagagactgagcagatacaacagcaccagccaggccttcgccgaggtgctgagactgcccaagcagcagctgagaaagctgctgtaccccctgcaggaggtggagagattcctggccccctacggcagacaggacctgcacctgagaatcttcgaccccagccccgaggacatcgccagagccgacaacatcttcaccgccaccgagagaaacagaatcgactacgtgagcagcgccgtgagaatcgaccacgcccccgacctgcccagacccgagggccacaccaagaagatgaacttcttcaaggtgggcaagcacttcaccgtggtggacatgcccggctacggcttcagagcccccgaggacttcgtggacatggtggagacctacctgaaggagagaagaaacctgaagagaaccttcctgctggtggacagcgtggtgggcatccagaagaccgacaacatcgccatcgagatgtgcgaggagttcgccctgccctacgtgatcgtgctgaccaagatcgacaagagcagcaagggccacctgctgaagcaggtgctgcagatccagaagttcgtgaacatgaagacccagggctgcttcccccagctgttccccgtgagcgccgtgaccttcagcggcatccacctgctgagatgcttcatcgccagcgtgaccggcagcctggactag

SEQ ID NO: 18708 - DNA, 855 bp, Artificial Sequence
  Description of Artificial Sequence: Synthetic coding sequence
atggccgcccccggcctgagactgggcgccggcagactgttcgagatgcccgccgtgctggagagactgagcagatacaacagcaccagccaggccttcgccgaggtgctgagactgcccaagcagcagctgagaaagctgctgtaccccctgcaggaggtggagagattcctggccccctacggcagacaggacctgcacctgagaatcttcgaccccagccccgaggacatcgccagagccgacaacatcttcaccgccaccgagagaaacagaatcgactacgtgagcagcgccgtgagaatcgaccacgcccccgacctgcccagacccgaggtgtgcttcatcggcagaagcaacgtgggcaagagcagcctgatcaaggccctgttcagcctggcccccgaggtggaggtgagagtgagcaagaagcccggccacaccaagaagatgaacttcttcaaggtgggcaagcacttcaccgtggtggacatgcccggctacggcttcagagcccccgaggacttcgtggacatggtggagacctacctgaaggagagaagaaacctgaagagaaccttcctgctggtggacagcgtggtgggcatccagaagaccgacaacatcgccatcgagatgtgcgaggagttcgccctgccctacgtgatcgtgctgaccaagatcgacaagagcagcaagggccacctgctgaagcaggtgctgcagatccagaagttcgtgaacatgaagacccagggctgcttcccccagctgttccccgtgagcgccgtgaccttcagcggcatccacctgctgagatgcttcatcgccagcgtgaccggcagcctggactag

SEQ ID NO: 18709 - DNA, 522 bp, Artificial Sequence
  Description of Artificial Sequence: Synthetic coding sequence
atggtgtgcttcatcggcagaagcaacgtgggcaagagcagcctgatcaaggccctgttcagcctggcccccgaggtggaggtgagagtgagcaagaagcccggccacaccaagaagatgaacttcttcaaggtgggcaagcacttcaccgtggtggacatgcccggctacggcttcagagcccccgaggacttcgtggacatggtggagacctacctgaaggagagaagaaacctgaagagaaccttcctgctggtggacagcgtggtgggcatccagaagaccgacaacatcgccatcgagatgtgcgaggagttcgccctgccctacgtgatcgtgctgaccaagatcgacaagagcagcaagggccacctgctgaagcaggtgctgcagatccagaagttcgtgaacatgaagacccagggctgcttcccccagctgttccccgtgagcgccgtgaccttcagcggcatccacctgctgagatgcttcatcgccagcgtgaccggcagcctggactag

SEQ ID NO: 18710 - DNA, 405 bp, Artificial Sequence
  Description of Artificial Sequence: Synthetic coding sequence
atgaacttcttcaaggtgggcaagcacttcaccgtggtggacatgcccggctacggcttcagagcccccgaggacttcgtggacatggtggagacctacctgaaggagagaagaaacctgaagagaaccttcctgctggtggacagcgtggtgggcatccagaagaccgacaacatcgccatcgagatgtgcgaggagttcgccctgccctacgtgatcgtgctgaccaagatcgacaagagcagcaagggccacctgctgaagcaggtgctgcagatccagaagttcgtgaacatgaagacccagggctgcttcccccagctgttccccgtgagcgccgtgaccttcagcggcatccacctgctgagatgcttcatcgccagcgtgaccggcagcctggactag

SEQ ID NO: 18711 - DNA, 756 bp, Artificial Sequence; identical to SEQ ID NO: 18707
  Description of Artificial Sequence: Synthetic coding sequence

SEQ ID NO: 18712 - DNA, 462 bp, Artificial Sequence
  Description of Artificial Sequence: Synthetic coding sequence
atgaccgagcagatgaccctgagaggcaccctgaagggccacaacggctgggtgacccagatcgccaccaccccccagttccccgacatgatcctgagcgccagcagagacaagaccatcatcatgtggaagctgaccagagacgagaccaactacggcatcccccagagagccctgagaggccacagccacttcgtgagcgacgtggtgatcagcagcgacggccagttcgccctgagcggcagctgggacggcaccctgagactgtgggacctgaccaccggcaccaccaccagaagattcgtgggccacaccaaggacgtgctgagcgtggccttcagcagcgacaacagacagatcgtgagcggcagcagagacaagaccatcaagctgtggaacaccctgggcgtgtgcaagtacaccgtgcagagccacagcgtggcccaggccggcgtgcagtag

SEQ ID NO: 18713 - DNA, 954 bp, Artificial Sequence
  Description of Artificial Sequence: Synthetic coding sequence
atgaccgagcagatgaccctgagaggcaccctgaagggccacaacggctgggtgacccagatcgccaccaccccccagttccccgacatgatcctgagcgccagcagagacaagaccatcatcatgtggaagctgaccagagacgagaccaactacggcatcccccagagagccctgagaggccacagccacttcgtgagcgacgtggtgatcagcagcgacggccagttcgccctgagcggcagctgggacggcaccctgagactgtgggacctgaccaccggcaccaccaccagaagattcgtgggccacaccaaggacgtgctgagcgtggccttcagcagcgacaacagacagatcgtgagcggcagcagagacaagaccatcaagctgtggaacaccctgggcgtgtgcaagtacaccgtgcaggacgagagccacagcgagtgggtgagctgcgtgagattcagccccaacagcagcaaccccatcatcgtgagctgcggctgggacaagctggtgaaggtgtggaacctggccaactgcaagctgaagaccaaccacatcggccacaccggctacctgaacaccgtgaccgtgagccccgacggcagcctgtgcgccagcggcggcaaggacggccaggccatgctgtgggacctgaacgagggcaagcacctgtacaccctggacggcggcgacatcatcaacgccctgtgcttcagccccaacagatactggctgtgcgccgccaccggccccagcatcaagatctgggacctggagggcaagatcatcgtggacgagctgaagcaggaggtgatcagcaccagcagcaaggccgagcccccccagtgcaccagcctggcctggagcgccgacggccagaccctgttcgccggctacaccgacaacctggtgagagtgtggcaggtgaccatcggcaccagatag

SEQ ID NO: 18714 - DNA, 207 bp, Artificial Sequence
  Description of Artificial Sequence: Synthetic coding sequence
atgagcagcggcgccagcgccagcgccctgcagagactggtggagcagctgaagctggaggccggcgtggagagaatcaaggtgagccaggccgccgccgagctgcagcagtactgcatgcagaacgcctgcaaggacgccctgctggtgggcgtgcccgccggcagcaaccccttcagagagcccagaagctgcgccctgctgtag

SEQ ID NO: 18715 - DNA, 219 bp, Artificial Sequence
  Description of Artificial Sequence: Synthetic coding sequence
atgagcagcaagaccgccagcaccaacaacatcgcccaggccagaagaaccgtgcagcagctgagactggaggccagcatcgagagaatcaaggtgagcaaggccagcgccgacctgatgagctactgcgaggagcacgccagaagcgaccccctgctgatcggcatccccaccagcgagaaccccttcaaggacaagaagacctgcatcatcctgtag

SEQ ID NO: 18716 - DNA, 228 bp, Artificial Sequence
  Description of Artificial Sequence: Synthetic coding sequence
atgaagggcgagacccccgtgaacagcaccatgagcatcggccaggccagaaagatggtggagcagctgaagatcgaggccagcctgtgcagaatcaaggtgagcaaggccgccgccgacctgatgacctactgcgacgcccacgcctgcgaggaccccctgatcacccccgtgcccaccagcgagaaccccttcagagagaagaagttcttctgcgccctgctgtag

SEQ ID NO: 18717 - DNA, 228 bp, Artificial Sequence
  Description of Artificial Sequence: Synthetic coding sequence
atgaaggagggcatgagcaacaacagcaccaccagcatcagccaggccagaaaggccgtggagcagctgaagatggaggcctgcatggacagagtgaaggtgagccaggccgccgccgacctgctggcctactgcgaggcccacgtgagagaggaccccctgatcatccccgtgcccgccagcgagaaccccttcagagagaagaagttcttctgcaccatcctgtag

SEQ ID NO: 18718 - DNA, 228 bp, Artificial Sequence; identical to SEQ ID NO: 18717
  Description of Artificial Sequence: Synthetic coding sequence

SEQ ID NO: 18719 - DNA, 228 bp, Artificial Sequence; identical to SEQ ID NO: 18717
  Description of Artificial Sequence: Synthetic coding sequence

SEQ ID NO: 18720 - DNA, 228 bp, Artificial Sequence; identical to SEQ ID NO: 18717
  Description of Artificial Sequence: Synthetic coding sequence

SEQ ID NO: 18721 - DNA, 207 bp, Artificial Sequence
  Description of Artificial Sequence: Synthetic coding sequence
atgagcgccaccaacaacatcgcccaggccagaaagctggtggagcagctgagaatcgaggccggcatcgagagaatcaaggtgagcaaggccgccagcgacctgatgagctactgcgagcagcacgccagaaacgaccccctgctggtgggcgtgcccgccagcgagaaccccttcaaggacaagaagccctgcatcatcctgtag

SEQ ID NO: 18722 - DNA, 141 bp, Artificial Sequence
  Description of Artificial Sequence: Synthetic coding sequence
atgcccgtgatcaacatcgaggacctgaccgagaaggacaagctgaagatggaggtggaccagctgaagaaggaggtgaccctggagagaatgctgatccccgccagacacctgcagaaccagagcctgatggactactag

SEQ ID NO: 18723 - DNA, 141 bp, Artificial Sequence; identical to SEQ ID NO: 18722
  Description of Artificial Sequence: Synthetic coding sequence

SEQ ID NO: 18724 - DNA, 141 bp, Artificial Sequence; identical to SEQ ID NO: 18722
  Description of Artificial Sequence: Synthetic coding sequence

SEQ ID NO: 18725 - DNA, 1065 bp, Artificial Sequence
  Description of Artificial Sequence: Synthetic coding sequence
atgggcagcggcatcagcagcgagagcaaggagagcgccaagagaagcaaggagctggagaagaagctgcaggaggacgccgagagagacgccagaaccgtgaagctgctgctgctgggcgccggcgagagcggcaagagcaccatcgtgaagcagatgaagatcatccacaagaacggctacagcgagcaggagtgcatggagttcaaggccgtgatctacagcaacaccctgcagagcatcctggccatcgtgaaggccatgaccaccctgggcatcgactacgtgaaccccagaagcgccgaggaccagagacagctgtacgccatggccaacaccctggaggacggcggcatgaccccccagctggccgaggtgatcaagagactgtggagagaccccggcatccaggcctgcttcgagagagccagcgagtaccagctgaacgacagcgccgcctactacctgaacgacctggacagaatcaccgccagcggctacgtgcccaacgagcaggacgtgctgcacagcagagtgaagaccaccggcatcatcgagacccagttcagcttcaaggacctgcacttcagaatgttcgacgtgggcggccagagaagcgagagaaagaagtggatccactgcttcgagggcgtgacctgcatcatcttctgcgccgccctgagcgcctacgacatggtgctggtggaggacgaggaggtgaacagaatgcacgagagcctgcacctgttcaacagcatctgcaaccacaagtacttcagcaccaccagcatcgtgctgttcctgaacaagaaggacatcttccaggagaaggtgaccaaggtgcacctgagcatctgcttccccgagtacaccggccccaacaccttcgaggacgccggcaactacatcaagaaccagttcctggacctgaacctgaagaaggaggacaaggagatctacagccacatgacctgcgccaccgacacccagaacgtgaagttcgtgttcgacgccgtgaccgacatcatcatcaaggagaacctgaaggactgcggcctgttctag

SEQ ID NO: 18726 - DNA, 1749 bp, Artificial Sequence
  Description of Artificial Sequence: Synthetic coding sequence
atgatgaagctgagacacaagaacaagaagcccggcgagggcagcaagggccacaagaagatcagctggccctacccccagcccgccaagcagaacggcaagaaggccaccagcaaggtgcccagcgccccccacttcgtgcaccccaacgaccacgccaacagagaggccgagctgaagaagaagtgggtggaggagatgagagagaagcagcaggccgccagagagcaggagagacagaagagaagaaccatcgagagctactgccaggacgtgctgagaagacaggaggagttcgagcacaaggaggaggtgctgcaggagctgaacatgttcccccagctggacgacgaggccaccagaaaggcctactacaaggagttcagaaaggtggtggagtacagcgacgtgatcctggaggtgctggacgccagagaccccctgggctgcagatgcttccagatggaggaggccgtgctgagagcccagggcaacaagaagctggtgctggtgctgaacaagatcgacctggtgcccaaggaggtggtggagaagtggctggactacctgagaaacgagctgcccaccgtggccttcaaggccagcacccagcaccaggtgaagaacctgaacagatgcagcgtgcccgtggaccaggccagcgagagcctgctgaagagcaaggcctgcttcggcgccgagaacctgatgagagtgctgggcaactactgcagactgggcgaggtgagaacccacatcagagtgggcgtggtgggcctgcccaacgtgggcaagagcagcctgatcaacagcctgaagagaagcagagcctgcagcgtgggcgccgtgcccggcatcaccaagttcatgcaggaggtgtacctggacaagttcatcagactgctggacgcccccggcatcgtgcccggccccaacagcgaggtgggcaccatcctgagaaactgcgtgcacgtgcagaagctggccgaccccgtgacccccgtggagaccatcctgcagagatgcaacctggaggagatcagcaactactacggcgtgagcggcttccagaccaccgagcacttcctgaccgccgtggcccacagactgggcaagaagaagaagggcggcctgtacagccaggagcaggccgccaaggccgtgctggccgactgggtgagcggcaagatcagcttctacatccccccccccgccacccacaccctgcccacccacctgagcgccgagatcgtgaaggagatgaccgaggtgttcgacatcgaggacaccgagcaggccaacgaggacaccatggagtgcctggccaccggcgagagcgacgagctgctgggcgacaccgaccccctggagatggagatcaagctgctgcacagccccatgaccaagatcgccgacgccatcgagaacaagaccaccgtgtacaagatcggcgacctgaccggctactgcaccaaccccaacagacaccagatgggctgggccaagagaaacgtggaccacagacccaagagcaacagcatggtggacgtgtgcagcgtggacagaagaagcgtgctgcagagaatcatggagaccgaccccctgcagcagggccaggccctggccagcgccctgaagaacaagaagaagatgcagaagagagccgacaagatcgccagcaagctgagcgacagcatgatgagcgccctggacctgagcggcaacgccgacgacggcgtgggcgactag

SEQ ID NO: 18727 - DNA, 1749 bp, Artificial Sequence; identical to SEQ ID NO: 18726
  Description of Artificial Sequence: Synthetic coding sequence

SEQ ID NO: 18728 - DNA, 2010 bp, Artificial Sequence
  Description of Artificial Sequence: Synthetic coding sequence
atgtggaccctggtgggcagaggctggggctgcgccagagccctggcccccagagccaccggcgccgccctgctggtggcccccggccccagaagcgcccccaccctgggcgccgcccccgagagctgggccaccgacagactgtacagcagcgccgagttcaaggagaagctggacatgagcagattccccgtggagaacatcagaaacttcagcatcgtggcccacgtggaccacggcaagagcaccctggccgacagactgctggagctgaccggcaccatcgacaagaccaagaacaacaagcaggtgctggacaagctgcaggtggagagagagagaggcatcaccgtgaaggcccagaccgccagcctgttctacaactgcgagggcaagcagtacctgctgaacctgatcgacacccccggccacgtggacttcagctacgaggtgagcagaagcctgagcgcctgccagggcgtgctgctggtggtggacgccaacgagggcatccaggcccagaccgtggccaacttcttcctggccttcgaggcccagctgagcgtgatccccgtgatcaacaagatcgacctgaagaacgccgaccccgagagagtggagaaccagatcgagaaggtgttcgacatccccagcgacgagtgcatcaagatcagcgccaagctgggcaccaacgtggagagcgtgctgcaggccatcatcgagagaatccccccccccaaggtgcacagaaagaaccccctgagagccctggtgttcgacagcaccttcgaccagtacagaggcgtgatcgccaacgtggccctgttcgacggcgtggtgagcaagggcgacaagatcgtgagcgcccacacccagaagacctacgaggtgaacgaggtgggcgtgctgaaccccaacgagcagcccacccacaagctgtacgccggccaggtgggctacctgatcgccggcatgaaggacgtgaccgaggcccagatcggcgacaccctgtgcctgcacaagcagcccgtggagcccctgcccggcttcaagagcgccaagcccatggtgttcgccggcatgtaccccctggaccagagcgagtacaacaacctgaagagcgccatcgagaagctgaccctgaacgacagcagcgtgaccgtgcacagagacagcagcctggccctgggcgccggctggagactgggcttcctgggcctgctgcacatggaggtgttcaaccagagactggagcaggagtacaacgccagcgtgatcctgaccacccccaccgtgccctacaaggccgtgctgagcagcagcaagctgatcaaggagcacagagagaaggagatcaccatcatcaaccccgcccagttccccgacaagagcaaggtgaccgagtacctggagcccgtggtgctgggcaccatcatcacccccgacgagtacaccggcaagatcatgatgctgtgcgaggccagaagagccgtgcagaagaacatgatcttcatcgaccagaacagagtgatgctgaagtacctgttccccctgaacgagatcgtggtggacttctacgacagcctgaagagcctgagcagcggctacgccagcttcgactacgaggacgccggctaccagaccgccgagctggtgaagatggacatcctgctgaacggcaacaccgtggaggagctggtgaccgtggtgcacaaggacaaggcccacagcatcggcaaggccatctgcgagagactgaaggacagcctgcccagacagctgttcgagatcgccatccaggccgccatcggcagcaagatcatcgccagagagaccgtgaaggcctacagaaagaacgtgctggccaagtgctacggcggcgacatcaccagaaagatgaagctgctgaagagacaggccgagggcaagaagaagctgagaaagatcggcaacgtggaggtgcccaaggacgccttcatcaaggtgctgaagacccagagcagcaagtag

SEQ ID NO: 18729 - DNA, 756 bp, Artificial Sequence
  Description of Artificial Sequence: Synthetic coding sequence
atggcccacagactgcagatcagactgctgacctgggacgtgaaggacaccctgctgagactgagacaccccctgggcgaggcctacgccaccaaggccagagcccacggcctggaggtggagcccagcgccctggagcagggcttcagacaggcctacagagcccagagccacagcttccccaactacggcctgagccacggcctgaccagcagacagtggtggctggacgtggtgctgcagaccttccacctggccggcgtgcaggacgcccaggccgtggcccccatcgccgagcagctgtacaaggacttcagccacccctgcacctggcaggtgctggacggcgccgaggacaccctgagagagtgcagaaccagaggcctgagactggccgtgatcagcaacttcgacagaagactggagggcatcctgggcggcctgggcctgagagagcacttcgacttcgtgctgaccagcgaggccgccggctggcccaagcccgaccccagaatcttccaggaggccctgagactggcccacatggagcccgtggtggccgcccacgtgggcgacaactacctgtgcgactaccagggccccagagccgtgggcatgcacagcttcctggtggtgggcccccaggccctggaccccgtggtgagagacagcgtgcccaaggagcacatcctgcccagcctggcccacctgctgcccgccctggactgcctggagggcagcacccccggcctgtag

SEQ ID NO: 18730 - DNA, 756 bp, Artificial Sequence; identical to SEQ ID NO: 18729
  Description of Artificial Sequence: Synthetic coding sequence

SEQ ID NO: 18731 - DNA, 867 bp, Artificial Sequence
  Description of Artificial Sequence: Synthetic coding sequence
atggacatcggcctgagcatcgccaacagcagcggcttccagctgagcgagttcatcctgatcggcttccccggcatccacgagtggcagcactggctgagcctgcccctggccctgggcgccaacctgctgatcatcatcaccatccagcacgagaccatgctgcacgagcccatgtaccacctgctgggcatcctggccgtggtggacatcggcctggccaccaccatcatgcccaagatcctggccatcttctggttcgacgccaaggccatcagcctgcccgagtgcttcgcccagatctacgccatccacagcttcatgtgcatggagagcggcatcttcctgtgcatggccgtggacagatacatggccatctgctaccccctgcagtacaccagcatcgtgaccgaggccttcgtgatcaaggccaccctgagcgtggtgctgagaaacggcctgctgaccatccccgtgcccgtgctggccgcccagagacactactgcagcagaaacgagatcgaccagtgcctgtgcagcaacctgggcgtgaccagcctggcctgcgacgacaccaccatcaacagattctaccagctggccctggtgtgggtggtggtgggcagcgacatgggcctggtgttcgccagctacagcctgatcatccacagcgtgctgaagctgaacagcgccaaggccaccagcaaggccctgaacacctgcagcagccacctgatcctgatcctgttcttctacaccgccatcatcgtggtgagcgtgaccacctggcaggaggagggcctgcccgccagcctgttcagcagcatgtgctgcatcctgagcagcccccagcccctgaccccctag

SEQ ID NO: 18732 - DNA, 513 bp, Artificial Sequence
  Description of Artificial Sequence: Synthetic coding sequence
atggccagcgtgagcagcgccaccttcagcggccacggcgccagaagcctgctgcagttcctgagactggtgggccagctgaagagagtgcccagaaccggctgggtgtacagaaacgtgcagagacccgagagcgtgagcgaccacatgtacagaatggccgtgatggccatggtgatcaaggacgacagactgaacaaggacagagaggccatgaagcagatcacccagctgctgcccgaggacctgagaaaggagctgtacgagctgtgggaggagtacgagacccagagcagcgccgaggccaagttcgtgaagcagctggaccagtgcgagatgatcctgcaggccagcgagtacgaggacctggagcacaagcccggcagactgcaggacttctacgacagcaccgccggcaagttcaaccaccccgagatcgtgcagctggtgagcgagctggaggccgagagaagcaccaacatcgccgccgccgccagcgagccccacagctag

SEQ ID NO: 18733 - DNA, 615 bp, Artificial Sequence
  Description of Artificial Sequence: Synthetic coding sequence
atggccagcgtgagcagcgccaccttcagcggccacggcgccagaagcctgctgcagttcctgagactggtgggccagctgaagagagtgcccagaaccggctgggtgtacagaaacgtgcagagacccgagagcgtgagcgaccacatgtacagaatggccgtgatggccatggtgatcaaggacgacagactgaacaaggacagatgcgtgagactggccctggtgcacgacatggccgagtgcatcgtgggcgacatcgcccccgccgacaacatccccaaggaggagaagcacagaagagaggaggaggccatgaagcagatcacccagctgctgcccgaggacctgagaaaggagctgtacgagctgtgggaggagtacgagacccagagcagcgccgaggccaagttcgtgaagcagctggaccagtgcgagatgatcctgcaggccagcgagtacgaggacctggagcacaagcccggcagactgcaggacttctacgacagcaccgccggcaagttcaaccaccccgagatcgtgcagctggtgagcgagctggaggccgagagaagcaccaacatcgccgccgccgccagcgagccccacagctag

SEQ ID NO: 18734 - DNA, 3135 bp, Artificial Sequence
  Description of Artificial Sequence: Synthetic coding sequence
atggccctgagccccggcgccaacctggtgttccacgaggaccccaagatgacccccagcccccccagctgcggcgcccccggcctgggcagcggcaccatcccccagccccaccccgacatggcccaggtgcccatgctgaacctgctgcccagccccggcctggccctggtgcccgacctgaacgacagcctgagccccgtgagcggcgaggccagcggcctggtgagcgagaacacccccagacccgacgacagcagagccatcgcccccgccagcctgcagatcaccagcagctgcagcggcgaggccctggacctggacagcaaggacgtgagcagacccgacagccagggcagactgtgccccgccagcaaccccatcctgagccccagcagcaccgaggcccccagactgagcagcggcaaccacccccagagcaacagcgaggacgccttcaagtgcctgagcagcaagatcttcaagctgggccagagaaacagcaaccccagcagacacgagctgaaccccttcatcagacaccacagcagagagggcctggtgctgggccactgcatcagcagacccagcagcaaggccctgctgatccccaccagcaacagcagcctggacctggacagcaaccccctgctgaacatgggcagcagaaacaccagcaagctgaacctgaacgtggcccccgacagccacggcaccctgatccccgacaccaacgagaccatcaccctggccagccacaacatcagcgagagcgtgagcaagggcgccttcagcaccacctggagcaccagcagcaaggagaccatgaacgtggccagcagcggccacagcagaagcgacctgagcgtgaccatcacccaggccagctacgtgaccctgatccccggcagcagctacggcatcagcctgcacagcagcacccacgagcccaacagcaccatcagcccccccagctgcatgaccctgatcctgggcagcaacgagaccctgagcctggacagcagcctgctgttcagcgacaccagcaccctgaccctgagcagccagcaggacgacgccaaggacaacagcatccacaccgtgcccctggaggagaacctggagagctggagcgagatggccagcatcaaggtgggccagttccccctgggcttccccatcagcaaccccgccggcaaggacgccgtgaccctgcagggcatccccgagggcgccttcgacgaggtgaccagctgcctggtgaaggtgcccgagaagaccgagggcggcaacaacatggccctggtggagaacgtgaccaccctgcagaagagccaggacctgctggaggccgagggcgagaagaagaccatgatcaagaagatcatgagacagatccaggaggagcccctggacagcctgagcagcagcgtgagaaagcaggccatggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagagccatggtgcagtacagctgccaggagctgtgcagaatcctgtacctgctgatccccctgctggagagaggcgacgagaagcacagaatcaccgccaccgccttcttcgtggagcagccctgcgaggagggcatcgtgatcctgatgctgagaatcagctgggagagacagcagcaggccgtgaccggcgccagaagctggagagtgacccacagcgccctgccccacggcgccgacggccaccagaccgagaccagcagcaacctgctggtgctgcaggtgtag

SEQ ID NO: 18735 - DNA, 1179 bp, Artificial Sequence
  Description of Artificial Sequence: Synthetic coding sequence
atggtgctgatggacatcagaagaagactgcccgccatctgctggttctgcaagagcgaggcccccggcagagccgagcccggcatccagtgcgccatccccgtgcacggcagacccggcggctgccccgcccccctgagcctgggcagcaacgaccccctgctgccccagctgctgcagatggagcaggtgagaagaatccccgaggagtacagcctgggcagaatggccgagggcctgagccaccacgaccccatcatgaaggtgctgagcatcagaggcctggtgatcctggccagaagaagcgagaagaccgccaaggtgaaggccctgctgcccagcatggtgaagggcctgaagaacatggacggcatgctggtggtggaggccgtgcacaacctgaaggccgtgttcaagggcagagaccagaagctgatggacagcgccgtgtacgtggagatgctgcagatcctgctgccccacttcagcgacgccagagaggtggtgagaagcagctgcatcaacctgtacggcaaggtggtgcagaagctgagagcccccagaacccaggccatggaggagcagctggtgagcaccctggtgcccctgctgctgaccatgcaggagggcaacagcaaggtgagccagaagtgcgtgaagaccctgctgagatgcagctacttcatggcctgggagctgcccaagagagcctacagcagaaagccctgggacaaccagcagcagaccgtggccaagatctgcaagtgcctggtgaacacccacagagacagcgccttcatcttcctgagccagagcctggagtacgccaagaacagcagagccagcctgagaaagtgcagcgtgatgttcatcggcagcctggtgccctgcatggagagcatcatgaccgaggacagactgaacgaggtgaaggccgccctggacaacctgagacacgaccccgaggccagcgtgtgcatctacgccgcccaggtgcaggaccacatcctggccagctgctggcagaacagctggctgccccacggcaacagctgggtgtgctacagcgccaccacccacagatggagccccagctgcgagaacctgcccaccagccaccagagaagaagctggatcatgcaggccctgggcagctggaagatgagcctgaagaagtag

SEQ ID NO: 18736 - DNA, 3093 bp, Artificial Sequence
  Description of Artificial Sequence: Synthetic coding sequence
atggccctgagccccggcgccaacctggtgttccacgaggaccccaagatgacccccagcccccccagctgcggcgcccccggcctgggcagcggcaccatcccccagccccaccccgacatggcccaggtgcccatgctgaacctgctgcccagccccggcctggccctggtgcccgacctgaacgacagcctgagccccgtgagcggcgaggccagcggcctggtgagcgagaacacccccagacccgacgacagcagagccatcgcccccgccagcctgcagatcaccagcagctgcagcggcgaggccctggacctggacagcaaggacgtgagcagacccgacagccagggcagactgtgccccgccagcaaccccatcctgagccccagcagcaccgaggcccccagactgagcagcggcaaccacccccagagcaacagcgaggacgccttcaagtgcctgagcagcaagatcttcaagctgggccagagaaacagcaaccccagcagacacgagctgaaccccttcatcagacaccacagcagagagggcctggtgctgggccactgcatcagcagacccagcagcaaggccctgctgatccccaccagcaacagcagcctggacctggacagcaaccccctgctgaacatgggcagcagaaacaccagcaagctgaacctgaacgtggcccccgacagccacggcaccctgatccccgacaccaacgagaccatcaccctggccagccacaacatcagcgagagcgtgagcaagggcgccttcagcaccacctggagcaccagcagcaaggagaccatgaacgtggccagcagcggccacagcagaagcgacctgagcgtgaccatcacccaggccagctacgtgaccctgatccccggcagcagctacggcatcagcctgcacagcagcacccacgagcccaacagcaccatcagcccccccagctgcatgaccctgatcctgggcagcaacgagaccctgagcctggacagcagcctgctgttcagcgacaccagcaccctgaccctgagcagccagcaggacgacgccaaggacaacagcatccacaccgtgcccctggaggagaacctggagagctggagcgagatggccagcatcaaggtgggccagttccccctgggcttccccatcagcaaccccgccggcaaggacgccgtgaccctgcagggcatccccgagggcgccttcgacgaggtgaccagctgcctggtgaaggtgcccgagaagaccgagggcggcaacaacatggccctggtggagaacgtgaccaccctgcagaagagccaggacctgctggaggccgagggcgagaagaagaccatgatcaagaagatcatgagacagatccaggaggagcccctggacagcctgagcagcagcgtgagaaagcaggccatggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagagccatggtgcagtacagctgccaggagctgtgcagaatcctgtacctgctgatccccctgctggagagaggcgacgagaagcacagaatcaccgccaccgccttcttcgtggagcagccctgcgaggagggcatcgtgatcctgatgctgagaccccaggacctgatgggcaaggccaccaccagcagccacagaggcagcgagctggagagcgacaccctgagcttcgccacctggtgctag

SEQ ID NO: 18737 - DNA, 3870 bp, Artificial Sequence
  Description of Artificial Sequence: Synthetic coding sequence
atggccctgagccccggcgccaacctggtgttccacgaggaccccaagatgacccccagcccccccagctgcggcgcccccggcctgggcagcggcaccatcccccagccccaccccgacatggcccaggtgcccatgctgaacctgctgcccagccccggcctggccctggtgcccgacctgaacgacagcctgagccccgtgagcggcgaggccagcggcctggtgagcgagaacacccccagacccgacgacagcagagccatcgcccccgccagcctgcagatcaccagcagctgcagcggcgaggccctggacctggacagcaaggacgtgagcagacccgacagccagggcagactgtgccccgccagcaaccccatcctgagccccagcagcaccgaggcccccagactgagcagcggcaaccacccccagagcaacagcgaggacgccttcaagtgcctgagcagcaagatcttcaagctgggccagagaaacagcaaccccagcagacacgagctgaaccccttcatcagacaccacagcagagagggcctggtgctgggccactgcatcagcagacccagcagcaaggccctgctgatccccaccagcaacagcagcctggacctggacagcaaccccctgctgaacatgggcagcagaaacaccagcaagctgaacctgaacgtggcccccgacagccacggcaccctgatccccgacaccaacgagaccatcaccctggccagccacaacatcagcgagagcgtgagcaagggcgccttcagcaccacctggagcaccagcagcaaggagaccatgaacgtggccagcagcggccacagcagaagcgacctgagcgtgaccatcacccaggccagctacgtgaccctgatccccggcagcagctacggcatcagcctgcacagcagcacccacgagcccaacagcaccatcagcccccccagctgcatgaccctgatcctgggcagcaacgagaccctgagcctggacagcagcctgctgttcagcgacaccagcaccctgaccctgagcagccagcaggacgacgccaaggacaacagcatccacaccgtgcccctggaggagaacctggagagctggagcgagatggccagcatcaaggtgggccagttccccctgggcttccccatcagcaaccccgccggcaaggacgccgtgaccctgcagggcatccccgaggacggcgtgagcctgctgctgcccagactggagtgcaacggcgccatcagcgcccactgcaacctgtgcctgcccggcgccttcgacgaggtgaccagctgcctggtgaaggtgcccgagaagaccgagggcggcaacaacatggccctggtggagaacgtgaccaccctgcagaagagccaggacctgctggaggccgagggcgagaagaagaccatgatcaagaagatcatgagacagatccaggaggagcccctggacagcctgagcagcagcgtgagaaagcaggccatggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatcgccatccagatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagagccatggtgcagtacagctgccaggagctgtgcagaatcctgtacctgctgatccccctgctggagagaggcgacgagaagcacagaatcaccgccaccgccttcttcgtggagctgctgcagatggagcaggtgagaagaatccccgaggagtacagcctgggcagaatggccgagggcctgagccaccacgaccccatcatgaaggtgctgagcatcagaggcctggtgatcctggccagaagaagcgagaagaccgccaaggtgaaggccctgctgcccagcatggtgaagggcctgaagaacatggacggcatgctggtggtggaggccgtgcacaacctgaaggccgtgttcaagggcagagaccagaagctgatggacagcgccgtgtacgtggagatgctgcagatcctgctgccccacttcagcgacgccagagaggtggtgagaagcagctgcatcaacctgtacggcaaggtggtgcagaagctgagagcccccagaacccaggccatggaggagcagctggtgagcaccctggtgcccctgctgctgaccatgcaggagggcaacagcaaggtgagccagaagtgcgtgaagaccctgctgagatgcagctacttcatggcctgggagctgcccaagagagcctacagcagaaagccctgggacaaccagcagcagaccgtggccaagatctgcaagtgcctggtgaacacccacagagacagcgccttcatcttcctgagccagagcctggagtacgccaagaacagcagagccagcctgagaaagtgcagcgtgatgttcatcgccacccccagaggccagagattccacctgctgtgcccccccctgtacagccagcccctggagcaggccggcagcgccgagagagccaagaacctgaagagaagcccctacctgtag

SEQ ID NO: 18738 - DNA, 3972 bp, Artificial Sequence
  Description of Artificial Sequence: Synthetic coding sequence
atggccctgagccccggcgccaacctggtgttccacgaggaccccaagatgacccccagcccccccagctgcggcgcccccggcctgggcagcggcaccatcccccagccccaccccgacatggcccaggtgcccatgctgaacctgctgcccagccccggcctggccctggtgcccgacctgaacgacagcctgagccccgtgagcggcgaggccagcggcctggtgagcgagaacacccccagacccgacgacagcagagccatcgcccccgccagcctgcagatcaccagcagctgcagcggcgaggccctggacctggacagcaaggacgtgagcagacccgacagccagggcagactgtgccccgccagcaaccccatcctgagccccagcagcaccgaggcccccagactgagcagcggcaaccacccccagagcaacagcgaggacgccttcaagtgcctgagcagcaagatcttcaagctgggccagagaaacagcaaccccagcagacacgagctgaaccccttcatcagacaccacagcagagagggcctggtgctgggccactgcatcagcagacccagcagcaaggccctgctgatccccaccagcaacagcagcctggacctggacagcaaccccctgctgaacatgggcagcagaaacaccagcaagctgaacctgaacgtggcccccgacagccacggcaccctgatccccgacaccaacgagaccatcaccctggccagccacaacatcagcgagagcgtgagcaagggcgccttcagcaccacctggagcaccagcagcaaggagaccatgaacgtggccagcagcggccacagcagaagcgacctgagcgtgaccatcacccaggccagctacgtgaccctgatccccggcagcagctacggcatcagcctgcacagcagcacccacgagcccaacagcaccatcagcccccccagctgcatgaccctgatcctgggcagcaacgagaccctgagcctggacagcagcctgctgttcagcgacaccagcaccctgaccctgagcagccagcaggacgacgccaaggacaacagcatccacaccgtgcccctggaggagaacctggagagctggagcgagatggccagcatcaaggtgggccagttccccctgggcttccccatcagcaaccccgccggcaaggacgccgtgaccctgcagggcatccccgagggcgccttcgacgaggtgaccagctgcctggtgaaggtgcccgagaagaccgagggcggcaacaacatggccctggtggagaacgtgaccaccctgcagaagagccaggacctgctggaggccgagggcgagaagaagaccatgatcaagaagatcatgagacagatccaggaggagcccctggacagcctgagcagcagcgtgagaaagcaggccatggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagagccatggtgcagtacagctgccaggagctgtgcagaatcctgtacctgctgatccccctgctggagagaggcgacgagaagcacagaatcaccgccaccgccttcttcgtggagctgctgcagatggagcaggtgagaagaatccccgaggagtacagcctgggcagaatggccgagggcctgagccaccacgaccccatcatgaaggtgctgagcatcagaggcctggtgatcctggccagaagaagcgagaagaccgccaaggtgaaggccctgctgcccagcatggtgaagggcctgaagaacatggacggcatgctggtggtggaggccgtgcacaacctgaaggccgtgttcaagggcagagaccagaagctgatggacagcgccgtgtacgtggagatgctgcagatcctgctgccccacttcagcgacgccagagaggtggtgagaagcagctgcatcaacctgtacggcaaggtggtgcagaagctgagagcccccagaacccaggccatggaggagcagctggtgagcaccctggtgcccctgctgctgaccatgcaggagggcaacagcaaggtgagccagaagtgcgtgaagaccctgctgagatgcagctacttcatggcctgggagctgcccaagagagcctacagcagaaagccctgggacaaccagcagcagaccgtggccaagatctgcaagtgcctggtgaacacccacagagacagcgccttcatcttcctgagccagagcctggagtacgccaagaacagcagagccagcctgagaaagtgcagcgtgatgttcatcggcagcctggtgccctgcatggagagcatcatgaccgaggacagactgaacgaggtgaaggccgccctggacaacctgagacacgaccccgaggccagcgtgtgcatctacgccgcccaggtgcaggaccacatcctggccagctgctggcagaacagctggctgccccacggcaacagctgggtgtgctacagcgccaccacccacagatggagccccagctgcgagaacctgcccaccagccaccagagaagaagctggatcatgcaggccctgggcagctggaagatgagcctgaagaagtag

SEQ ID NO: 18739 - DNA, 2526 bp, Artificial Sequence
  Description of Artificial Sequence: Synthetic coding sequence
atggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagagccatggtgcagtacagctgccaggagctgtgcagaatcctgtacctgctgatccccctgctggagagaggcgacgagaagcacagaatcaccgccaccgccttcttcgtggagctgctgcagatggagcaggtgagaagaatccccgaggagtacagcctgggcagaatggccgagggcctgagccaccacgaccccatcatgaaggtgctgagcatcagaggcctggtgatcctggccagaagaagcgagaagaccgccaaggtgaaggccctgctgcccagcatggtgaagggcctgaagaacatggacggcatgctggtggtggaggccgtgcacaacctgaaggccgtgttcaagggcagagaccagaagctgatggacagcgccgtgtacgtggagatgctgcagatcctgctgccccacttcagcgacgccagagaggtggtgagaagcagctgcatcaacctgtacggcaaggtggtgcagaagctgagagcccccagaacccaggccatggaggagcagctggtgagcaccctggtgcccctgctgctgaccatgcaggagggcaacagcaaggtgagccagaagtgcgtgaagaccctgctgagatgcagctacttcatggcctgggagctgcccaagagagcctacagcagaaagccctgggacaaccagcagcagaccgtggccaagatctgcaagtgcctggtgaacacccacagagacagcgccttcatcttcctgagccagagcctggagtacgccaagaacagcagagccagcctgagaaagtgcagcgtgatgttcatcggcagcctggtgccctgcatggagagcatcatgaccgaggacagactgaacgaggtgaaggccgccctggacaacctgagacacgaccccgaggccagcgtgtgcatctacgccgcccaggtgcaggaccacatcctggccagctgctggcagaacagctggctgccccacggcaacagctgggtgtgctacagcgccaccacccacagatggagccccagctgcgagaacctgcccaccagccaccagagaagaagctggatcatgcaggccctgggcagctggaagatgagcctgaagaagtag

SEQ ID NO: 18740 - DNA, 1623 bp, Artificial Sequence
  Description of Artificial Sequence: Synthetic coding sequence
atggccctggtggagaacgtgaccaccctgcagaagagccaggacctgctggaggccgagggcgagaagaagaccatgatcaagaagatcatgagacagatccaggaggagcccctggacagcctgagcagcagcgtgagaaagcaggccatggagatcctgacccagctgagccacacccagcccaccctgggcatgagagagagaagcgagctggtgaacgtgtgcgtgcacagcgtgttcagcctgcccagcgtgcaggccatgcaggagaaggacgaggccaaggccgagaccatccaggccctgtaccaccagaccctggaggccctgcagaccctgctgaaggccctgttcatcgaggaccccacccccgccggcctgaagagcatcctggaggccctgggcccctggatgaacagcggcaaggcccacgagagagccagagccgtgaacaccaacgtgagcgtgctgaaccacatgctgctgaccctgcccttcttcatgcccctgggcttccccgccctgggcctgctgctgggcagactgatcctgcacatcggcgaccccgacgaggagatcggctgcgaggccctggacggcatcatcatcctgtacaccatcctggagctgcagaagagagccagagacaaggaggagaccaacaagaaggagctgtacgagagcaacaagcacttcctgggcccctacaaccccgtgagcccctgccagaacatcctgagagtgatcgaggagttcggcgacttcctgggcccccagcagatcaaggacctgctgctggccgccctggagggcctgaagggcagcagcgaggcccccggcaaggacagcagagagatgatgcagctggccagcgaggtgatgctgagcagcgtgctggagtggtacagacacagagccctggaggtgatccccgagatcatgcagggcatctacatgcagctgagccacatccaggagcccagagccagacaggtggccctgctgcccgtgagcctgctggccagcagcttcatgaccgaggtggtggtggccctgctgatgtgccccctgcccctgaacagcaacggcgccgagatgtggagacagctgatcctgtgcaagcccagctgcgacgtgagagacctgctggacctgctgctgggcagcctgaaggagaagcccgtgaccaaggagggcagagccagcatcgtgcccctggccgccgccagcggcctgtgcgagctgctgagcgtgaacagctgcatgggcagagtgagaagaatctacccccagctgctgctggccctgctgatccaggtgcactaccacatcggcctgaacctgcccggctgcgtggccccccccaaggacaccaagaagggcgcccagcccagccccttcgtgcccgtgagatgggtggtgaaggtggtgaagaccctgctgctgagaatgggctgcagctacgagaccaccttcctggaggaccagggcggctgggagctgatggagcaggtggagagccaccacagaggcgtggccctgctggccagcagcagcagatggagcagatgcgccggcagccccagaaacaccctgtggggcggctggcagaaggcctag

SEQ ID NO: 18741 - DNA, 1416 bp, Artificial Sequence
  Description of Artificial Sequence: Synthetic coding sequence
atggccagagagatgaccatcctgggcagcgccgtgctgaccctgctgctggccggctacctggcccagcagtacctgcccctgcccacccccaaggtgatcggcatcgacctgggcaccacctactgcagcgtgggcgtgttcttccccggcaccggcaaggtgaaggtgatccccgacgagaacggccacatcagcatccccagcatggtgagcttcaccgacaacgacgtgtacgtgggctacgagagcgtggagctggccgacagcaacccccagaacaccatctacgacgccaagagattcatcggcaagatcttcaccgccgaggagctggaggccgagatcggcagataccccttcaaggtgctgaacaagaacggcatggtggagttcagcgtgaccagcaacgagaccatcaccgtgagccccgagtacgtgggcagcagactgctgctgaagctgaaggagatggccgaggcctacctgggcatgcccgtggccaacgccgtgatcagcgtgcccgccgagttcgacctgaagcagagaaacagcaccatcgaggccgccaacctggccggcctgaagatcctgagagtgatcaacgagcccaccgccgccgccatggcctacggcctgcacaaggccgacgtgttccacgtgctggtgatcgacctgggcggcggcaccctggacgtgagcctgctgaacaagcagggcggcatgttcctgaccagagccatgagcggcaacaacaagctgggcggccaggacttcaaccagagactgctgcagtacctgtacaagcagatctaccagacctacggcttcgtgcccagcagaaaggaggagatccacagactgagacaggccgtggagatggtgaagctgaacctgaccctgcaccagagcgcccagctgagcgtgctgctgaccgtggaggagcaggacagaaaggagccccacagcagcgacaccgagctgcccaaggacaagctgagcagcgccgacgaccacagagtgaacagcggcttcggcagaggcctgagcgacaagaagagcggcgagagccaggtgctgttcgagaccgagatcagcagaaagctgttcgacaccctgaacgaggacctgttccagaagatcctggtgcccatccagcaggtgctgaaggagggccacctggagaagaccgagatcgacgaggtggtgctggtgggcggcagcaccagaatccccagaatcagacaggtgatccaggagttcttcggcaaggaccccaacaccagcgtggaccccgacctggccgtggtgaccggcgtggccatccaggccggcatcgacggcggcagctggcccctgcaggtgagcgccctggagatccccaacaagcacctgcagaagaccaacttcaactag

SEQ ID NO: 18742 - DNA, 792 bp, Artificial Sequence
  Description of Artificial Sequence: Synthetic coding sequence
atggcctacggcctgcacaaggccgacgtgttccacgtgctggtgatcgacctgggcggcggcaccctggacgtgagcctgctgaacaagcagggcggcatgttcctgaccagagccatgagcggcaacaacaagctgggcggccaggacttcaaccagagactgctgcagtacctgtacaagcagatctaccagacctacggcttcgtgcccagcagaaaggaggagatccacagactgagacaggccgtggagatggtgaagctgaacctgaccctgcaccagagcgcccagctgagcgtgctgctgaccgtggaggagcaggacagaaaggagccccacagcagcgacaccgagctgcccaaggacaagctgagcagcgccgacgaccacagagtgaacagcggcttcggcagaggcctgagcgacaagaagagcggcgagagccaggtgctgttcgagaccgagatcagcagaaagctgttcgacaccctgaacgaggacctgttccagaagatcctggtgcccatccagcaggtgctgaaggagggccacctggagaagaccgagatcgacgaggtggtgctggtgggcggcagcaccagaatccccagaatcagacaggtgatccaggagttcttcggcaaggaccccaacaccagcgtggaccccgacctggccgtggtgaccggcgtggccatccaggccggcatcgacggcggcagctggcccctgcaggtgagcgccctggagatccccaacaagcacctgcagaagaccaacttcaactag

SEQ ID NO: 18743 - DNA, 1515 bp, Artificial Sequence
  Description of Artificial Sequence: Synthetic coding sequence
atgggcatcaagaccgccctgcccgccgccgagctgggcctgtacagcctggtgctgagcggcgccctggcctacgccggcagaggcctgctggaggccagccaggacggcgcccacagaaaggccttcagagagagcgtgagacccggctgggagtacatcggcagaaagatggacgtggccgacttcgagtgggtgatgtggttcaccagcttcagaaacgtgatcatcttcgccctgagcggccacgtgctgttcgccaagctgtgcaccatggtggcccccaagctgagaagctggatgtacgccgtgtacggcgccctggccgtgatgggcaccatgggcccctggtacctgctgctgctgctgggccactgcgtgggcctgtacgtggccagcctgctgggccagccctggctgtgcctgggcctgggcctggccagcctggccagcttcaagatggaccccctgatcagctggcagagcggcttcgtgaccggcaccttcgacctgcaggaggtgctgttccacggcggcagcagcttcaccgtgctgagatgcaccagcttcgccctggagagctgcgcccaccccgacagacactacagcctggccgacctgctgaagtacaacttctacctgcccttcttcttcttcggccccatcatgaccttcgacagattccacgcccaggtgagccaggtggagcccgtgagaagagagggcgagctgtggcacatcagagcccaggccggcctgagcgtggtggccatcatggccgtggacatcttcttccacttcttctacatcctgaccatccccagcgacctgaagttcgccaacagactgcccgacagcgccctggccggcctggcctacagcaacctggtgtacgactgggtgaaggccgccgtgctgttcggcgtggtgaacaccgtggcctgcctggaccacctggaccccccccagccccccaagtgcatcaccgccctgtacgtgttcgccgagacccacttcgacagaggcatcaacgactggctgtgcaagtacgtgtacaaccacatcggcggcgagcacagcgccgtgatccccgagctggccgccaccgtggccaccttcgccatcaccaccctgtggctgggcccctgcgacatcgtgtacctgtggagcttcctgaactgcttcggcctgaacttcgagctgtggatgcagaagctggccgagtggggccccctggccagaatcgaggccagcctgagcgtgcagatgagcagaagagtgagagccctgttcggcgccatgaacttctgggccatcatcatgtacaacctggtgagcctgaacagcctgaagttcaccgagctggtggccagaagactgctgctgaccggcttcccccagaccaccctgagcatcctgttcgtgacctactgcggcgtgcagctggtgaaggagagagagagaaccctggccctggaggaggagcagaagcaggacaaggagaagcccgagtag

SEQ ID NO: 18744 - DNA, 738 bp, Artificial Sequence
  Description of Artificial Sequence: Synthetic coding sequence
atggtggcccccaagctgagaagctggatgtacgccgtgtacggcgccctggccgtgatgggcaccatgggcccctggtacctgctgctgctgctgggccactgcgtgggcctgtacgtggccagcctgctgggccagccctggctgtgcctgggcctgggcctggccagcctggccagcttcaagatggaccccctgatcagctggcagagcggcttcgtgaccggcaccttcgacctgcaggaggtgctgttccacggcggcagcagcttcaccgtgctgagatgcaccagcttcgccctggagagctgcgcccaccccgacagacactacagcctggccgacctgctgaagtacaacttctacctgcccttcttcttcttcggccccatcatgaccttcgacagattccacgcccaggtgagccaggtggagcccgtgagaagagagggcgagctgtggcacatcagagcccaggccggcctgagcgtggtggccatcatggccgtggacatcttcttccacttcttctacatcctgagccccgccaccagcagcagccccaccgccagccagaccgtgcccagcgccggcctggcctacagcaacctggtgtacgactgggtgaagggcagacccctgtggtgctgccagcactggcacgccagcaccacctggacccaccccccccccaagtgcatcaccgccctgtacgtgttcgccgagacccacttctag

SEQ ID NO: 18745 - DNA, 696 bp, Artificial Sequence
  Description of Artificial Sequence: Synthetic coding sequence
atgggcatcaagaccgccctgcccgccgccgagctgggcctgtacagcctggtgctgagcggcgccctggcctacgccggcagaggcctgctggaggccagccaggacggcgcccacagaaaggccttcagagagagcgtgagacccggctgggagtacatcggcagaaagatggacgtggccgacttcgagtgggtgatgtggttcaccagcttcagaaacgtgatcatcttcgccctgagcggccacgtgctgttcgccaagctgtgcaccatggtggcccccaagctgagaagctggatgtacgccgtgtacggcgccctggccgtgatgggcaccatgggcccctggtacctgctgctgctgctgggccactgcgtgggcctgtacgtggccagcctgctgggccagccctggctgtgcctgggcctgggcctggccagcctggccagcttcaagatggaccccctgatcagctggcagagcggcttcgtgaccggcaccttcgacctgcaggaggtgctgttccacggcggcagcagcttcaccgtgctgagatgcaccagcttcgccctggagagctgcgcccaccccgacagacactacagcctggccgacctgctgaagtacaacttctacctgcccttcttcttcttcggccccatcatgaccttcgacagattccacgcccagtag

SEQ ID NO: 18746 - DNA, 1515 bp, Artificial Sequence; identical to SEQ ID NO: 18743
  Description of Artificial Sequence: Synthetic coding sequence

SEQ ID NO: 18747 - DNA, 282 bp, Artificial Sequence
  Description of Artificial Sequence: Synthetic coding sequence
atgatccacctgggccacatcctgttcctgctgctgctgcccgtggccgccgcccagaccacccccggcgagagaagcagcctgcccgccttctaccccggcaccagcggcagctgcagcggctgcggcagcctgagcctgcccctgctggccggcctggtggccgccgacgccgtggccagcctgctgatcgtgggcgccgtgttcctgtgcgccagacccagaagaagccccgcccaggaggacggcaaggtgtacatcaacatgcccggcagaggctag

SEQ ID NO: 18748 - DNA, 279 bp, Artificial Sequence
  Description of Artificial Sequence: Synthetic coding sequence
atgatccacctgggccacatcctgttcctgctgctgctgcccgtggccgccgcccagaccacccccggcgagagaagcagcctgcccgccttctaccccggcaccagcggcagctgcagcggctgcggcagcctgagcctgcccctgctggccggcctggtggccgccgacgccgtggccagcctgctgatcgtgggcgccgtgttcctgtgcgccagacccagaagaagccccgcccaggacggcaaggtgtacatcaacatgcccggcagaggctag

SEQ ID NO: 18749 - DNA, 924 bp, Artificial Sequence
  Description of Artificial Sequence: Synthetic coding sequence
atggccgccctgctgctgggcgccgtgctgctggtggcccagccccagctggtgcccagcagacccgccgagctgggccagcaggagctgctgagaaaggccggcaccctgcaggacgacgtgagagacggcgtggcccccaacggcagcgcccagcagctgccccagaccatcatcatcggcgtgagaaagggcggcaccagagccctgctggagatgctgagcctgcaccccgacgtggccgccgccgagaacgaggtgcacttcttcgactgggaggagcactacagccacggcctgggctggtacctgagccagatgcccttcagctggccccaccagctgaccgtggagaagacccccgcctacttcaccagccccaaggtgcccgagagagtgtacagcatgaaccccagcatcagactgctgctgatcctgagagaccccagcgagagagtgctgagcgactacacccaggtgttctacaaccacatgcagaagcacaagccctaccccagcatcgaggagttcctggtgagagacggcagactgaacgtggactacaaggccctgaacagaagcctgtaccacgtgcacatgcagaactggctgagattcttccccctgagacacatccacatcgtggacggcgacagactgatcagagaccccttccccgagatccagaaggtggagagattcctgaagctgagcccccagatcaacgccagcaacttctacttcaacaagaccaagggcttctactgcctgagagacagcggcagagacagatgcctgcacgagagcaagggcagagcccacccccaggtggaccccaagctgctgaacaagctgcacgagtacttccacgagcccaacaagaagttcttcgagctggtgggcagaaccttcgactggcactag

SEQ ID NO: 18750 - DNA, 252 bp, Artificial Sequence
  Description of Artificial Sequence: Synthetic coding sequence
atggccgccctgctgctgggcgccgtgctgctggtggcccagccccagctggtgcccagcagacccgccgagctgggccagcaggagctgctgagaaaggccggcaccctgcaggacgacgtgagagacggcgtggcccccaacggcagcgcccagcagctgccccagaccatcatcatcggcgtgagaaagggcggcaccagagccctgctggagatgctgagcctgcaccccgacgtggccgccgcctag

SEQ ID NO: 18751 - DNA, 252 bp, Artificial Sequence; identical to SEQ ID NO: 18750
  Description of Artificial Sequence: Synthetic coding sequence

SEQ ID NO: 18752 - DNA, 1029 bp, Artificial Sequence
  Description of Artificial Sequence: Synthetic coding sequence
atggccggcagcggcggcctgggcggcggcgccggcggcggccagggcgccggcgccggccagggcgccgccctgagagccagcagagcccccatgctgctggtggccctggtgctgggcgcctactgcctgtgcgccctgcccggcagatgcccccccgccgccagagcccccgcccccgcccccgcccccagcgagcccagcagcagcgtgcacagacccggcgcccccggcctgcccctggccagcggccccggcagaagaagattcccccaggccctgatcgtgggcgtgaagaagggcggcaccagagccctgctggagttcctgagactgcaccccgacgtgagagccctgggcagcgagccccacttcttcgacagatgctacgagagaggcctggcctggtacagaagcctgatgcccagaaccctggacggccagatcaccatggagaagacccccagctacttcgtgaccagagaggcccccagaagaatccacgccatgagccccgacaccaagctgatcgtggtggtgagaaaccccgtgaccagagccatcagcgactacgcccagaccctgagcaagacccccggcctgcccagcttcagagccctggccttcagacacggcctgggccccgtggacaccgcctggagcgccgtgagaatcggcctgtacgcccagcacctggaccactggctgagatacttccccctgagccacttcctgttcgtgagcggcgagagactggtgagcgaccccgccggcgaggtgggcagagtgcaggacttcctgggcctgaagagagtggtgaccgacaagcacttctacttcaacgccaccaagggcttcccctgcctgaagaaggcccagggcggcagcagacccagatgcctgggcaagagcaagggcagaccccaccccagagtgccccaggccctggtgagaagactgcaggagttctacagacccttcaacagaagattctaccagatgaccggccaggacttcggctggggctag

SEQ ID NO: 18753 - DNA, 936 bp, Artificial Sequence
  Description of Artificial Sequence: Synthetic coding sequence
atgctgctggtggccctggtgctgggcgcctactgcctgtgcgccctgcccggcagatgcccccccgccgccagagcccccgcccccgcccccgcccccagcgagcccagcagcagcgtgcacagacccggcgcccccggcctgcccctggccagcggccccggcagaagaagattcccccaggccctgatcgtgggcgtgaagaagggcggcaccagagccctgctggagttcctgagactgcaccccgacgtgagagccctgggcagcgagccccacttcttcgacagatgctacgagagaggcctggcctggtacagaagcctgatgcccagaaccctggacggccagatcaccatggagaagacccccagctacttcgtgaccagagaggcccccagaagaatccacgccatgagccccgacaccaagctgatcgtggtggtgagaaaccccgtgaccagagccatcagcgactacgcccagaccctgagcaagacccccggcctgcccagcttcagagccctggccttcagacacggcctgggccccgtggacaccgcctggagcgccgtgagaatcggcctgtacgcccagcacctggaccactggctgagatacttccccctgagccacttcctgttcgtgagcggcgagagactggtgagcgaccccgccggcgaggtgggcagagtgcaggacttcctgggcctgaagagagtggtgaccgacaagcacttctacttcaacgccaccaagggcttcccctgcctgaagaaggcccagggcggcagcagacccagatgcctgggcaagagcaagggcagaccccaccccagagtgccccaggccctggtgagaagactgcaggagttctacagacccttcaacagaagattctaccagatgaccggccaggacttcggctggggctag

SEQ ID NO: 18754 - DNA, 1146 bp, Artificial Sequence
  Description of Artificial Sequence: Synthetic coding sequence
gccgccggcccccccggcgccgagcacaagcccggcacccacggcctgagcggcgccagagccgagatgagagccagactgctgccccccctgcccggcctggagagaagagaccccatggccggcagcggcggcctgggcggcggcgccggcggcggccagggcgccggcgccggccagggcgccgccctgagagccagcagagcccccatgctgctggtggccctggtgctgggcgcctactgcctgtgcgccctgcccggcagatgcccccccgccgccagagcccccgcccccgcccccgcccccagcgagcccagcagcagcgtgcacagacccggcgcccccggcctgcccctggccagcggccccggcagaagaagattcccccaggccctgatcgtgggcgtgaagaagggcggcaccagagccctgctggagttcctgagactgcaccccgacgtgagagccctgggcagcgagccccacttcttcgacagatgctacgagagaggcctggcctggtacagaagcctgatgcccagaaccctggacggccagatcaccatggagaagacccccagctacttcgtgaccagagaggcccccagaagaatccacgccatgagccccgacaccaagctgatcgtggtggtgagaaaccccgtgaccagagccatcagcgactacgcccagaccctgagcaagacccccggcctgcccagcttcagagccctggccttcagacacggcctgggccccgtggacaccgcctggagcgccgtgagaatcggcctgtacgcccagcacctggaccactggctgagatacttccccctgagccacttcctgttcgtgagcggcgagagactggtgagcgaccccgccggcgaggtgggcagagtgcaggacttcctgggcctgaagagagtggtgaccgacaagcacttctacttcaacgccaccaagggcttcccctgcctgaagaaggcccagggcggcagcagacccagatgcctgggcaagagcaagggcagaccccaccccagagtgccccaggccctggtgagaagactgcaggagttctacagacccttcaacagaagattctaccagatgaccggccaggacttcggctggggctag

SEQ ID NO: 18755 - DNA, 906 bp, Artificial Sequence
  Description of Artificial Sequence: Synthetic coding sequence
atgttcagccacctgcccttcgactgcgtgctgctgctgctgctgctgctgctgaccagaagcagcgaggtggagtacagagccgaggtgggccagaacgcctacctgccctgcttctacacccccgccgcccccggcaacctggtgcccgtgtgctggggcaagggcgcctgccccgtgttcgagtgcggcaacgtggtgctgagaaccgacgagagagacgtgaactactggaccagcagatactggctgaacggcgacttcagaaagggcgacgtgagcctgaccatcgagaacgtgaccctggccgacagcggcatctactgctgcagaatccagatccccggcatcatgaacgacgagaagttcaacctgaagctggtgatcaagcccgccaaggtgacccccgcccccaccagacagagagacttcaccgccgccttccccagaatgctgaccaccagaggccacggccccgccgagacccagaccctgggcagcctgcccgacatcaacctgacccagatcagcaccctggccaacgagctgagagacagcagactggccaacgacctgagagacagcggcgccaccatcagaatcggcatctacatcggcgccggcatctgcgccggcctggccctggccctgatcttcggcgccctgatcttcaagtggtacagccacagcaaggagaagatccagaacctgagcctgatcagcctggccaacctgccccccagcggcctggccaacgccgtggccgagggcatcagaagcgaggagaacatctacaccatcgaggagaacgtgtacgaggtggaggagcccaacgagtactactgctacgtgagcagcagacagcagcccagccagcccctgggctgcagattcgccatgccctag

SEQ ID NO: 18756 - DNA, 3480 bp, Artificial Sequence
  Description of Artificial Sequence: Synthetic coding sequence
atgcccagaaagcagcccgccggctgcatcttcctgctgaccttcctgggcctgagcggcctggtgggcaccgtgaccagaacctactacatcggcatcgtggaggagtactggaactacgtgccccagggcaagaacgtgatcaccggcaagagcttcaccgaggacaagctggccaccctgttcctggagagaggccccaacagaatcggcagcatctacaagaaggccgtgtacagaagattcaccgacggcacctacagcatcgagatccccaagcccccctggctgggcttcctgggccccatcctgagagccgaggtgggcgacgtgatcgtgatccacctgaagaacttcgccagcagaccctacagcctgcacccccacggcgtgttctacaacaaggacagcgagggcgccctgtaccccgacggcaccagcggcagaaacaagaacgacgacatggtgccccccggcaagaactacacctacgtgtggcccgtgagagaggagtacgcccccacccccgccgacgccaactgcctgacctgggtgtaccacagccacatcgacgcccccaaggacatctgcagcggcctgatcggccccctgctggtgtgcaaggagggcatcctgaacagatacagcggcaccagaaacgacgtggacagagagttcgtgatcatgttcaccctggtggacgagaaccagagctggtacctgaacgagaacatcaagcacttctgcaccaaccccgacagcgtggacaagaaggacgccgtgttccagagaagcaacaagatgcacgccctgaacggctacctgttcggcaacttccccgagcccgacatgtgcgtgggcgagagcgtgagctggcacctgttcggcatgggcaacgagatcgacatccacagcatctacttctacggcaacaccttcatcagcagaggccacagaaccgacgtggtgaacctgttccccgccaccttcctgaccaccgagatgatcgccgagaaccccggcaagtggatgatcacctgccaggtgagcgaccacctgcaggccggcatgctgggccagtacaacgtggacaactgcaagagcgacatcttctaccccaagatgaagggccagcagagaagatacttcatcgccgccgagaagatcctgtgggactacgccccccagggctacaacaagttcagcggcctgcccctgaacgccagcggcagcgacagcgacctgtacttcacccagggcgacaacagaatcggcggcaagtactggaaggtgagatacaccgagttcgtggacgccaccttcaccaagagaaagagactgagcgccgaggaggcccacctgggcatcctgggccccgtgatcaaggccgaggtgggcgacaccctgctggtgaccttcgccaacaaggccgacaaggtgtacagcatcctgccccacggcgtgatctacgacaaggccagcgacgccgcccccaacctggacggcttcgtgaagcccggcgcccacgtgaagcccggcgagaccttcacctacaagtggaccgtgcccgagagcgtgagccccaccgccggcgaccccccctgcctgacctacctgtacttcagcgccgtggaccccatcaaggacaccagcagcggcctggtgggccccctgctggtgtgcaagaagggcgtgctgaacgccgacggcacccagaagggcatcgacaaggagttctacctgctgttcaccgtgttcgacgagaacctgagcagatacttcgacgagaacatccagaagttcatctggcaccccttcagcatcgacaaggaggacaaggagttcgtgaagagcaacagaatgcacgccgtgaacggctacatgtacggcaaccagcccggcctgaacatgtgcaagagagacagagtgagctggcacctgatcggcctgggcaccgacaccgacatgcacggcatcgtgttccagggcaacaccatccacctgagaggcacccacagagacagcctggccctgttcccccacatggccaccaccgccttcatgcagcccgaccacgccggcatcttcagagtgttctgcgccaccatgccccacctgagcagaggcatgggccagatctacgaggtgagcagctgcgacaacagagaccccagcgagcagagatacggcatgatcagaaccttctacatcgccgccgaggaggtggagtgggactacgcccccaacaagaactgggagttcgagaagcagcacgtggacgccagaggcgagagacacggcgacatcttcatgaacagaaccgagaactggatcggcagccagtacaagaaggtggtgtacagagagtacaccgacggcgagttcgtggagatcaaggccagaccccccagagaggagcacctggagctgctgggccccatgatccacgccgaggtgggcaacaccgtgctgatcatcttcaagaacaaggccagcagaccctacagcatcagcgcccagggcgtggaggagatggacagcggcaagcagttccaggtgcccatgaccaagcccggcgaggtgaagacctacagatggaacatccccaagagaagcggccccggccccagcgaccccaactgcatcccctgggtgtactacagcaccgtgaacttcgtgaaggacacctacagcggcctgatgggccccctgatcacctgcagaaagggcgtgctgaacgagaagggcagaagaagcgacgtggactacgagttcgccctgctgttcctggtgttcaacgagaacgagagctggtacctggacgacaacatcaagaagtacctgaacaaggaccccagagacttcaagagaaccgacgacttcgaggagagcaacagaatgcacgccatcaacggcaagatcttcggcaacctgcacggcctgatcatgaacgaggacaccatgaccaactggtacctgctgggcatcggcagcgaggtggacatccacaccatccactaccacgccgagagcttcctgttcaagatcgacaagagctacagagaggacgtgtacgacctgttccccggcaccttccagaccatcgagctgttcgccgaccaccccggcacctggctgctgcactgccacgtgagcgaccacatccacgccggcatggagaccacctacaccgtgctgagaaacatcgacaacagaatcccctacagcaccaccagccccggcgtggccagccaccccgccaccgtgcccagcaacgagagacccggcaaggagcagctgtacttcttcggcaagaacctgggccccaccggcgccaaggccgccctggtgatcctgttcatcatcggcctgctgctgctgatcaccaccgtgatcctgagcctgagactgtgcagcgccatgaagcagaccgactaccagcaggtgcagagctgcgccctgcccaccgacgccctgtag

SEQ ID NO: 18757 - DNA, 1221 bp, Artificial Sequence
  Description of Artificial Sequence: Synthetic coding sequence
atggaccagagcggcatggagatccccgtgaccctgatcatcaaggcccccaaccagaagtacagcgaccagaccatcagctgcttcctgaactggaccgtgggcaagctgaagacccacctgagcaacgtgtaccccagcaagcccctgaccaaggaccagagactggtgtacagcggcagactgctgcccgaccacctgcagctgaaggacatcctgagaaagcaggacgagtaccacatggtgcacctggtgtgcaccagcagaaccccccccagcagccccaagagcagcaccaacagagagagccacgaggccctggccagcagcagcaacagcagcagcgaccacagcggcagcaccacccccagcagcggccaggagaccctgagcctggccgtgggcagcagcagcgagggcctgagacagagaaccctgccccaggcccagaccgaccaggcccagagccaccagttcccctacgtgatgcagggcaacgtggacaaccagttccccggccaggccgccccccccggcttccccgtgtaccccgccttcagccccctgcagatgctgtggtggcagcagatgtacgcccaccagtactacatgcagtaccaggccgccgtgagcgcccaggccaccagcaacgtgaaccccacccagcccaccaccagccagcccctgaacctggcccacgtgcccggcgaggagcccccccccgcccccaacctggtggcccaggagaacagacccatgaacgagaacgtgcagatgaacgcccagggcggccccgtgctgaacgaggaggacttcaacagagactggctggactggatgtacaccttcagcagagccgccatcctgctgagcatcgtgtacttctacagcagcttcagcagattcatcatggtgatgggcgccatgctgctggtgtacctgcaccaggccggctggttccccttcagacaggagggcggccaccagcaggcccccaacaacaacgccgaggtgaacaacgacggccagaacgccaacaacctggagctggaggagatggagagactgatggacgacggcctggaggacgagagcggcgaggacggcggcgaggacgccagcgccatccagagacccggcctgatggccagcgcctggagcttcatcaccaccttcttcaccagcctgatccccgagggccccccccaggtggccaactag

SEQ ID NO: 18758 - DNA, 1221 bp, Artificial Sequence; identical to SEQ ID NO: 18757
  Description of Artificial Sequence: Synthetic coding sequence

SEQ ID NO: 18759 - DNA, 1245 bp, Artificial Sequence
  Description of Artificial Sequence: Synthetic coding sequence
atgaaggcccagaccgccctgagcttcttcctgatcctgatcaccagcctgagcggcagccagggcatcttccccctggccttcttcatctacgtgcccatgaacgagcagatcgtgatcggcagactggacgaggacatcatcctgcccagcagcttcgagagaggcagcgaggtggtgatccactggaagtaccaggacagctacaaggtgcacagctactacaagggcagcgaccacctggagagccaggaccccagatacgccaacagaaccagcctgttctacaacgagatccagaacggcaacgccagcctgttcttcagaagagtgagcctgctggacgagggcatctacacctgctacgtgggcaccgccatccaggtgatcaccaacaaggtggtgctgaaggtgggcgtgttcctgacccccgtgatgaagtacgagaagagaaacaccaacagcttcctgatctgcagcgtgctgagcgtgtaccccagacccatcatcacctggaagatggacaacacccccatcagcgagaacaacatggaggagaccggcagcctggacagcttcagcatcaacagccccctgaacatcaccggcagcaacagcagctacgagtgcaccatcgagaacagcctgctgaagcagacctggaccggcagatggaccatgaaggacggcctgcacaagatgcagagcgagcacgtgagcctgagctgccagcccgtgaacgactacttcagccccaaccaggacttcaaggtgacctggagcagaatgaagagcggcaccttcagcgtgctggcctactacctgagcagcagccagaacaccatcatcaacgagagcagattcagctggaacaaggagctgatcaaccagagcgacttcagcatgaacctgatggacctgaacctgagcgacagcggcgagtacctgtgcaacatcagcagcgacgagtacaccctgctgaccatccacaccgtgcacgtggagcccagccaggagaccgccagccacaacaagggcctgtggatcctggtgcccagcgccatcctggccgccttcctgctgatctggagcgtgaagtgctgcagagcccagctggaggccagaagaagcagacaccccgccgacggcgcccagcaggagagatgctgcgtgccccccggcgagagatgccccagcgcccccgacaacggcgaggagaacgtgcccctgagcggcaaggtgtag

SEQ ID NO: 18760 - DNA, 294 bp, Artificial Sequence
  Description of Artificial Sequence: Synthetic coding sequence
atgaaggcccagaccgccctgagcttcttcctgatcctgatcaccagcctgagcggcagccagggcatcttccccctggccttcttcatctacgtgcccatgaacgagcagatcgtgatcggcagactggacgaggacatcatcctgcccagcagcttcgagagaggcagcgaggtggtgatccactggaagtaccaggacagctacaaggtgcacagctactacaagggcagcgaccacctggagagccaggaccccagatacgccaacagaaccagcctgttctacaactag

SEQ ID NO: 18761 - DNA, 438 bp, Artificial Sequence
  Description of Artificial Sequence: Synthetic coding sequence
atgaaggcccagaccgccctgagcttcttcctgatcctgatcaccagcctgagcggcagccagggcatcttccccctggccttcttcatctacgtgcccatgaacgagcagatcgtgatcggcagactggacgaggacatcatcctgcccagcagcttcgagagaggcagcgaggtggtgatccactggaagtaccaggacagctacaaggtgcacagctactacaagggcagcgaccacctggagagccaggaccccagatacgccaacagaaccagcctgttctacaacgagatccagaacggcaacgccagcctgttcttcagaagagtgagcctgctggacgagggcatctacacctgctacgtgggcaccgccatccaggtgatcaccaacaaggtggtgctgaaggtgggcgtgttcctgacccccgtgtag

SEQ ID NO: 18762 - DNA, 1245 bp, Artificial Sequence; identical to SEQ ID NO: 18759
  Description of Artificial Sequence: Synthetic coding sequence

SEQ ID NO: 18763 - DNA, 411 bp, Artificial Sequence
  Description of Artificial Sequence: Synthetic coding sequence
atgaaggcccagaccgccctgagcttcttcctgatcctgatcaccagcctgagcggcagccagggcatcttccccctggccttcttcatctacgtgcccatgaacgagcagatcgtgatcggcagactggacgaggacatcatcctgcccagcagcttcgagagaggcagcgaggtggtgatccactggaagtaccaggacagctacaaggtgcacagctactacaagggcagcgaccacctggagagccaggaccccagatacgccaacagaaccagcctgttctacaacgagatccagaacggcaacgccagcctgttcttcagaagagtgagcctgctggacgagggcatctacacctgctacgtgggcaccgccatccaggtgatcaccaacaaggtggtgctgtag

SEQ ID NO: 18764 - DNA, 1245 bp, Artificial Sequence; identical to SEQ ID NO: 18759
  Description of Artificial Sequence: Synthetic coding sequence

SEQ ID NO: 18765 - DNA, 2193 bp, Artificial Sequence
  Description of Artificial Sequence: Synthetic coding sequence
atggccgccggcgtggaggccgccgccgaggtggccgccaccgagatcaagatggaggaggagagcggcgcccccggcgtgcccagcggcaacggcgcccccggccccaagggcgagggcgagagacccgcccagaacgagaagagaaaggagaagaacatcaagagaggcggcaacagattcgagccctacgccaaccccaccaagagatacagagccttcatcaccaacatccccttcgacgtgaagtggcagagcctgaaggacctggtgaaggagaaggtgggcgaggtgacctacgtggagctgctgatggacgccgagggcaagagcagaggctgcgccgtggtggagttcaagatggaggagagcatgaagaaggccgccgaggtgctgaacaagcacagcctgagcggcagacccctgaaggtgaaggaggaccccgacggcgagcacgccagaagagccatgcagaaggtgatggccaccaccggcggcatgggcatgggccccggcggccccggcatgatcaccatcccccccagcatcctgaacaaccccaacatccccaacgagatcatccacgccctgcaggccggcagactgggcagcaccgtgttcgtggccaacctggactacaaggtgggctggaagaagctgaaggaggtgttcagcatggccggcgtggtggtgagagccgacatcctggaggacaaggacggcaagagcagaggcatcggcaccgtgaccttcgagcagagcatcgaggccgtgcaggccatcagcatgttcaacggccagctgctgttcgacagacccatgcacgtgaagatggacgagagagccctgcccaagggcgacttcttcccccccgagagaccccagcagctgccccacggcctgggcggcatcggcatgggcctgggccccggcggccagcccatcgacgccaaccacctgaacaagggcatcggcatgggcaacatcggccccgccggcatgggcatggagggcatcggcttcggcatcaacaagatgggcggcatggagggccccttcggcggcggcatggagaacatgggcagattcggcagcggcatgaacatgggcagaatcaacgagatcctgagcaacgccctgaagagaggcgagatcatcgccaagcagggcggcggcggcggcggcggcagcgtgcccggcatcgagagaatgggccccggcatcgacagactgggcggcgccggcatggagagaatgggcgccggcctgggccacggcatggacagagtgggcagcgagatcgagagaatgggcctggtgatggacagaatgggcagcgtggagagaatgggcagcggcatcgagagaatgggccccctgggcctggaccacatggccagcagcatcgagagaatgggccagaccatggagagaatcggcagcggcgtggagagaatgggcgccggcatgggcttcggcctggagagaatggccgcccccatcgacagagtgggccagaccatcgagagaatgggcagcggcgtggagagaatgggccccgccatcgagagaatgggcctgagcatggagagaatggtgcccgccggcatgggcgccggcctggagagaatgggccccgtgatggacagaatggccaccggcctggagagaatgggcgccaacaacctggagagaatgggcctggagagaatgggcgccaacagcctggagagaatgggcctggagagaatgggcgccaacagcctggagagaatgggccccgccatgggccccgccctgggcgccggcatcgagagaatgggcctggccatgggcggcggcggcggcgccagcttcgacagagccatcgagatggagagaggcaacttcggcggcagcttcgccggcagcttcggcggcgccggcggccacgcccccggcgtggccagaaaggcctgccagatcttcgtgagaaacctgcccttcgacttcacctggaagatgctgaaggacaagttcaacgagtgcggccacgtgctgtacgccgacatcaagatggagaacggcaagagcaagggctgcggcgtggtgaagttcgagagccccgaggtggccgagagagcctgcagaatgatgaacggcatgaagctgagcggcagagagatcgacgtgagaatcgacagaaacgcctag

SEQ ID NO: 18766 - DNA, 2076 bp, Artificial Sequence
  Description of Artificial Sequence: Synthetic coding sequence
atggccgccggcgtggaggccgccgccgaggtggccgccaccgagatcaagatggaggaggagagcggcgcccccggcgtgcccagcggcaacggcgcccccggccccaagggcgagggcgagagacccgcccagaacgagaagagaaaggagaagaacatcaagagaggcggcaacagattcgagccctacgccaaccccaccaagagatacagagccttcatcaccaacatccccttcgacgtgaagtggcagagcctgaaggacctggtgaaggagaaggtgggcgaggtgacctacgtggagctgctgatggacgccgagggcaagagcagaggctgcgccgtggtggagttcaagatggaggagagcatgaagaaggccgccgaggtgctgaacaagcacagcctgagcggcagacccctgaaggtgaaggaggaccccgacggcgagcacgccagaagagccatgcagaaggccggcagactgggcagcaccgtgttcgtggccaacctggactacaaggtgggctggaagaagctgaaggaggtgttcagcatggccggcgtggtggtgagagccgacatcctggaggacaaggacggcaagagcagaggcatcggcaccgtgaccttcgagcagagcatcgaggccgtgcaggccatcagcatgttcaacggccagctgctgttcgacagacccatgcacgtgaagatggacgagagagccctgcccaagggcgacttcttcccccccgagagaccccagcagctgccccacggcctgggcggcatcggcatgggcctgggccccggcggccagcccatcgacgccaaccacctgaacaagggcatcggcatgggcaacatcggccccgccggcatgggcatggagggcatcggcttcggcatcaacaagatgggcggcatggagggccccttcggcggcggcatggagaacatgggcagattcggcagcggcatgaacatgggcagaatcaacgagatcctgagcaacgccctgaagagaggcgagatcatcgccaagcagggcggcggcggcggcggcggcagcgtgcccggcatcgagagaatgggccccggcatcgacagactgggcggcgccggcatggagagaatgggcgccggcctgggccacggcatggacagagtgggcagcgagatcgagagaatgggcctggtgatggacagaatgggcagcgtggagagaatgggcagcggcatcgagagaatgggccccctgggcctggaccacatggccagcagcatcgagagaatgggccagaccatggagagaatcggcagcggcgtggagagaatgggcgccggcatgggcttcggcctggagagaatggccgcccccatcgacagagtgggccagaccatcgagagaatgggcagcggcgtggagagaatgggccccgccatcgagagaatgggcctgagcatggagagaatggtgcccgccggcatgggcgccggcctggagagaatgggccccgtgatggacagaatggccaccggcctggagagaatgggcgccaacaacctggagagaatgggcctggagagaatgggcgccaacagcctggagagaatgggcctggagagaatgggcgccaacagcctggagagaatgggccccgccatgggccccgccctgggcgccggcatcgagagaatgggcctggccatgggcggcggcggcggcgccagcttcgacagagccatcgagatggagagaggcaacttcggcggcagcttcgccggcagcttcggcggcgccggcggccacgcccccggcgtggccagaaaggcctgccagatcttcgtgagaaacctgcccttcgacttcacctggaagatgctgaaggacaagttcaacgagtgcggccacgtgctgtacgccgacatcaagatggagaacggcaagagcaagggctgcggcgtggtgaagttcgagagccccgaggtggccgagagagcctgcagaatgatgaacggcatgaagctgagcggcagagagatcgacgtgagaatcgacagaaacgcctag

SEQ ID NO: 18767 - DNA, 864 bp, Artificial Sequence
  Description of Artificial Sequence: Synthetic coding sequence
atgggcagcgtggagagaatgggcagcggcatcgagagaatgggccccctgggcctggaccacatggccagcagcatcgagagaatgggccagaccatggagagaatcggcagcggcgtggagagaatgggcgccggcatgggcttcggcctggagagaatggccgcccccatcgacagagtgggccagaccatcgagagaatgggcagcggcgtggagagaatgggccccgccatcgagagaatgggcctgagcatggagagaatggtgcccgccggcatgggcgccggcctggagagaatgggccccgtgatggacagaatggccaccggcctggagagaatgggcgccaacaacctggagagaatgggcctggagagaatgggcgccaacagcctggagagaatgggcctggagagaatgggcgccaacagcctggagagaatgggccccgccatgggccccgccctgggcgccggcatcgagagaatgggcctggccatgggcggcggcggcggcgccagcttcgacagagccatcgagatggagagaggcaacttcggcggcagcttcgccggcagcttcggcggcgccggcggccacgcccccggcgtggccagaaaggcctgccagatcttcgtgagaaacctgcccttcgacttcacctggaagatgctgaaggacaagttcaacgagtgcggccacgtgctgtacgccgacatcaagatggagaacggcaagagcaagggctgcggcgtggtgaagttcgagagccccgaggtggccgagagagcctgcagaatgatgaacggcatgaagctgagcggcagagagatcgacgtgagaatcgacagaaacgcctag

SEQ ID NO: 18768 - DNA, 1848 bp, Artificial Sequence
  Description of Artificial Sequence: Synthetic coding sequence
aacggcagccacctgaagacctggctgaagaagaagggctgcgccgtggtggagttcaagatggaggagagcatgaagaaggccgccgaggtgctgaacaagcacagcctgagcggcagacccctgaaggtgaaggaggaccccgacggcgagcacgccagaagagccatgcagaaggtgatggccaccaccggcggcatgggcatgggccccggcggccccggcatgatcaccatcccccccagcatcctgaacaaccccaacatccccaacgagatcatccacgccctgcaggccggcagactgggcagcaccgtgttcgtggccaacctggactacaaggtgggctggaagaagctgaaggaggtgttcagcatggccggcgtggtggtgagagccgacatcctggaggacaaggacggcaagagcagaggcatcggcaccgtgaccttcgagcagagcatcgaggccgtgcaggccatcagcatgttcaacggccagctgctgttcgacagacccatgcacgtgaagatggacgagagagccctgcccaagggcgacttcttcccccccgagagaccccagcagctgccccacggcctgggcggcatcggcatgggcctgggccccggcggccagcccatcgacgccaaccacctgaacaagggcatcggcatgggcaacatcggccccgccggcatggagggccccttcggcggcggcatggagaacatgggcagattcggcagcggcatgaacatgggcagaatcaacgagatcctgagcaacgccctgaagagaggcgagatcatcgccaagcagggcggcggcggcggcggcggcagcgtgcccggcatcgagagaatgggccccggcatcgacagactgggcggcgccggcatggagagaatgggcgccggcctgggccacggcatggacagagtgggcagcgagatcgagagaatgggcctggtgatggacagaatgggcagcgtggagagaatgggcagcggcatcgagagaatgggccccctgggcctggaccacatggccagcagcatcgagagaatgggccagaccatggagagaatcggcagcggcgtggagagaatgggcgccggcatgggcttcggcctggagagaatggccgcccccatcgacagagtgggccagaccatcgagagaatgggcagcggcgtggagagaatgggccccgccatcgagagaatgggcctgagcatggagagaatggtgcccgccggcatgggcgccggcctggagagaatgggccccgtgatggacagaatggccaccggcctggagagaatgggcgccaacaacctggagagaatgggcctggagagaatgggcgccaacagcctggagagaatgggcctggagagaatgggcgccaacagcctggagagaatgggccccgccatgggccccgccctgggcgccggcatcgagagaatgggcctggccatgggcggcggcggcggcgccagcttcgacagagccatcgagatggagagaggcaacttcggcggcagcttcgccggcagcttcggcggcgccggcggccacgcccccggcgtggccagaaaggcctgccagatcttcgtgagaaacctgcccttcgacttcacctggaagatgctgaaggacaagttcaacgagtgcggccacgtgctgtacgccgacatcaagatggagaacggcaagagcaagggctgcggcgtggtgaagttcgagagccccgaggtggccgagagagcctgcagaatgatgaacggcatgaagctgagcggcagagagatcgacgtgagaatcgacagaaacgcctag

SEQ ID NO: 18769 - DNA, 2754 bp, Artificial Sequence
  Description of Artificial Sequence: Synthetic coding sequence
atgttcgccgtgcacctgatggccttctacttcagcaagctgaaggaggaccagatcaagaaggtggacagattcctgtaccacatgagactgagcgacgacaccctgctggacatcatgagaagattcagagccgagatggagaagggcctggccaaggacaccaaccccaccgccgccgtgaagatgctgcccaccttcgtgagagccatccccgacggcagcgagaacggcgagttcctgagcctggacctgggcggcagcaagttcagagtgctgaaggtgcaggtggccgaggagggcaagagacacgtgcagatggagagccagttctaccccacccccaacgagatcatcagaggcaacggcaccgagctgttcgagtacgtggccgactgcctggccgacttcatgaagaccaaggacctgaagcacaagaagctgcccctgggcctgaccttcagcttcccctgcagacagaccaagctggaggagggcgtgctgctgagctggaccaagaagttcaaggccagaggcgtgcaggacaccgacgtggtgagcagactgaccaaggccatgagaagacacaaggacatggacgtggacatcctggccctggtgaacgacaccgtgggcaccatgatgacctgcgcctacgacgacccctactgcgaggtgggcgtgatcatcggcaccggcaccaacgcctgctacatggaggacatgagcaacatcgacctggtggagggcgacgagggcagaatgtgcatcaacaccgagtggggcgccttcggcgacgacggcgccctggaggacatcagaaccgagttcgacagagagctggacctgggcagcctgaaccccggcaagcagctgttcgagaagatgatcagcggcctgtacctgggcgagctggtgagactgatcctgctgaagatggccaaggccggcctgctgttcggcggcgagaagagcagcgccctgcacaccaagggcaagatcgagaccagacacgtggccgccatggagaagtacaaggagggcctggccaacaccagagagatcctggtggacctgggcctggagcccagcgaggccgactgcatcgccgtgcagcacgtgtgcaccatcgtgagcttcagaagcgccaacctgtgcgccgccgccctggccgccatcctgaccagactgagagagaacaagaaggtggagagactgagaaccaccgtgggcatggacggcaccctgtacaagatccacccccagtaccccaagagactgcacaaggtggtgagaaagctggtgcccagctgcgacgtgagattcctgctgagcgagagcggcagcaccaagggcgccgccatggtgaccgccgtggccagcagagtgcaggcccagagaaagcagatcgacagagtgctggccctgttccagctgaccagagagcagctggtggacgtgcaggccaagatgagagccgagctggagtacggcctgaagaagaagagccacggcctggccaccgtgagaatgctgcccacctacgtgtgcggcctgcccgacggcaccgagaagggcaagttcctggccctggacctgggcggcaccaacttcagagtgctgctggtgaagatcagaagcggcagaagaagcgtgagaatgtacaacaagatcttcgccatccccctggagatcatgcagggcaccggcgaggagctgttcgaccacatcgtgcagtgcatcgccgacttcctggactacatgggcctgaagggcgccagcctgcccctgggcttcaccttcagcttcccctgcagacagatgagcatcgacaagggcaccctgatcggctggaccaagggcttcaaggccaccgactgcgagggcgaggacgtggtggacatgctgagagaggccatcaagagaagaaacgagttcgacctggacatcgtggccgtggtgaacgacaccgtgggcaccatgatgacctgcggctacgaggaccccaactgcgagatcggcctgatcgccggcaccggcagcaacatgtgctacatggaggacatgagaaacatcgagatggtggagggcggcgagggcaagatgtgcatcaacaccgagtggggcggcttcggcgacaacggctgcatcgacgacatctggaccagatacgacaccgaggtggacgagggcagcctgaaccccggcaagcagagatacgagaagatgaccagcggcatgtacctgggcgagatcgtgagacagatcctgatcgacctgaccaagcagggcctgctgttcagaggccagatcagcgagagactgagaaccagaggcatcttcgagaccaagttcctgagccagatcgagagcgacagactggccctgctgcaggtgagaagaatcctgcagcagctgggcctggacagcacctgcgaggacagcatcgtggtgaaggaggtgtgcggcgccgtgagcagaagagccgcccagctgtgcggcgccggcctggccgccatcgtggagaagagaagagaggaccagggcctggagcacctgagaatcaccgtgggcgtggacggcaccctgtacaagctgcacccccacttcagcagaatcctgcaggagaccgtgaaggagctggcccccagatgcgacgtgaccttcatgctgagcgaggacggcagcggcaagggcgccgccctgatcaccgccgtggccaagagactgcagcaggcccagaaggagaactag

SEQ ID NO: 18770 - DNA, 2421 bp, Artificial Sequence
  Description of Artificial Sequence: Synthetic coding sequence
atgttcgccgtgcacctgatggccttctacttcagcaagctgaaggaggaccagatcaagaaggtggacagattcctgtaccacatgagactgagcgacgacaccctgctggacatcatgagaagattcagagccgagatggagaagggcctggccaaggacaccaaccccaccgccgccgtgaagatgctgcccaccttcgtgagagccatccccgacggcagcgagaacggcgagttcctgagcctggacctgggcggcagcaagttcagagtgctgaaggtgcaggtggccgaggagggcaagagacacgtgcagatggagagccagttctaccccacccccaacgagatcatcagaggcaacggcaccgagctgttcgagtacgtggccgactgcctggccgacttcatgaagaccaaggacctgaagcacaagaagctgcccctgggcctgaccttcagcttcccctgcagacagaccaagctggaggagggcgtgctgctgagctggaccaagaagttcaaggccagaggcgtgcaggacaccgacgtggtgagcagactgaccaaggccatgagaagacacaaggacatggacgtggacatcctggccctggtgaacgacaccgtgggcaccatgatgacctgcgcctacgacgacccctactgcgaggtgggcgtgatcatcggcaccggcaccaacgcctgctacatggaggacatgagcaacatcgacctggtggagggcgacgagggcagaatgtgcatcaacaccgagtggggcgccttcggcgacgacggcgccctggaggacatcagaaccgagttcgacagagagctggacctgggcagcctgaaccccggcaagcagctgttcgagaagatgatcagcggcctgtacctgggcgagctggtgagactgatcctgctgaagatggccaaggccggcctgctgttcggcggcgagaagagcagcgccctgcacaccaagggcaagatcgagaccagacacgtggccgccatggagaagtacaaggagggcctggccaacaccagagagatcctggtggacctgggcctggagcccagcgaggccgactgcatcgccgtgcagcacgtgtgcaccatcgtgagcttcagaagcgccaacctgtgcgccgccgccctggccgccatcctgaccagactgagagagaacaagaaggtggagagactgagaaccaccgtgggcatggacggcaccctgtacaagatccacccccagtaccccaagagactgcacaaggtggtgagaaagctggtgcccagctgcgacgtgagattcctgctgagcgagagcggcagcaccaagggcgccgccatggtgaccgccgtggccagcagagtgcaggcccagagaaagcagatcgacagagtgctggccctgttccagctgaccagagagcagctggtggacgtgcaggccaagatgagagccgagctggagtacggcctgaagaagaagagccacggcctggccaccgtgagaatgctgcccacctacgtgtgcggcctgcccgacggcaccgagaagggcaagttcctggccctggacctgggcggcaccaacttcagagtgctgctggtgaagatcagaagcggcagaagaagcgtgagaatgtacaacaagatcttcgccatccccctggagatcatgcagggcaccggcgaggagctgttcgaccacatcgtgcagtgcatcgccgacttcctggactacatgggcctgaagggcgccagcctgcccctgggcttcaccttcagcttcccctgcagacagatgagcatcgacaagggcaccctgatcggctggaccaagggcttcaaggccaccgactgcgagggcgaggacgtggtggacatgctgagagaggccatcaagagaagaaacgagttcgacctggacatcgtggccgtggtgaacgacaccgtgggcaccatgatgacctgcggctacgaggaccccaactgcgagatcggcctgatcgccggcaccggcagcaacatgtgctacatggaggacatgagaaacatcgagatggtggagggcggcgagggcaagatgtgcatcaacaccgagtggggcggcttcggcgacaacggctgcatcgacgacatctggaccagatacgacaccgaggtggacgagggcagcctgaaccccggcaagcagagatacgagaagatgaccagcggcatgtacctgggcgagatcgtgagacagatcctgatcgacctgaccaagcagggcctgctgttcagaggccagatcagcgagagactgagaaccagaggcatcttcgagaccaagttcctgagccagatcgagagaatgctgagcgtgatcgacgcctactgcctggacctgctgttccactag

SEQ ID NO: 18771 - DNA, 2211 bp, Artificial Sequence
  Description of Artificial Sequence: Synthetic coding sequence
atgttcgccgtgcacctgatggccttctacttcagcaagctgaaggaggaccagatcaagaaggtggacagattcctgtaccacatgagactgagcgacgacaccctgctggacatcatgagaagattcagagccgagatggagaagggcctggccaaggacaccaaccccaccgccgccgtgaagatgctgcccaccttcgtgagagccatccccgacggcagcgagaacggcgagttcctgagcctggacctgggcggcagcaagttcagagtgctgaaggtgcaggtggccgaggagggcaagagacacgtgcagatggagagccagttctaccccacccccaacgagatcatcagaggcaacggcaccgagctgttcgagtacgtggccgactgcctggccgacttcatgaagaccaaggacctgaagcacaagaagctgcccctgggcctgaccttcagcttcccctgcagacagaccaagctggaggagggcgtgctgctgagctggaccaagaagttcaaggccagaggcgtgcaggacaccgacgtggtgagcagactgaccaaggccatgagaagacacaaggacatggacgtggacatcctggccctggtgaacgacaccgtgggcaccatgatgacctgcgcctacgacgacccctactgcgaggtgggcgtgatcatcggcaccggcaccaacgcctgctacatggaggacatgagcaacatcgacctggtggagggcgacgagggcagaatgtgcatcaacaccgagtggggcgccttcggcgacgacggcgccctggaggacatcagaaccgagttcgacagagagctggacctgggcagcctgaaccccggcaagcagctgttcgagaagatgatcagcggcctgtacctgggcgagctggtgagactgatcctgctgaagatggccaaggccggcctgctgttcggcggcgagaagagcagcgccctgcacaccaagggcaagatcgagaccagacacgtggccgccatggagaagtacaaggagggcctggccaacaccagagagatcctggtggacctgggcctggagcccagcgaggccgactgcatcgccgtgcagcacgtgtgcaccatcgtgagcttcagaagcgccaacctgtgcgccgccgccctggccgccatcctgaccagactgagagagaacaagaaggtggagagactgagaaccaccgtgggcatggacggcaccctgtacaagatccacccccagtaccccaagagactgcacaaggtggtgagaaagctggtgcccagctgcgacgtgagattcctgctgagcgagagcggcagcaccaagggcgccgccatggtgaccgccgtggccagcagagtgcaggcccagagaaagcagatcgacagagtgctggccctgttccagctgaccagagagcagctggtggacgtgcaggccaagatgagagccgagctggagtacggcctgaagaagaagagccacggcctggccaccgtgagaatgctgcccacctacgtgtgcggcctgcccgacggcaccgagaagggcaagttcctggccctggacctgggcggcaccaacttcagagtgctgctggtgaagatcagaagcggcagaagaagcgtgagaatgtacaacaagatcttcgccatccccctggagatcatgcagggcaccggcgaggagctgttcgaccacatcgtgcagtgcatcgccgacttcctggactacatgggcctgaagggcgccagcctgcccctgggcttcaccttcagcttcccctgcagacagatgagcatcgacaagggcaccctgatcggctggaccaagggcttcaaggccaccgactgcgagggcgaggacgtggtggacatgctgagagaggccatcaagagaagaaacgagttcgacctggacatcgtggccgtggtgaacgacaccgtgggcaccatgatgacctgcggctacgaggaccccaactgcgagatcggcctgatcgccggcaccggcagcaacatgtgctacatggaggacatgagaaacatcgagatggtggagggcggcgagggcaagatgtgcatctgcttcagcttctgcctgtggttcgtgctgcaggtgctgatcgtggtgctgagaatcgtgagatacagaaagagcagcaagctgatcaagaagttctag

SEQ ID NO: 18772 - DNA, 282 bp, Artificial Sequence
  Description of Artificial Sequence: Synthetic coding sequence
atgagcaccgacaccggcgtgagcctgcccagctacgaggaggaccagggcagcaagctgatcagaaaggccaaggaggcccccttcgtgcccgtgggcatcgccggcttcgccgccatcgtggcctacggcctgtacaagctgaagagcagaggcaacaccaagatgagcatccacctgatccacatgagagtggccgcccagggcttcgtggtgggcgccatgaccgtgggcatgggctacagcatgtacagagagttctgggccaagcccaagccctag

SEQ ID NO: 18773 - DNA, 282 bp, Artificial Sequence; identical to SEQ ID NO: 18772
  Description of Artificial Sequence: Synthetic coding sequence

SEQ ID NO: 18774 - DNA, 324 bp, Artificial Sequence
  Description of Artificial Sequence: Synthetic coding sequence
atggagcagaagctggtggaggagatcctgcaggccatcaccatgagcaccgacaccggcgtgagcctgcccagctacgaggaggaccagggcagcaagctgatcagaaaggccaaggaggcccccttcgtgcccgtgggcatcgccggcttcgccgccatcgtggcctacggcctgtacaagctgaagagcagaggcaacaccaagatgagcatccacctgatccacatgagagtggccgcccagggcttcgtggtgggcgccatgaccgtgggcatgggctacagcatgtacagagagttctgggccaagcccaagccctag

SEQ ID NO: 18775 - DNA, 300 bp, Artificial Sequence
  Description of Artificial Sequence: Synthetic coding sequence
atgagcgccaacagaagatggtgggtgccccccgacgacgaggactgcgtgagcgagaagctgctgagaaagaccagagagagccccctggtgcccatcggcctgggcggctgcctggtggtggccgcctacagaatctacagactgagaagcagaggcagcaccaagatgagcatccacctgatccacaccagagtggccgcccaggcctgcgccgtgggcgccatcatgctgggcgccgtgtacaccatgtacagcgactacgtgaagagaatggcccaggacgccggcgagaagtag

SEQ ID NO: 18776 - DNA, 321 bp, Artificial Sequence
  Description of Artificial Sequence: Synthetic coding sequence
atggccacccccggccccgtgatccccgaggtgcccttcgagcccagcaagccccccgtgatcgagggcctgagccccaccgtgtacagaaaccccgagagcttcaaggagaagttcgtgagaaagaccagagagaaccccgtggtgcccatcggctgcctggccaccgccgccgccctgacctacggcctgtacagcttccacagaggcaacagccagagaagccagctgatgatgagaaccagaatcgccgcccagggcttcaccgtggccgccatcctgctgggcctggccgtgaccgccatgaagagcagaccctag

SEQ ID NO: 18777 - DNA, 321 bp, Artificial Sequence
  Description of Artificial Sequence: Synthetic coding sequence
atggccaccctgggcttcgtgacccccgaggcccccttcgagagcagcaagccccccatcttcgagggcctgagccccaccgtgtacagcaaccccgagggcttcaaggagaagttcctgagaaagaccagagagaaccccgtggtgcccatcggcttcctgtgcaccgccgccgtgctgaccaacggcctgtactgcttccaccagggcaacagccagtgcagcagactgatgatgcacacccagatcgccgcccagggcttcaccatcgccgccatcctgctgggcctggccgccaccgccatgaagagccccccctag

SEQ ID NO: 18778 - DNA, 1473 bp, Artificial Sequence
  Description of Artificial Sequence: Synthetic coding sequence
atgacccagggcaagaagaagaagagagccgccaacagaagcatcatgctggccaagaagatcatcatcaaggacggcggcaccccccagggcatcggcagccccagcgtgtaccacgccgtgatcgtgatcttcctggagttcttcgcctggggcctgctgaccgcccccaccctggtggtgctgcacgagaccttccccaagcacaccttcctgatgaacggcctgatccagggcgtgaagggcctgctgagcttcctgagcgcccccctgatcggcgccctgagcgacgtgtggggcagaaagagcttcctgctgctgaccgtgttcttcacctgcgcccccatccccctgatgaagatcagcccctggtggtacttcgccgtgatcagcgtgagcggcgtgttcgccgtgaccttcagcgtggtgttcgcctacgtggccgacatcacccaggagcacgagagaagcatggcctacggcctggtgagcgccaccttcgccgccagcctggtgaccagccccgccatcggcgcctacctgggcagagtgtacggcgacagcctggtggtggtgctggccaccgccatcgccctgctggacatctgcttcatcctggtggccgtgcccgagagcctgcccgagaagatgagacccgccagctggggcgcccccatcagctgggagcaggccgaccccttcgccagcctgaagaaggtgggccaggacagcatcgtgctgctgatctgcatcaccgtgttcctgagctacctgcccgaggccggccagtacagcagcttcttcctgtacctgagacagatcatgaagttcagccccgagagcgtggccgccttcatcgccgtgctgggcatcctgagcatcatcgcccagaccatcgtgctgagcctgctgatgagaagcatcggcaacaagaacaccatcctgctgggcctgggcttccagatcctgcagctggcctggtacggcttcggcagcgagccctggatgatgtgggccgccggcgccgtggccgccatgagcagcatcaccttccccgccgtgagcgccctggtgagcagaaccgccgacgccgaccagcagggcgtggtgcagggcatgatcaccggcatcagaggcctgtgcaacggcctgggccccgccctgtacggcttcatcttctacatcttccacgtggagctgaaggagctgcccatcaccggcaccgacctgggcaccaacaccagcccccagcaccacttcgagcagaacagcatcatccccggcccccccttcctgttcggcgcctgcagcgtgctgctggccctgctggtggccctgttcatccccgagcacaccaacctgagcctgagaagcagcagctggagaaagcactgcggcagccacagccacccccacaacacccaggcccccggcgaggccaaggagcccctgctgcaggacaccaacgtgtag

SEQ ID NO: 18779 - DNA, 363 bp, Artificial Sequence
  Description of Artificial Sequence: Synthetic coding sequence
tgacacgagaccttccccaagcacaccttcctgatgaacggcctgatccagggcgtgaagggcctgctgagcttcctgagcgcccccctgatcggcgccctgagcgacgtgtggggcagaaagagcttcctgctgctgaccgtgttcttcacctgcgcccccatccccctgatgaagatcagcccctggtggtacttcgccgtgatcagcgtgagcggcgtgttcgccgtgaccttcagcgtggtgttcgcctacgtggccgacatcacccaggagcacgagagaagcatggcctacggcctggtgtgcatgttcatcctgtacctgctgtacctgctgagaaacgccctgttcctgagatag

SEQ ID NO: 18780 - DNA, 462 bp, Artificial Sequence
  Description of Artificial Sequence: Synthetic coding sequence
atggtgggcatcctgagcatcgtggcccagaccgccttcctgagcatcctgatgagaagcctgggcaacaagaacaccgtgctgctgggcctgggcttccagatgctgcagctggcctggtacggcttcggcagccaggcctggatgatgtgggccgccggcaccgtggccgccatgagcagcatcaccttccccgccatcagcgccctggtgagcagaaacgccgagagcgaccagcagggcgtggcccaggaccacaactggaacaagagaaccatgcagtggcccggcgccctgtacggcttcatcttctacatgttccacgtggagctgaccgagctgggccccaagctgaacagcaacaacgtgcccctgcagggcagctgccaccccagacccgccgtgttcatctggggcatgtacagcccctacgtgttcagcggctgcctgatccacagctag

SEQ ID NO: 18781 - DNA, 1521 bp, Artificial Sequence
  Description of Artificial Sequence: Synthetic coding sequence
atgagcgtggagcccccccccgagctggaggagaaggccgccagcgagcccgaggccggcgccatgcccgagaagagagccggcgcccaggccgccggcagcacctggctgcagggcttcggcagacccagcgtgtaccacgccgccatcgtgatcttcctggagttcttcgcctggggcctgctgaccacccccatgctgaccgtgctgcacgagaccttcagccagcacaccttcctgatgaacggcctgatccagggcgtgaagggcctgctgagcttcctgagcgcccccctgatcggcgccctgagcgacgtgtggggcagaaagcccttcctgctgggcaccgtgttcttcacctgcttccccatccccctgatgagaatcagcccctggtggtacttcgccatgatcagcgtgagcggcgtgttcagcgtgaccttcagcgtgatcttcgcctacgtggccgacgtgacccaggagcacgagagaagcaccgcctacggctgggtgagcgccaccttcgccgccagcctggtgagcagccccgccatcggcgcctacctgagcgccagctacggcgacagcctggtggtgctggtggccaccgtggtggccctgctggacatctgcttcatcctggtggccgtgcccgagagcctgcccgagaagatgagacccgtgagctggggcgcccagatcagctggaagcaggccgaccccttcgccagcctgaagaaggtgggcaaggacagcaccgtgctgctgatctgcatcaccgtgttcctgagctacctgcccgaggccggccagtacagcagcttcttcctgtacctgagacaggtgatcggcttcggcagcgtgaagatcgccgccttcatcgccatggtgggcatcctgagcatcgtggcccagaccgccttcctgagcatcctgatgagaagcctgggcaacaagaacaccgtgctgctgggcctgggcttccagatgctgcagctggcctggtacggcttcggcagccaggcctggatgatgtgggccgccggcaccgtggccgccatgagcagcatcaccttccccgccatcagcgccctggtgagcagaaacgccgagagcgaccagcagggcgtggcccagggcatcatcaccggcatcagaggcctgtgcaacggcctgggccccgccctgtacggcttcatcttctacatgttccacgtggagctgaccgagctgggccccaagctgaacagcaacaacgtgcccctgcagggcgccgtgatccccggcccccccttcctgttcggcgcctgcatcgtgctgatgagcttcctggtggccctgttcatccccgagtacagcaaggccagcggcgtgcagaagcacagcaacagcagcagcggcagcctgaccaacacccccgagagaggcagcgacgaggacatcgagcccctgctgcaggacagcagcatctgggagctgagcagcttcgaggagcccggcaaccagtgcaccgagctgtag

SEQ ID NO: 18782 - DNA, 936 bp, Artificial Sequence
  Description of Artificial Sequence: Synthetic coding sequence
atgctgaccgtgctgcacgagaccttcagccagcacaccttcctgatgaacggcctgatccagggcgtgaagggcctgctgagcttcctgagcgcccccctgatcggcgccctgagcgacgtgtggggcagaaagcccttcctgctgggcaccgtgttcttcacctgcttccccatccccctgatgagaatcagcccctggtggtacttcgccatgatcagcgtgagcggcgtgttcagcgtgaccttcagcgtgatcttcgcctacgtggccgacgtgacccaggagcacgagagaagcaccgcctacggctgggtgagcgccaccttcgccgccagcctggtgagcagccccgccatcggcgcctacctgagcgccagctacggcgacagcctggtggtgctggtggccaccgtggtggccctgctggacatctgcttcatcctggtggccgtgcccgagagcctgcccgagaagatgagacccgtgagctggggcgcccagatcagctggaagcaggccgaccccttcgccagcctgaagaaggtgggcaaggacagcaccgtgctgctgatctgcatcaccgtgttcctgagctacctgcccgaggccggccagtacagcagcttcttcctgtacctgagacaggtgatcggcttcggcagcgtgaagatcgccgccttcatcgccatggtgggcatcctgagcatcgtggcccagaccgccttcctgagcatcctgatgagaagcctgggcaacaagaacaccgtgctgctgggcctgggcttccagatgctgcagctggcctggtacggcttcggcagccaggcctggagctgccccggcgaccacaactggaacaagagaaccatgcagtggcccggcgccagcaccgtgtggctgcacatcctgcacgtgccctgcggcaccgactag

SEQ ID NO: 18783 - DNA, 405 bp, Artificial Sequence
  Description of Artificial Sequence: Synthetic coding sequence
atgagcgtggagcccccccccgagctggaggagaaggccgccagcgagcccgaggccggcgccatgcccgagaagagagccggcgcccaggccgccggcagcacctggctgcagggcttcggcccccccagcgtgtaccacgccgccatcgtgatcttcctggagttcttcgcctggggcctgctgaccacccccatgctgaccgtgctgcacgagaccttcagccagcacaccttcctgatgaacggcctgatccagggcgtgaagggcctgctgagcttcctgagcgcccccctgatcggcgccctgagcgacgtgtggggcagaaagcccttcctgctgggcaccgtgttcttcacctgcttccccatccccctgatgagaatcagcccctgccaggcctag

SEQ ID NO: 18784 - DNA, 348 bp, Artificial Sequence
  Description of Artificial Sequence: Synthetic coding sequence
atgctgggcctgctgggcagcaccgccctggtgggctggatcaccggcgccgccgtggccgtgctgctgctgctgctgctgctggccacctgcctgttccacggcagacaggactgcgacgtggagagaaacagaaccgccgccggcggcaacagagtgagaagagcccagccctggcccttcagaagaagaggccacctgggcatcttccaccaccacagacaccccggccacgtgagccacgtgcccaacgtgggcctgcaccaccaccaccaccccagacacaccccccaccacctgcaccaccaccaccacccccacagacaccaccccagacacgccagatag

SEQ ID NO: 18785 - DNA, 1041 bp, Artificial Sequence
  Description of Artificial Sequence: Synthetic coding sequence
atgtacaacggcagctgctgcagaatcgagggcgacaccatcagccaggtgatgccccccctgctgatcgtggccttcgtgctgggcgccctgggcaacggcgtggccctgtgcggcttctgcttccacatgaagacctggaagcccagcaccgtgtacctgttcaacctggccgtggccgacttcctgctgatgatctgcctgcccttcagaaccgactactacctgagaagaagacactgggccttcggcgacatcccctgcagagtgggcctgttcaccctggccatgaacagagccggcagcatcgtgttcctgaccgtggtggccgccgacagatacttcaaggtggtgcacccccaccacgccgtgaacaccatcagcaccagagtggccgccggcatcgtgtgcaccctgtgggccctggtgatcctgggcaccgtgtacctgctgctggagaaccacctgtgcgtgcaggagaccgccgtgagctgcgagagcttcatcatggagagcgccaacggctggcacgacatcatgttccagctggagttcttcatgcccctgggcatcatcctgttctgcagcttcaagatcgtgtggagcctgagaagaagacagcagctggccagacaggccagaatgaagaaggccaccagattcatcatggtggtggccatcgtgttcatcacctgctacctgcccagcgtgagcgccagactgtacttcctgtggaccgtgcccagcagcgcctgcgaccccagcgtgcacggcgccctgcacatcaccctgagcttcacctacatgaacagcatgctggaccccctggtgtactacttcagcagccccagcttccccaagttctacaacaagctgaagatctgcagcctgaagcccaagcagcccggccacagcaagacccagagacccgaggagatgcccatcagcaacctgggcagaagaagctgcatcagcgtggccaacagcttccagagccagagcgacggccagtgggacccccacatcgtggagtggcactag

SEQ ID NO: 18786 - DNA, 1041 bp, Artificial Sequence; identical to SEQ ID NO: 18785
  Description of Artificial Sequence: Synthetic coding sequence

SEQ ID NO: 18787 - DNA, 1041 bp, Artificial Sequence; identical to SEQ ID NO: 18785
  Description of Artificial Sequence: Synthetic coding sequence

SEQ ID NO: 18788 - DNA, 1092 bp, Artificial Sequence
  Description of Artificial Sequence: Synthetic coding sequence
atgaacagacaccacctgcaggaccacttcctggagatcgacaagaagaactgctgcgtgttcagagacgacttcatcgtgaaggtgctgccccccgtgctgggcctggagttcatcttcggcctgctgggcaacggcctggccctgtggatcttctgcttccacctgaagagctggaagagcagcagaatcttcctgttcaacctggccgtggccgacttcctgctgatcatctgcctgcccttcctgatggacaactacgtgagaagatgggactggaagttcggcgacatcccctgcagactgatgctgttcatgctggccatgaacagacagggcagcatcatcttcctgaccgtggtggccgtggacagatacttcagagtggtgcacccccaccacgccctgaacaagatcagcaacagaaccgccgccatcatcagctgcctgctgtggggcatcaccatcggcctgaccgtgcacctgctgaagaagaagatgcccatccagaacggcggcgccaacctgtgcagcagcttcagcatctgccacaccttccagtggcacgaggccatgttcctgctggagttcttcctgcccctgggcatcatcctgttctgcagcgccagaatcatctggagcctgagacagagacagatggacagacacgccaagatcaagagagccatcaccttcatcatggtggtggccatcgtgttcgtgatctgcttcctgcccagcgtggtggtgagaatcagaatcttctggctgctgcacaccagcggcacccagaactgcgaggtgtacagaagcgtggacctggccttcttcatcaccctgagcttcacctacatgaacagcatgctggaccccgtggtgtactacttcagcagccccagcttccccaacttcttcagcaccctgatcaacagatgcctgcagagaaagatgaccggcgagcccgacaacaacagaagcaccagcgtggagctgaccggcgaccccaacaagaccagaggcgcccccgaggccctgatggccaacagcggcgagccctggagccccagctacctgggccccaccagcccctag

SEQ ID NO: 18789 - DNA, 1164 bp, Artificial Sequence
  Description of Artificial Sequence: Synthetic coding sequence
atgaacagacaccacctgcaggaccacttcctggagatcgacaagaagaactgctgcgtgttcagagacgacttcatcgtgaaggtgctgccccccgtgctgggcctggagttcatcttcggcctgctgggcaacggcctggccctgtggatcttctgcttccacctgaagagctggaagagcagcagaatcttcctgttcaacctggccgtggccgacttcctgctgatcatctgcctgcccttcctgatggacaactacgtgagaagatgggactggaagttcggcgacatcccctgcagactgatgctgttcatgctggccatgaacagacagggcagcatcatcttcctgaccgtggtggccgtggacagatacttcagagtggtgcacccccaccacgccctgaacaagatcagcaacagaaccgccgccatcatcagctgcctgctgtggggcatcaccatcggcctgaccgtgcacctgctgaagaagaagatgcccatccagaacggcggcgccaacctgtgcagcagcttcagcatctgccacaccttccagtggcacgaggccatgttcctgctggagttcttcctgcccctgggcatcatcctgttctgcagcgccagaatcatctggagcctgagacagagacagatggacagacacgccaagatcaagagagccatcaccttcatcatggtggtggccatcgtgttcgtgatctgcttcctgcccagcgtggtggtgagaatcagaatcttctggctgctgcacaccagcggcacccagaactgcgaggtgtacagaagcgtggacctggccttcttcatcaccctgagcttcacctacatgaacagcatgctggaccccgtggtgtactacttcagcagccccagcttccccaacttcttcagcaccctgatcaacagatgcctgcagagaaagatgaccggcgagcccgacaacaacagaagcaccagcgtggagctgaccggcgaccccaacaagaccagaggcgcccccgaggccctgatggccaacagcggcgagccctggagccccagctacctgggccccaccagcaacaaccacgccaagaagggccactgccaccaggagcccggcagcctggagaagcagctgggctgctgcatcgagtag

SEQ ID NO: 18790 - DNA, 954 bp, Artificial Sequence
  Description of Artificial Sequence: Synthetic coding sequence
atgtggctgtacctggccgccttcgtgggcctgtactacctgctgcactggtacagagagagacaggtggtgagccacctgcaggacaagtacgtgttcatcaccggctgcgacagcggcttcggcaacctgctggccagacagctggacgccagaggcctgagagtgctggccgcctgcctgaccgagaagggcgccgagcagctgagaggccagaccagcgacagactggagaccgtgaccctggacgtgaccaagatggagagcatcgccgccgccacccagtgggtgaaggagcacgtgggcgacagaggcctgtggggcctggtgaacaacgccggcatcctgacccccatcaccctgtgcgagtggctgaacaccgaggacagcatgaacatgctgaaggtgaacctgatcggcgtgatccaggtgaccctgagcatgctgcccctggtgagaagagccagaggcagaatcgtgaacgtgagcagcatcctgggcagagtggccttcttcgtgggcggctactgcgtgagcaagtacggcgtggaggccttcagcgacatcctgagaagagagatccagcacttcggcgtgaagatcagcatcgtggagcccggctacttcagaaccggcatgaccaacatgacccagagcctggagagaatgaagcagagctggaaggaggcccccaagcacatcaaggagacctacggccagcagtacttcgacgccctgtacaacatcatgaaggagggcctgctgaactgcagcaccaacctgaacctggtgaccgactgcatggagcacgccctgaccagcgtgcaccccagaaccagatacagcgccggctgggacgccaagttcttcttcatccccctgagctacctgcccaccagcctggccgactacatcctgaccagaagctggcccaagcccgcccaggccgtgtag

SEQ ID NO: 18791 - DNA, 954 bp, Artificial Sequence; identical to SEQ ID NO: 18790
  Description of Artificial Sequence: Synthetic coding sequence

SEQ ID NO: 18792 - DNA, 267 bp, Artificial Sequence
  Description of Artificial Sequence: Synthetic coding sequence
atgtggctgtacctggccgccttcgtgggcctgtactacctgctgcactggtacagagagagacaggtggtgagccacctgcaggacaagtacgtgttcatcaccggctgcgacagcggcttcggcaacctgctggccagacagctggacgccagaggcctgagagtgctggccgcctgcctgaccgagaagggcgccgagcagctgagaggccagaccagcgacagactggagaccgtgaccctggacgtgaccaagatggagtag

SEQ ID NO: 18793 - DNA, 954 bp, Artificial Sequence; identical to SEQ ID NO: 18790
  Description of Artificial Sequence: Synthetic coding sequence

SEQ ID NO: 18794 - DNA, 954 bp, Artificial Sequence; identical to SEQ ID NO: 18790
  Description of Artificial Sequence: Synthetic coding sequence

SEQ ID NO: 18795 - DNA, 954 bp, Artificial Sequence; identical to SEQ ID NO: 18790
  Description of Artificial Sequence: Synthetic coding sequence

SEQ ID NO: 18796 - DNA, 228 bp, Artificial Sequence
  Description of Artificial Sequence: Synthetic coding sequence
atgtggctgtacctggccgccttcgtgggcctgtactacctgctgcactggtacagagagagacaggtggtgagccacctgcaggacaagtacgtgttcatcaccggctgcgacagcggcttcggcaacctgctggccagacagctggacgccagaggcctgagagtgctggccgcctgcctgaccgagaagggcgccgagcagctgagaggccagaccagcgactag

SEQ ID NO: 18797 - DNA, 897 bp, Artificial Sequence
  Description of Artificial Sequence: Synthetic coding sequence
atggtgacccccgccctgcagatgaagaagcccaagcagttctgcagaagaatgggccagaagaagcagagacccgccagagccggccagccccacagcagcagcgacgccgcccaggcccccgccgagcagccccacagcagcagcgacgccgcccaggccccctgccccagagagagatgcctgggcccccccaccacccccggcccctacagaagcatctacttcagcagccccaagggccacctgaccagactgggcctggagttcttcgaccagcccgccgtgcccctggccagagccttcctgggccaggtgctggtgagaagactgcccaacggcaccgagctgagaggcagaatcgtggagaccgaggcctacctgggccccgaggacgaggccgcccacagcagaggcggcagacagacccccagaaacagaggcatgttcatgaagcccggcaccctgtacgtgtacatcatctacggcatgtacttctgcatgaacatcagcagccagggcgacggcgcctgcgtgctgctgagagccctggagcccctggagggcctggagaccatgagacagctgagaagcaccctgagaaagggcaccgccagcagagtgctgaaggacagagagctgtgcagcggccccagcaagctgtgccaggccctggccatcaacaagagcttcgaccagagagacctggcccaggacgaggccgtgtggctggagagaggccccctggagcccagcgagcccgccgtggtggccgccgccagagtgggcgtgggccacgccggcgagtgggccagaaagcccctgagattctacgtgagaggcagcccctgggtgagcgtggtggacagagtggccgagcaggacacccaggcctag

SEQ ID NO: 18798 - DNA, 828 bp, Artificial Sequence
  Description of Artificial Sequence: Synthetic coding sequence
atggccgccgtggacagcttctacctgctgtacagagagatcgccagaagctgcaactgctacatggaggccctggccctggtgggcgcctggtacaccgccagaaagagcatcaccgtgatctgcgacttctacagcctgatcagactgcacttcatccccagactgggcagcagagccgacctgatcaagcagtacggcagatgggccgtggtgagcggcgccaccgacggcatcggcaaggcctacgccgaggagctggccagcagaggcctgaacatcatcctgatcagcagaaacgaggagaagctgcagtacttcacccagctgagcgaggacaagctgtgggacatcatcaacgtgaacatcgccgccgccagcctgatggtgcacgtggtgctgcccggcatggtggagagaaagaagggcgccatcgtgaccatcagcagcggcagctgctgcaagcccaccccccagctggccgccttcagcgccagcaaggcctacctggaccacttcagcagagccctgcagtacgagtacgccagcaagggcatcttcgtgcagagcctgatccccttctacgtggccaccagcatgaccgcccccagcaacttcctgcacagatgcagctggctggtgcccagccccaaggtgtacgcccaccacgccgtgagcaccctgggcatcagcaagagaaccaccggctactggagccacagcatccagttcctgttcgcccagtacatgcccgagtggctgtgggtgtggggcgccaacatcctgaacagaagcctgagaaaggaggccctgagctgcaccgcctag

SEQ ID NO: 18799 - DNA, 2673 bp, Artificial Sequence
  Description of Artificial Sequence: Synthetic coding sequence
atggagggcggcggcaagcccaacagcagcagcaacagcagagacgacggcaacagcgtgttccccgccaaggccagcgccaccggcgccggccccgccgccgccgagaagagactgggcaccccccccggcggcggcggcgccggcgccaaggagcacggcaacagcgtgtgcttcaaggtggacggcggcggcggcggcggcggcggcggcggcggcggcgaggagcccgccggcggcttcgaggacgccgagggccccagaagacagtacggcttcatgcagagacagttcaccagcatgctgcagcccggcgtgaacaagttcagcctgagaatgttcggcagccagaaggccgtggagaaggagcaggagagagtgaagaccgccggcttctggatcatccacccctacagcgacttcagattctactgggacctgatcatgctgatcatgatggtgggcaacctggtgatcatccccgtgggcatcaccttcttcaccgagcagaccaccaccccctggatcatcttcaacgtggccagcgacaccgtgttcctgctggacctgatcatgaacttcagaaccggcaccgtgaacgaggacagcagcgagatcatcctggaccccaaggtgatcaagatgaactacctgaagagctggttcgtggtggacttcatcagcagcatccccgtggactacatcttcctgatcgtggagaagggcatggacagcgaggtgtacaagaccgccagagccctgagaatcgtgagattcaccaagatcctgagcctgctgagactgctgagactgagcagactgatcagatacatccaccagtgggaggagatcttccacatgacctacgacctggccagcgccgtggtgagaatcttcaacctgatcggcatgatgctgctgctgtgccactgggacggctgcctgcagttcctggtgcccctgctgcaggacttcccccccgactgctgggtgagcctgaacgagatggtgaacgacagctggggcaagcagtacagctacgccctgttcaaggccatgagccacatgctgtgcatcggctacggcgcccaggcccccgtgagcatgagcgacctgtggatcaccatgctgagcatgatcgtgggcgccacctgctacgccatgttcgtgggccacgccaccgccctgatccagagcctggacagcagcagaagacagtaccaggagaagtacaagcaggtggagcagtacatgagcttccacaagctgcccgccgacatgagacagaagatccacgactactacgagcacagataccagggcaagatcttcgacgaggagaacatcctgaacgagctgaacgaccccctgagagaggagatcgtgaacttcaactgcagaaagctggtggccaccatgcccctgttcgccaacgccgaccccaacttcgtgaccgccatgctgagcaagctgagattcgaggtgttccagcccggcgactacatcatcagagagggcgccgtgggcaagaagatgtacttcatccagcacggcgtggccggcgtgatcaccaagagcagcaaggagatgaagctgaccgacggcagctacttcggcgagatctgcctgctgaccaagggcagaagaaccgccagcgtgagagccgacacctactgcagactgtacagcctgagcgtggacaacttcaacgaggtgctggaggagtaccccatgatgagaagagccttcgagaccgtggccatcgacagactggacagaatcggcaagaagaacagcatcctgctgcagaagttccagaaggacctgaacaccggcgtgttcaacaaccaggagaacgagatcctgaagcagatcgtgaagcacgacagagagatggtgcaggccatcgcccccatcaactacccccagatgaccaccctgaacagcaccagcagcaccaccacccccaccagcagaatgagaacccagagcccccccgtgtacaccgccaccagcctgagccacagcaacctgcacagccccagccccagcacccagaccccccagcccagcgccatcctgagcccctgcagctacaccaccgccgtgtgcagcccccccgtgcagagccccctggccgccagaaccttccactacgccagccccaccgccagccagctgagcctgatgcagcagcagccccagcagcaggtgcagcagagccagcccccccagacccagccccagcagcccagcccccagccccagacccccggcagcagcacccccaagaacgaggtgcacaagagcacccaggccctgcacaacaccaacctgaccagagaggtgagacccctgagcgccagccagcccagcctgccccacgaggtgagcaccctgatcagcagaccccaccccaccgtgggcgagagcctggccagcatcccccagcccgtgaccgccgtgcccggcaccggcctgcaggccggcggcagaagcaccgtgccccagagagtgaccctgttcagacagatgagcagcggcgccatcccccccaacagaggcgtgccccccgccccccccccccccgccgccgccctgcccagagagagcagcagcgtgctgaacaccgaccccgacgccgagaagcccagattcgccagcaacctgtag

SEQ ID NO: 18800 - DNA, 1170 bp, Artificial Sequence
  Description of Artificial Sequence: Synthetic coding sequence
atggagcccagcgccacccccggcgcccagatgggcgtgccccccggcagcagagagcccagccccgtgccccccgactacgaggacgagttcctgagatacctgtggagagactacctgtaccccaagcagtacgagtgggtgctgatcgccgcctacgtggccgtgttcgtggtggccctggtgggcaacaccctggtgtgcctggccgtgtggagaaaccaccacatgagaaccgtgaccaactacttcatcgtgaacctgagcctggccgacgtgctggtgaccgccatctgcctgcccgccagcctgctggtggacatcaccgagagctggctgttcggccacgccctgtgcaaggtgatcccctacctgcaggccgtgagcgtgagcgtggccgtgctgaccctgagcttcatcgccctggacagatggtacgccatctgccaccccctgctgttcaagagcaccgccagaagagccagaggcagcatcctgggcatctgggccgtgagcctggccatcatggtgccccaggccgccgtgatggagtgcagcagcgtgctgcccgagctggccaacagaaccagactgttcagcgtgtgcgacgagagatgggccgacgacctgtaccccaagatctaccacagctgcttcttcatcgtgacctacctggcccccctgggcctgatggccatggcctacttccagatcttcagaaagctgtggggcagacagatccccggcaccaccagcgccctggtgagaaactggaagagacccagcgaccagctgggcgacctggagcagggcctgagcggcgagccccagcccagagccagagccttcctggccgaggtgaagcagatgagagccagaagaaagaccgccaagatgctgatggtggtgctgctggtgttcgccctgtgctacctgcccatcagcgtgctgaacgtgctgaagagagtgttcggcatgttcagacaggccagcgacagagaggccgtgtacgcctgcttcaccttcagccactggctggtgtacgccaacagcgccgccaaccccatcatctacaacttcctgagcggctgcaaggagaagagcctggccctgagctgccccagctgccccggccacgacccccacctggccgccgccctgtgcagctag

SEQ ID NO: 18801 - DNA, 1278 bp, Artificial Sequence
  Description of Artificial Sequence: Synthetic coding sequence
atggagcccagcgccacccccggcgcccagatgggcgtgccccccggcagcagagagcccagccccgtgccccccgactacgaggacgagttcctgagatacctgtggagagactacctgtaccccaagcagtacgagtgggtgctgatcgccgcctacgtggccgtgttcgtggtggccctggtgggcaacaccctggtgtgcctggccgtgtggagaaaccaccacatgagaaccgtgaccaactacttcatcgtgaacctgagcctggccgacgtgctggtgaccgccatctgcctgcccgccagcctgctggtggacatcaccgagagctggctgttcggccacgccctgtgcaaggtgatcccctacctgcaggccgtgagcgtgagcgtggccgtgctgaccctgagcttcatcgccctggacagatggtacgccatctgccaccccctgctgttcaagagcaccgccagaagagccagaggcagcatcctgggcatctgggccgtgagcctggccatcatggtgccccaggccgccgtgatggagtgcagcagcgtgctgcccgagctggccaacagaaccagactgttcagcgtgtgcgacgagagatgggccgacgacctgtaccccaagatctaccacagctgcttcttcatcgtgacctacctggcccccctgggcctgatggccatggcctacttccagatcttcagaaagctgtggggcagacagatccccggcaccaccagcgccctggtgagaaactggaagagacccagcgaccagctgggcgacctggagcagggcctgagcggcgagccccagcccagagccagagccttcctggccgaggtgaagcagatgagagccagaagaaagaccgccaagatgctgatggtggtgctgctggtgttcgccctgtgctacctgcccatcagcgtgctgaacgtgctgaagagagtgttcggcatgttcagacaggccagcgacagagaggccgtgtacgcctgcttcaccttcagccactggctggtgtacgccaacagcgccgccaaccccatcatctacaacttcctgagcggcaagttcagagagcagttcaaggccgccttcagctgctgcctgcccggcctgggcccctgcggcagcctgaaggcccccagccccagaagcagcgccagccacaagagcctgagcctgcagagcagatgcagcatcagcaagatcagcgagcacgtggtgctgaccagcgtgaccaccgtgctgccctag

SEQ ID NO: 18802 - DNA, 1278 bp, Artificial Sequence; identical to SEQ ID NO: 18801
  Description of Artificial Sequence: Synthetic coding sequence

SEQ ID NO: 18803 - DNA, 1335 bp, Artificial Sequence
  Description of Artificial Sequence: Synthetic coding sequence
atgagcggcaccaagctggaggacagccccccctgcagaaactggagcagcgccagcgagctgaacgagacccaggagcccttcctgaaccccaccgactacgacgacgaggagttcctgagatacctgtggagagagtacctgcaccccaaggagtacgagtgggtgctgatcgccggctacatcatcgtgttcgtggtggccctgatcggcaacgtgctggtgtgcgtggccgtgtggaagaaccaccacatgagaaccgtgaccaactacttcatcgtgaacctgagcctggccgacgtgctggtgaccatcacctgcctgcccgccaccctggtggtggacatcaccgagacctggttcttcggccagagcctgtgcaaggtgatcccctacctgcagaccgtgagcgtgagcgtgagcgtgctgaccctgagctgcatcgccctggacagatggtacgccatctgccaccccctgatgttcaagagcaccgccaagagagccagaaacagcatcgtgatcatctggatcgtgagctgcatcatcatgatcccccaggccatcgtgatggagtgcagcaccgtgttccccggcctggccaacaagaccaccctgttcaccgtgtgcgacgagagatggggcggcgagatctaccccaagatgtaccacatctgcttcttcctggtgacctacatggcccccctgtgcctgatggtgctggcctacctgcagatcttcagaaagctgtggtgcagacagatccccggcaccagcagcgtggtgcagagaaagtggaagcccctgcagcccgtgagccagcccagaggccccggccagcccaccaagagcagaatgagcgccgtggccgccgagatcaagcagatcagagccagaagaaagaccgccagaatgctgatgatcgtgctgctggtgttcgccatctgctacctgcccatcagcatcctgaacgtgctgaagagagtgttcggcatgttcgcccacaccgaggacagagagaccgtgtacgcctggttcaccttcagccactggctggtgtacgccaacagcgccgccaaccccatcatctacaacttcctgagcggcaagttcagagaggagttcaaggccgccttcagctgctgctgcctgggcgtgcaccacagacaggaggacagactgaccagaggcagaaccagcaccgagagcagaaagagcctgaccacccagatcagcaacttcgacaacatcagcaagctgagcgagcaggtggtgctgaccagcatcagcaccctgcccgccgccaacggcgccggccccctgcagaactggtag

SEQ ID NO: 18804 - DNA, 1134 bp, Artificial Sequence
  Description of Artificial Sequence: Synthetic coding sequence
atgagcgaggtgaagagcagaaagaagagcggccccaagggcgcccccgccgccgagcccggcaagagaagcgagggcggcaagacccccgtggccagaagcagcggcggcggcggctgggccgaccccagaacctgcctgagcctgctgagcctgggcacctgcctgggcctggcctggttcgtgttccagcagagcgagaagttcgccaaggtggagaaccagtaccagctgctgaagctggagaccaacgagttccagcagctgcagagcaagatcagcctgatcagcgagaagctggagagcaccgagagcatcctgcaggaggccaccagcagcatgagcctgatgacccagttcgagcaggaggtgagcaacctgcaggacatcatgcacgacatccagaacaacgaggaggtgctgacccagagaatgcagagcctgaacgagaagttccagaacatcaccgacttctggaagagaagcctggaggagatgaacatcaacaccgacatcttcaagagcgaggccaagcacatccacagccaggtgaccgtgcagatcaacagcgccgagcaggagatcaagctgctgaccgagagactgaaggacctggaggacagcaccctgagaaacatcagaaccgtgaagagacaggaggaggaggacctgctgagagtggaggagcagctgggcagcgacaccaaggccatcgagaagctggaggaggagcagcacgccctgttcgccagagacgaggacctgaccaacaagctgagcgactacgagcccaaggtggaggagtgcaagacccacctgcccaccatcgagagcgccatccacagcgtgctgagagtgagccaggacctgatcgagaccgagaagaagatggaggacctgaccatgcagatgttcaacatggaggacgacatgctgaaggccgtgagcgagatcatggagatgcagaagaccctggagggcatccagtacgacaacagcatcctgaagatgcagaacgagctggacatcctgaaggagaaggtgcacgacttcatcgcctacagcagcaccggcgagaagggcaccctgaaggagtacaacatcgagaacaagggcatcggcggcgacttctag

SEQ ID NO: 18805 - DNA, 1053 bp, Artificial Sequence
  Description of Artificial Sequence: Synthetic coding sequence
atgagcgaggtgaagagcagaaagaagagcggccccaagggcgcccccgccgccgagcccggcaagagaagcgagggcggcaagacccccgtggccagaagcagcggcggcggcggctgggccgaccccagaacctgcctgagcctgctgagcctgggcacctgcctgggcctggcctggttcgtgttccagcagagcgagaagttcgccaaggtggagaaccagtaccagctgctgaagctggagaccaacgagttccagcagctgcagagcaagatcagcctgatcagcgagaagtggcagaagagcgaggccatcatggagcagctgaagagcttccagatcatcgcccacctgaagagactgcaggaggagatcaacgaggtgaagacctggagcaacagaatcaccgagaagcaggacatcctgaacaacagcctgaccaccctgagccaggacatcaccaaggtggaccagagcaccaccagcatggccaaggacgtgggcctgaagatcaccagcgtgaagaccgacatcagaagaatcagcggcctggtgaccgacgtgatcagcctgaccgacagcgtgcaggagctggagaacaagatcgagaaggtggagaagaacaccgtgaagaacatcggcgacctgctgagcagcagcatcgacagaaccgccaccctgagaaagaccgccagcgagaacagccagagaatcaacagcgtgaagaagaccctgaccgagctgaagagcgacttcgacaagcacaccgacagattcctgagcctggagggcgacagagccaaggtgctgaagaccgtgaccttcgccaacgacctgaagcccaaggtgtacaacctgaagaaggacttcagcagactggagcccctggtgaacgacctgaccctgagaatcggcagactggtgaccgacctgctgcagagagagaaggagatcgccttcctgagcgagaagatcagcaacctgaccatcgtgcaggccgagatcaaggacatcaaggacgagatcgcccacatcagcgacatgaactag

SEQ ID NO: 18806 - DNA, 213 bp, Artificial Sequence
  Description of Artificial Sequence: Synthetic coding sequence
atgagcgaggtgaagagcagaaagaagagcggccccaagggcgcccccgccgccgagcccggcaagagaagcgagggcggcaagacccccgtggccagaagcagcggcggcggcggctgggccgaccccagaacctgcctgagcctgctgagcctgggcacctgcctgggcctggcctgcggcagaaacctgaagctgagctggaacaactag

SEQ ID NO: 18807 - DNA, 735 bp, Artificial Sequence
  Description of Artificial Sequence: Synthetic coding sequence
atggagcagctgaagagcttccagatcatcgcccacctgaagagactgcaggaggagatcaacgaggtgaagacctggagcaacagaatcaccgagaagcaggacatcctgaacaacagcctgaccaccctgagccaggacatcaccaaggtggaccagagcaccaccagcatggccaaggacgtgggcctgaagatcaccagcgtgaagaccgacatcagaagaatcagcggcctggtgaccgacgtgatcagcctgaccgacagcgtgcaggagctggagaacaagatcgagaaggtggagaagaacaccgtgaagaacatcggcgacctgctgagcagcagcatcgacagaaccgccaccctgagaaagaccgccagcgagaacagccagagaatcaacagcgtgaagaagaccctgaccgagctgaagagcgacttcgacaagcacaccgacagattcctgagcctggagggcgacagagccaaggtgctgaagaccgtgaccttcgccaacgacctgaagcccaaggtgtacaacctgaagaaggacttcagcagactggagcccctggtgaacgacctgaccctgagaatcggcagactggtgaccgacctgctgcagagagagaaggagatcgccttcctgagcgagaagatcagcaacctgaccatcgtgcaggccgagatcaaggacatcaaggacgagatcgcccacatcagcgacatgaactag

SEQ ID NO: 18808 - DNA, 2445 bp, Artificial Sequence
  Description of Artificial Sequence: Synthetic coding sequence
atggccgtgcagagagccgccagccccagaagaccccccgcccccctgtggcccagactgctgctgcccctgctgctgctgctgctgcccgcccccagcgagggcctgggccacagcgccgagctggccttcgccgtggagcccagcgacgacgtggccgtgcccggccagcccatcgtgctggactgcagagtggagggcaccccccccgtgagaatcacctggagaaagaacggcgtggagctgcccgagagcacccacagcaccctgctggccaacggcagcctgatgatcagacacttcagactggagcccggcggcagccccagcgacgagggcgactacgagtgcgtggcccagaacagattcggcctggtggtgagcagaaaggccagaatccaggccgccaccatgagcgacttccacgtgcacccccaggccaccgtgggcgaggagggcggcgtggccagattccagtgccagatccacggcctgcccaagcccctgatcacctgggagaagaacagagtgcccatcgacaccgacaacgagagatacaccctgctgcccaagggcgtgctgcagatcaccggcctgagagccgaggacggcggcatcttccactgcgtggccagcaacatcgccagcatcagaatcagccacggcgccagactgaccgtgagcggcagcggcagcggcgcctacaaggagcccgccatcctggtgggccccgagaacctgaccctgaccgtgcaccagaccgccgtgctggagtgcgtggccaccggcaaccccagacccatcgtgagctggagcagactggacggcagacccatcggcgtggagggcatccaggtgctgggcaccggcaacctgatcatcagcgacgtgaccgtgcagcacagcggcgtgtacgtgtgcgccgccaacagacccggcaccagagtgagaagaaccgcccagggcagactggtggtgcaggcccccgccgagttcgtgcagcacccccagagcatcagcagacccgccggcaccaccgccatgttcacctgccaggcccagggcgagccccccccccacgtgacctggctgaagaacggccaggtgctgggccccggcggccacgtgagactgaagaacaacaacagcaccctgaccatcagcggcatcggccccgaggacgaggccatctaccagtgcgtggccgagaacagcgccggcagcagccaggccagcgccagactgaccgtgctgtgggccgagggcctgcccggcccccccagaaacgtgagagccgtgagcgtgagcagcaccgaggtgagagtgagctggagcgagcccctggccaacaccaaggagatcatcggctacgtgctgcacatcagaaaggccgccgacccccccgagctggagtaccaggaggccgtgagcaagagcaccttccagcacctggtgagcgacctggagcccagcaccgcctacagcttctacatcaaggcctacacccccagaggcgccagcagcgccagcgtgcccaccctggccagcaccctgggcgaggcccccgcccccccccccctgagcgtgagagtgctgggcagcagcagcctgcagctgctgtgggagccctggcccagactggcccagcacgagggcggcttcaagctgttctacagacccgccagcaagaccagcttcaccggccccatcctgctgcccggcaccgtgagcagctacaacctgagccagctggaccccaccgccgtgtacgaggtgaagctgctggcctacaaccagcacggcgacggcaacgccaccgtgagattcgtgagcctgagaggcgccagcgagagaaccgccctgagccccccctgcgactgcagaaaggaggaggccgccaaccagaccagcaccaccggcatcgtgatcggcatccacatcggcgtgacctgcatcatcttctgcgtgctgttcctgctgttcggccagagaggcagagtgctgctgtgcaaggacgtggagaaccagctgagccccccccagggccccagaagccagagagaccccggcatcctggccctgaacggcgccagaagaggccagagaggccagctgggcagagacgagaagagagtggacatgaaggagctggagcagctgttcccccccgccagcgccgccggccagcccgaccccagacccacccaggaccccgccgcccccgccccctgcgaggagacccagctgagcgtgctgcccctgcagggctgcggcctgatggagggcaagaccaccgaggccaagaccaccgaggccaccgccccctgcgccggcctggccgccgccccccccccccccgacggcggccccggcctgctgagcgagggccaggccagcagacccgccgccgccagagtgacccagcccgcccacagcgagcagtag

SEQ ID NO: 18809 - DNA, 1914 bp, Artificial Sequence
  Description of Artificial Sequence: Synthetic coding sequence
atgagcgacttccacgtgcacccccaggccaccgtgggcgaggagggcggcgtggccagattccagtgccagatccacggcctgcccaagcccctgatcacctgggagaagaacagagtgcccatcgacaccgacaacgagagatacaccctgctgcccaagggcgtgctgcagatcaccggcctgagagccgaggacggcggcatcttccactgcgtggccagcaacatcgccagcatcagaatcagccacggcgccagactgaccgtgagcggcagcggcagcggcgcctacaaggagcccgccatcctggtgggccccgagaacctgaccctgaccgtgcaccagaccgccgtgctggagtgcgtggccaccggcaaccccagacccatcgtgagctggagcagactggacggcagacccatcggcgtggagggcatccaggtgctgggcaccggcaacctgatcatcagcgacgtgaccgtgcagcacagcggcgtgtacgtgtgcgccgccaacagacccggcaccagagtgagaagaaccgcccagggcagactggtggtgcaggcccccgccgagttcgtgcagcacccccagagcatcagcagacccgccggcaccaccgccatgttcacctgccaggcccagggcgagccccccccccacgtgacctggctgaagaacggccaggtgctgggccccggcggccacgtgagactgaagaacaacaacagcaccctgaccatcagcggcatcggccccgaggacgaggccatctaccagtgcgtggccgagaacagcgccggcagcagccaggccagcgccagactgaccgtgctgtgggccgagggcctgcccggcccccccagaaacgtgagagccgtgagcgtgagcagcaccgaggtgagagtgagctggagcgagcccctggccaacaccaaggagatcatcggctacgtgctgcacatcagaaaggccgccgacccccccgagctggagtaccaggaggccgtgagcaagagcaccttccagcacctggtgagcgacctggagcccagcaccgcctacagcttctacatcaaggcctacacccccagaggcgccagcagcgccagcgtgcccaccctggccagcaccctgggcgaggcccccgcccccccccccctgagcgtgagagtgctgggcagcagcagcctgcagctgctgtgggagccctggcccagactggcccagcacgagggcggcttcaagctgttctacagacccgccagcaagaccagcttcaccggccccatcctgctgcccggcaccgtgagcagctacaacctgagccagctggaccccaccgccgtgtacgaggtgaagctgctggcctacaaccagcacggcgacggcaacgccaccgtgagattcgtgagcctgagaggcgccagcgagagaaccgccctgagccccccctgcgactgcagaaaggaggaggccgccaaccagaccagcaccaccggcatcgtgatcggcatccacatcggcgtgacctgcatcatcttctgcgtgctgttcctgctgttcggccagagaggcagagtgctgctgtgcaaggacgtggacatgaaggagctggagcagctgttcccccccgccagcgccgccggccagcccgaccccagacccaccgaccccgccgcccccgccccctgcgaggagacccagctgagcgtgctgcccctgcagggctgcggcctgatggagggcaagaccaccgaggccaagaccaccgaggccaccgccccctgcgccggcctggccgccgccccccccccccccgacggcggccccggcctgctgagcgagggccaggccagcagacccgccgccgccagagtgacccagcccgcccacagcgagcagtag

SEQ ID NO: 18810 - DNA, 3753 bp, Artificial Sequence
  Description of Artificial Sequence: Synthetic coding sequence
atggccagaggcgacgccggcagaggcagaggcctgctggccctgaccttctgcctgctggccgccagaggcgagctgctgctgccccaggagaccaccgtggagctgagctgcggcgtgggccccctgcaggtgatcctgggccccgagcaggccgccgtgctgaactgcagcctgggcgccgccgccgccggcccccccaccagagtgacctggagcaaggacggcgacaccctgctggagcacgaccacctgcacctgctgcccaacggcagcctgtggctgagccagcccctggcccccaacggcagcgacgagagcgtgcccgaggccgtgggcgtgatcgagggcaactacagctgcctggcccacggccccctgggcgtgctggccagccagaccgccgtggtgaagctggccaccctggccgacttcagcctgcaccccgagagccagaccgtggaggagaacggcaccgccagattcgagtgccacatcgagggcctgcccgcccccatcatcacctgggagaaggaccaggtgaccctgcccgaggagcccagactgatcgtgctgcccaacggcgtgctgcagatcctggacgtgcaggagagcgacgccggcccctacagatgcgtggccaccaacagcgccagacagcacttcagccaggaggccctgctgagcgtggcccacagaggcagcctggccagcaccagaggccaggacgtggtgatcgtggccgcccccgagaacaccaccgtggtgagcggccagagcgtggtgatggagtgcgtggccagcgccgaccccacccccttcgtgagctgggtgagacaggacggcaagcccatcagcaccgacgtgatcgtgctgggcagaaccaacctgctgatcgccaacgcccagccctggcacagcggcgtgtacgtgtgcagagccaacaagcccagaaccagagacttcgccaccgccgccgccgagctgagagtgctggccgcccccgccatcacccaggcccccgaggccctgagcagaaccagagccagcaccgccagattcgtgtgcagagccagcggcgagcccagacccgccctgagatggctgcacaacggcgcccccctgagacccaacggcagagtgaaggtgcagggcggcggcggcagcctggtgatcacccagatcggcctgcaggacgccggctactaccagtgcgtggccgagaacagcgccggcatggcctgcgccgccgccagcctggccgtggtggtgagagagggcctgcccagcgcccccaccagagtgaccgccacccccctgagcagcagcgccgtgctggtggcctgggagagacccgagatgcacagcgagcagatcatcggcttcagcctgcactaccagaaggccagaggcatggacaacgtggagtaccagttcgccgtgaacaacgacaccaccgagctgcaggtgagagacctggagcccaacaccgactacgagttctacgtggtggcctacagccagctgggcgccagcagaaccagcacccccgccctggtgcacaccctggacgacgtgcccagcgccgccccccagctgagcctgagcagccccaaccccagcgacatcagagtggcctggctgcccctgccccccagcctgagcaacggccaggtggtgaagtacaagatcgagtacggcctgggcaaggaggaccagatcttcagcaccgaggtgagaggcaacgagacccagctgatgctgaacagcctgcagcccaacaaggtgtacagagtgagaatcagcgccggcaccgccgccggcttcggcgcccccagccagtggatgcaccacagaacccccagcatgcacaaccagagccacgtgcccttcgcccccgccgagctgaaggtgcaggccaagatggagagcctggtggtgagctggcagccccccccccaccccacccagatcagcggctacaagctgtactggagagaggtgggcgccgaggaggaggccaacggcgacagactgcccggcggcagaggcgaccaggcctgggacgtgggccccgtgagactgaagaagaaggtgaagcagtacgagctgacccagctggtgcccggcagactgtacgaggtgaagctggtggccttcaacaagcacgaggacggctacgccgccgtgtggaagggcaagaccgagaaggcccccgcccccgacatgcccatccagagaggcccccccctgccccccgcccacgtgcacgccgagagcaacagcagcaccagcatctggctgagatggaagaagcccgacttcaccaccgtgaagatcgtgaactacaccgtgagattcagcccctggggcctgagaaacgccagcctggtgacctactacaccagcagcggcgaggacatcctgatcggcggcctgaagcccttcaccaagtacgagttcgccgtgcagagccacggcgtggacatggacggccccttcggcagcgtggtggagagaagcaccctgcccgacagacccagcaccccccccagcgacctgagactgagccccctgacccccagcaccgtgagactgcactggtgcccccccaccgagcccaacggcgagatcgtggagtacctgatcctgtacagcagcaaccacacccagcccgagcaccagtggaccctgctgaccacccagggcaacatcttcagcgccgaggtgcacggcctggagagcgacaccagatacttcttcaagatgggcgccagaaccgaggtgggccccggccccttcagcagactgcaggacgtgatcaccctgcaggagaagctgagcgacagcctggacatgcacagcgtgaccggcatcatcgtgggcgtgtgcctgggcctgctgtgcctgctggcctgcatgtgcgccggcctgagaagaagcccccacagagagagcctgcccggcctgagcagcaccgccacccccggcaaccccgccctgtacagcagagccagactgggcccccccagcccccccgccgcccacgagctggagagcctggtgcacccccacccccaggactggagccccccccccagcgacgtggaggacagagccgaggtgcacagcctgatgggcggcggcgtgagcgagggcagaagccacagcaagagaaagatcagctgggcccagcccagcggcctgagctgggccggcagctgggccggctgcgagctgccccaggccggccccagacccgccctgaccagagccctgctgccccccgccggcaccggccagaccctgctgctgcaggccctggtgtacgacgccatcaagggcaacggcagaaagaagagcccccccgcctgcagaaaccaggtggaggccgaggtgatcgtgcacagcgacttcagcgccagcaacggcaaccccgacctgcacctgcaggacctggagcccgaggaccccctgccccccgaggcccccgacctgatcagcggcgtgggcgaccccggccagggcgccgcctggctggacagagagctgggcggctgcgagctggccgcccccggccccgacagactgacctgcctgcccgaggccgccagcgccagctgcagctaccccgacctgcagcccggcgaggtgctggaggagacccccggcgacagctgccagctgaagagcccctgccccctgggcgccagccccggcctgcccagaagccccgtgagcagcagcgcctag

SEQ ID NO: 18811 - DNA, 2940 bp, Artificial Sequence
  Description of Artificial Sequence: Synthetic coding sequence
atgggcagaagaaagggcagaagcgccctgagcagaagcagcctggagagagtgaaccagggcgaggtgaaggtgatcggcagaggcgccagagagggcggcggcggccaggcctggggcaccggcggcggcagagacctgagctgcggcatccccagaagcgccagccccctggcccccctggccgcccccgccatcacccaggcccccgaggccctgagcagaaccagagccagcaccgccagattcgtgtgcagagccagcggcgagcccagacccgccctgagatggctgcacaacggcgcccccctgagacccaacggcagagtgaaggtgcagggcggcggcggcagcctggtgatcacccagatcggcctgcaggacgccggctactaccagtgcgtggccgagaacagcgccggcatggcctgcgccgccgccagcctggccgtggtggtgagagagggcctgcccagcgcccccaccagagtgaccgccacccccctgagcagcagcgccgtgctggtggcctgggagagacccgagatgcacagcgagcagatcatcggcttcagcctgcactaccagaaggccagaggcatggacaacgtggagtaccagttcgccgtgaacaacgacaccaccgagctgcaggtgagagacctggagcccaacaccgactacgagttctacgtggtggcctacagccagctgggcgccagcagaaccagcacccccgccctggtgcacaccctggacgacgtgcccagcgccgccccccagctgagcctgagcagccccaaccccagcgacatcagagtggcctggctgcccctgccccccagcctgagcaacggccaggtggtgaagtacaagatcgagtacggcctgggcaaggaggaccagatcttcagcaccgaggtgagaggcaacgagacccagctgatgctgaacagcctgcagcccaacaaggtgtacagagtgagaatcagcgccggcaccgccgccggcttcggcgcccccagccagtggatgcaccacagaacccccagcatgcacaaccagagccacgtgcccttcgcccccgccgagctgaaggtgcaggccaagatggagagcctggtggtgagctggcagccccccccccaccccacccagatcagcggctacaagctgtactggagagaggtgggcgccgaggaggaggccaacggcgacagactgcccggcggcagaggcgaccaggcctgggacgtgggccccgtgagactgaagaagaaggtgaagcagtacgagctgacccagctggtgcccggcagactgtacgaggtgaagctggtggccttcaacaagcacgaggacggctacgccgccgtgtggaagggcaagaccgagaaggcccccgcccccgacatgcccatccagagaggcccccccctgccccccgcccacgtgcacgccgagagcaacagcagcaccagcatctggctgagatggaagaagcccgacttcaccaccgtgaagatcgtgaactacaccgtgagattcagcccctggggcctgagaaacgccagcctggtgacctactacaccagcagcggcgaggacatcctgatcggcggcctgaagcccttcaccaagtacgagttcgccgtgcagagccacggcgtggacatggacggccccttcggcagcgtggtggagagaagcaccctgcccgacagacccagcaccccccccagcgacctgagactgagccccctgacccccagcaccgtgagactgcactggtgcccccccaccgagcccaacggcgagatcgtggagtacctgatcctgtacagcagcaaccacacccagcccgagcaccagtggaccctgctgaccacccagggcaacatcttcagcgccgaggtgcacggcctggagagcgacaccagatacttcttcaagatgggcgccagaaccgaggtgggccccggccccttcagcagactgcaggacgtgatcaccctgcaggagaagctgagcgacagcctggacatgcacagcgtgaccggcatcatcgtgggcgtgtgcctgggcctgctgtgcctgctggcctgcatgtgcgccggcctgagaagaagcccccacagagagagcctgcccggcctgagcagcaccgccacccccggcaaccccgccctgtacagcagagccagactgggcccccccagcccccccgccgcccacgagctggagagcctggtgcacccccacccccaggactggagccccccccccagcgacgtggaggacagagccgaggtgcacagcctgatgggcggcggcgtgagcgagggcagaagccacagcaagagaaagatcagctgggcccagcccagcggcctgagctgggccggcagctgggccggctgcgagctgccccaggccggccccagacccgccctgaccagagccctgctgccccccgccggcaccggccagaccctgctgctgcaggccctggtgtacgacgccatcaagggcaacggcagaaagaagagcccccccgcctgcagaaaccaggtggaggccgaggtgatcgtgcacagcgacttcagcgccagcaacggcaaccccgacctgcacctgcaggacctggagcccgaggaccccctgccccccgaggcccccgacctgatcagcggcgtgggcgaccccggccagggcgccgcctggctggacagagagctgggcggctgcgagctggccgcccccggccccgacagactgacctgcctgcccgaggccgccagcgccagctgcagctaccccgacctgcagcccggcgaggtgctggaggagacccccggcgacagctgccagctgaagagcccctgccccctgggcgccagccccggcctgcccagaagccccgtgagcagcagcgcctag

SEQ ID NO: 18812 - DNA, 1293 bp, Artificial Sequence
  Description of Artificial Sequence: Synthetic coding sequence
atgagcctggtggagctgctgctgtggtggaactgcttcagcagaaccggcgtggccgccagcctggaggtgagcgagagccccggcagcatccaggtggccagaggccagcccgccgtgctgccctgcaccttcaccaccagcgccgccctgatcaacctgaacgtgatctggatggtgacccccctgagcaacgccaaccagcccgagcaggtgatcctgtaccagggcggccagatgttcgacggcgcccccagattccacggcagagtgggcttcaccggcaccatgcccgccaccaacgtgagcatcttcatcaacaacacccagctgagcgacaccggcacctaccagtgcctggtgaacaacctgcccgacatcggcggcagaaacatcggcgtgaccggcctgaccgtgctggtgccccccagcgccccccactgccagatccagggcagccaggacatcggcagcgacgtgatcctgctgtgcagcagcgaggagggcatccccagacccacctacctgtgggagaagctggacaacaccctgaagctgccccccaccgccacccaggaccaggtgcagggcaccgtgaccatcagaaacatcagcgccctgagcagcggcctgtaccagtgcgtggccagcaacgccatcggcaccagcacctgcctgctggacctgcaggtgatcagcccccagcccagaaacatcggcctgatcgccggcgccatcggcaccggcgccgtgatcatcatcttctgcatcgccctgatcctgggcgccttcttctactggagaagcaagaacaaggaggaggaggaggaggagatccccaacgagatcagagaggacgacctgccccccaagtgcagcagcgccaaggccttccacaccgagatcagcagcagcgacaacaacaccctgaccagcagcaacgcctacaacagcagatactggagcaacaaccccaaggtgcacagaaacaccgagagcgtgagccacttcagcgacctgggccagagcttcagcttccacagcggcaacgccaacatccccagcatctacgccaacggcacccacctggtgcccggccagcacaagaccctggtggtgaccgccaacagaggcagcagcccccaggtgatgagcagaagcaacggcagcgtgagcagaaagcccagacccccccacacccacagctacaccatcagccacgccaccctggagagaatcggcgccgtgcccgtgatggtgcccgcccagagcagagccggcagcctggtgtag

SEQ ID NO: 18813 - DNA, 1296 bp, Artificial Sequence
  Description of Artificial Sequence: Synthetic coding sequence
atgaccagccagagaagccccctggcccccctgctgctgctgagcctgcacggcgtggccgccagcctggaggtgagcgagagccccggcagcatccaggtggccagaggccagcccgccgtgctgccctgcaccttcaccaccagcgccgccctgatcaacctgaacgtgatctggatggtgacccccctgagcaacgccaaccagcccgagcaggtgatcctgtaccagggcggccagatgttcgacggcgcccccagattccacggcagagtgggcttcaccggcaccatgcccgccaccaacgtgagcatcttcatcaacaacacccagctgagcgacaccggcacctaccagtgcctggtgaacaacctgcccgacatcggcggcagaaacatcggcgtgaccggcctgaccgtgctggtgccccccagcgccccccactgccagatccagggcagccaggacatcggcagcgacgtgatcctgctgtgcagcagcgaggagggcatccccagacccacctacctgtgggagaagctggacaacaccctgaagctgccccccaccgccacccaggaccaggtgcagggcaccgtgaccatcagaaacatcagcgccctgagcagcggcctgtaccagtgcgtggccagcaacgccatcggcaccagcacctgcctgctggacctgcaggtgatcagcccccagcccagaaacatcggcctgatcgccggcgccatcggcaccggcgccgtgatcatcatcttctgcatcgccctgatcctgggcgccttcttctactggagaagcaagaacaaggaggaggaggaggaggagatccccaacgagatcagagaggacgacctgccccccaagtgcagcagcgccaaggccttccacaccgagatcagcagcagcgacaacaacaccctgaccagcagcaacgcctacaacagcagatactggagcaacaaccccaaggtgcacagaaacaccgagagcgtgagccacttcagcgacctgggccagagcttcagcttccacagcggcaacgccaacatccccagcatctacgccaacggcacccacctggtgcccggccagcacaagaccctggtggtgaccgccaacagaggcagcagcccccaggtgatgagcagaagcaacggcagcgtgagcagaaagcccagacccccccacacccacagctacaccatcagccacgccaccctggagagaatcggcgccgtgcccgtgatggtgcccgcccagagcagagccggcagcctggtgtag

SEQ ID NO: 18814 - DNA, 1293 bp, Artificial Sequence; identical to SEQ ID NO: 18812
  Description of Artificial Sequence: Synthetic coding sequence

SEQ ID NO: 18815 - DNA, 579 bp, Artificial Sequence
  Description of Artificial Sequence: Synthetic coding sequence
atgagagccaagccccagagccccctgcccagaaaccccgtgcccgcctggagcccccccaccaccaccaccgaccccatgctggagaaggacgccgccggcggcgacttccccgccaacctggtgctgcagctgatgcccctgaagaccttccccgccgccatcagaggcgtgatccagagcgagctgaactacagcgtgatcctgcagtgggtggtgaccatggaccccgagcccgtgctgagctggaccttcagcggcgtgccctgcggcatgggcgagaagctgttcatcagaagactgagctgcgagcagctgggcacctacatgtgcatcgccaccaacagcaagaagcagctggtgagcgagcccgtgaccatcagcctgcccaagcccatcatgcagcccaccgaggccgagcccatggagcccgaccccaccctgagcctgagcggcggcagcgccatcggcctgctggccgccggcatcctgggcgccggcgccctgatcgccggcatgtgcttcatcatcatccagagcctgagaaccgacagacagagaatcggcatctgcagctag

SEQ ID NO: 18816 - DNA, 1224 bp, Artificial Sequence
  Description of Artificial Sequence: Synthetic coding sequence
atgggccagaaggagagaagcaccgccgacaccctgcccgacctggaggagtggaagagcgccgccggcctgagatggtggcagaccgccgtggtggacggcagcggcagcggcaacgaggtgatcgagggcccccagaacgccagagtgctgaagggcagccaggccagattcaactgcaccgtgagccagggctggaagctgatcatgtgggccctgagcgacatggtggtgctgagcgtgagacccatggagcccatcatcaccaacgacagattcaccagccagagatacgaccagggcggcaacttcaccagcgagatgatcatccacaacgtggagcccagcgacagcggcaacatcagatgcagcctgcagaacagcagactgcacggcagcgcctacctgaccgtgcaggtgatgggcgagctgttcatccccagcgtgaacctggtggtggccgagaacgagccctgcgaggtgacctgcctgcccagccactggaccagactgcccgacatcagctgggagctgggcctgctggtgagccacagcagctactacttcgtgcccgagcccagcgacctgcagagcgccgtgagcatcctggccctgaccccccagagcaacggcaccctgacctgcgtggccacctggaagagcctgaaggccagaaagagcgccaccgtgaacctgaccgtgatcagatgcccccaggacaccggcggcggcatcaacatccccggcgtgctgagcagcctgcccagcctgggcttcagcctgcccacctggggcaaggtgggcctgggcctggccggcaccatgctgctgacccccacctgcaccctgaccatcagatgctgctgctgcagaagaagatgctgcggctgcaactgctgctgcagatgctgcttctgctgcagaagaaagagaggcttcagaatccagttccagaagaagagcgagaaggagaagaccaacaaggagaccgagaccgagagcggcaacgagaacagcggctacaacagcgacgagcagaagaccaccgacaccgccagcctgccccccaagagctgcgagagcagcgaccccgagcagagaaacagcagctgcggccccccccaccagagagccgaccagagaccccccagacccgccagccacccccaggccagcttcaacctggccagccccgagaaggtgagcaacaccaccgtggtgtag

SEQ ID NO: 18817 - DNA, 1920 bp, Artificial Sequence
  Description of Artificial Sequence: Synthetic coding sequence
atggacagagtgctgctgagatggatcagcctgttctggctgaccgccatggtggagggcctgcaggtgaccgtgcccgacaagaagaaggtggccatgctgttccagcccaccgtgctgagatgccacttcagcaccagcagccaccagcccgccgtggtgcagtggaagttcaagagctactgccaggacagaatgggcgagagcctgggcatgagcagcaccagagcccagagcctgagcaagagaaacctggagtgggacccctacctggactgcctggacagcagaagaaccgtgagagtggtggccagcaagcagggcagcaccgtgaccctgggcgacttctacagaggcagagagatcaccatcgtgcacgacgccgacctgcagatcggcaagctgatgtggggcgacagcggcctgtactactgcatcatcaccacccccgacgacctggagggcaagaacgaggacagcgtggagctgctggtgctgggcagaaccggcctgctggccgacctgctgcccagcttcgccgtggagatcatgcccgagtgggtgttcgtgggcctggtgctgctgggcgtgttcctgttcttcgtgctggtgggcatctgctggtgccagtgctgcccccacagctgctgctgctacgtgagatgcccctgctgccccgacagctgctgctgcccccaggccctgtacgaggccggcaaggccgccaaggccggctacccccccagcgtgagcggcgtgcccggcccctacagcatccccagcgtgcccctgggcggcgcccccagcagcggcatgctgatggacaagccccaccccccccccctggcccccagcgacagcaccggcggcagccacagcgtgagaaagggctacagaatccaggccgacaaggagagagacagcatgaaggtgctgtactacgtggagaaggagctggcccagttcgaccccgccagaagaatgagaggcagatacaacaacaccatcagcgagctgagcagcctgcacgaggaggacagcaacttcagacagagcttccaccagatgagaagcaagcagttccccgtgagcggcgacctggagagcaaccccgactactggagcggcgtgatgggcggcagcagcggcgccagcagaggccccagcgccatggagtacaacaaggaggacagagagagcttcagacacagccagcccagaagcaagagcgagatgctgagcagaaagaacttcgccaccggcgtgcccgccgtgagcatggacgagctggccgccttcgccgacagctacggccagagacccagaagagccgacggcaacagccacgaggccagaggcggcagcagattcgagagaagcgagagcagagcccacagcggcttctaccaggacgacagcctggaggagtactacggccagagaagcagaagcagagagcccctgaccgacgccgacagaggctgggccttcagccccgccagaagaagacccgccgaggacgcccacctgcccagactggtgagcagaacccccggcaccgcccccaagtacgaccacagctacctgggcagcgccagagagagacaggccagacccgagggcgccagcagaggcggcagcctggagacccccagcaagagaagcgcccagctgggccccagaagcgccagctactacgcctggagcccccccggcacctacaaggccggcagcagccaggacgaccaggaggacgccagcgacgacgccctgcccccctacagcgagctggagctgaccagaggccccagctacagaggcagagacctgccctaccacagcaacagcgagaagaagagaaagaaggagcccgccaagaagaccaacgacttccccaccagaatgagcctggtggtgtag

SEQ ID NO: 18818 - DNA, 1644 bp, Artificial Sequence
  Description of Artificial Sequence: Synthetic coding sequence
atggccatgggcctgttcagagtgtgcctggtggtggtgaccgccatcatcaaccaccccctgctgttccccagagagaacgccaccgtgcccgagaacgaggaggagatcatcagaaagatgcaggcccaccaggagaagctgcagctggagcagctgagactggaggaggaggtggccagactggccgccgagaaggaggccctggagcaggtggccgaggagggcagacagcagaacgagaccagagtggcctgggacctgtggagcaccctgtgcatgatcctgttcctgatgatcgaggtgtggagacaggaccaccaggagggccccagccccgagtgcctgggcggcgaggaggacgagctgcccggcctgggcggcgcccccctgcagggcctgaccctgcccaacaaggccaccctgggccacttctacgagagatgcatcagaggcgccaccgccgacgccgccagaaccagagagttcctggagggcttcgtggacgacctgctggaggccctgagaagcctgtgcaacagagacaccgacatggaggtggaggacttcatcggcgtggacagcatgtacgagaactggcaggtggacagacccctgctgtgccacctgttcgtgcccttcaccccccccgagccctacagattccaccccgagctgtggtgcagcggcagaagcgtgcccctggacagacagggctacggccagatcaaggtggtgagagccgacggcgacaccctgagctgcatctgcggcaagaccaagctgggcgaggacatgctgtgcctgctgcacggcagaaacagcatggcccccccctgcggcgacatggagaacctgctgtgcgccaccgacagcctgtacctggacaccatgcaggtgatgaagtggttccagaccgccctgaccagagcctggaagggcatcgcccacaagtacgagttcgacctggccttcggccagctggacagccccggcagcctgaagatcaagttcagaagcggcaagttcatgcccttcaacctgatccccgtgatccagtgcgacgacagcgacctgtacttcgtgagccacctgcccagagagcccagcgagggcacccccgccagcagcaccgactggctgctgagcttcgccgtgtacgagagacacttcctgagaaccaccctgaaggccctgcccgagggcgcctgccacctgagctgcctgcagatcgccagcttcctgctgagcaagcagagcagactgaccggccccagcggcctgagcagctaccacctgaagaccgccctgctgcacctgctgctgctgagacaggccgccgactggaaggccggccagctggacgccagactgcacgagctgctgtgcttcctggagaagagcctgctgcagaagaagctgcaccacttcttcatcggcaacagaaaggtgcccgaggccatgggcctgcccgaggccgtgctgagagccgagcccctgaacctgttcagacccttcgtgctgcagagaagcctgtacagaaagaccctggacagcttctacgagatgctgaagaacgcccccgccctgatcagcgagtacagcctgcacgtgcccagcgaccagcccacccccaagagctag

SEQ ID NO: 18819 - DNA, 1644 bp, Artificial Sequence; identical to SEQ ID NO: 18818
  Description of Artificial Sequence: Synthetic coding sequence

SEQ ID NO: 18820 - DNA, 1644 bp, Artificial Sequence; identical to SEQ ID NO: 18818
  Description of Artificial Sequence: Synthetic coding sequence

SEQ ID NO: 18821 - DNA, 345 bp, Artificial Sequence
  Description of Artificial Sequence: Synthetic coding sequence
atggccatgggcctgttcagagtgtgcctggtggtggtgaccgccatcatcaaccaccccctgctgttccccagagagaacgccaccgtgcccgagaacgaggaggagatcatcagaaagatgcaggcccaccaggagaagctgcagctggagcagctgagactggaggaggaggtggccagactggccgccgagaaggaggccctggagcaggtggccgaggagggcagacagcagaacgagaccagagtggcctgggacctgtggagcaccctgtgcatgatcctgttcctgatgatcgaggtgtggagacaggaccaccaggagggccccagccccgagtag

SEQ ID NO: 18822 - DNA, 1692 bp, Artificial Sequence
  Description of Artificial Sequence: Synthetic coding sequence
atgaccaccgacagctacagccccaccagccccgacgccgaggccagcatggccgtgatcagcctgctgttcctggccgtgatgtacgtggtgcaccaccccctgatggtgagcgacagaatggacctggacaccctggccagaagcagacagctggagaagagaatgagcgaggagatgagactgctggagatggagttcgaggagagaaagagagccgccgagcagagacagaaggccgagaacttctggaccggcgacaccagcagcgaccagctggtgctgggcaagaaggacatgggctggcccttccaggccgacggccaggagggccccctgggctggatgctgggcaacctgtggaacaccggcctgttctgcctgttcctggtgttcgagctgctgagacagaacatgcagcacgagcccgccttcgacagcagcagcgaggaggaggaggaggaggtgagagtggtgcccgtgaccagctacaactggctgaccgacttccccagccaggaggccctggacagcttctacaagcactacgtgcagaacgccatcagagacctgccctgcacctgcgagttcgtggagagcttcgtggacgacctgatcgaggcctgcagagtgctgagcagacaggaggcccacccccagctggaggactgcctgggcatcggcgccgccttcgagaagtggggcaccctgcacgagacccagaagttcgacatcctggtgcccatcgtgcccccccagggcaccatgttcgtgctggagatgagagaccccgccctgggcagaagatgcggctgcgtgctggtggagagcgagtgcgtgtgcaagagagagaagctgctgggcgacgtgctgtgcctggtgcaccaccacagagaccccagcgccgtgctgggcaagtgcagcagcagcatcaaggccgccctgtgcaccggcttccacctggacgtgtgcaagaccgtgcagtggttcagaaacatgatgggcaacgcctgggccctggtggcccacaagtacgacttcaagctgagcctgccccccagcaccaccagctgcaagctgagactggactacagaagcggcagattcctgagcatccacctggtgctgggcgtgcagagagaggacaccctggtgtacctggtgagccaggcccccgaccaggagcagctgaccagcgtggactggcccgagagcttcgtggcctgcgagcacctgttcctgaagctggtgggcagattcgcccccgagaacacctgccacctgaagtgcctgcagatcatcctgagcctgagacagcaccagagcctgccccacggcgccagcagacccatcctgaccagctaccacttcaagaccgccctgatgcacctgctgctgagactgcccctgaccgactgggcccacaacatgctgagccagagactgcaggacatcctgtggttcctgggcagaggcctgcagcagagaagcctgcaccacttcctgatcggcaacaacttcctgcccctgaccatccccatccccaagaccttcagaaacgccgagcccgtgaacctgttccagcacctggtgctgaaccccaaggcccacagccaggccgtggaggagttccagaacctgctgacccaggtgaagaccctgccccacgcccccctggccgccgccccctag

SEQ ID NO: 18823 - DNA, 1668 bp, Artificial Sequence
  Description of Artificial Sequence: Synthetic coding sequence
atgaacgtggacgccgaggccagcatggccgtgatcagcctgctgttcctggccgtgatgtacgtggtgcaccaccccctgatggtgagcgacagaatggacctggacaccctggccagaagcagacagctggagaagagaatgagcgaggagatgagactgctggagatggagttcgaggagagaaagagagccgccgagcagagacagaaggccgagaacttctggaccggcgacaccagcagcgaccagctggtgctgggcaagaaggacatgggctggcccttccaggccgacggccaggagggccccctgggctggatgctgggcaacctgtggaacaccggcctgttctgcctgttcctggtgttcgagctgctgagacagaacatgcagcacgagcccgccttcgacagcagcagcgaggaggaggaggaggaggtgagagtggtgcccgtgaccagctacaactggctgaccgacttccccagccaggaggccctggacagcttctacaagcactacgtgcagaacgccatcagagacctgccctgcacctgcgagttcgtggagagcttcgtggacgacctgatcgaggcctgcagagtgctgagcagacaggaggcccacccccagctggaggactgcctgggcatcggcgccgccttcgagaagtggggcaccctgcacgagacccagaagttcgacatcctggtgcccatcgtgcccccccagggcaccatgttcgtgctggagatgagagaccccgccctgggcagaagatgcggctgcgtgctggtggagagcgagtgcgtgtgcaagagagagaagctgctgggcgacgtgctgtgcctggtgcaccaccacagagaccccagcgccgtgctgggcaagtgcagcagcagcatcaaggccgccctgtgcaccggcttccacctggacgtgtgcaagaccgtgcagtggttcagaaacatgatgggcaacgcctgggccctggtggcccacaagtacgacttcaagctgagcctgccccccagcaccaccagctgcaagctgagactggactacagaagcggcagattcctgagcatccacctggtgctgggcgtgcagagagaggacaccctggtgtacctggtgagccaggcccccgaccaggagcagctgaccagcgtggactggcccgagagcttcgtggcctgcgagcacctgttcctgaagctggtgggcagattcgcccccgagaacacctgccacctgaagtgcctgcagatcatcctgagcctgagacagcaccagagcctgccccacggcgccagcagacccatcctgaccagctaccacttcaagaccgccctgatgcacctgctgctgagactgcccctgaccgactgggcccacaacatgctgagccagagactgcaggacatcctgtggttcctgggcagaggcctgcagcagagaagcctgcaccacttcctgatcggcaacaacttcctgcccctgaccatccccatccccaagaccttcagaaacgccgagcccgtgaacctgttccagcacctggtgctgaaccccaaggcccacagccaggccgtggaggagttccagaacctgctgacccaggtgaagaccctgccccacgcccccctggccgccgccccctag

SEQ ID NO: 18824 - DNA, 1644 bp, Artificial Sequence
  Description of Artificial Sequence: Synthetic coding sequence
atggccgtgatcagcctgctgttcctggccgtgatgtacgtggtgcaccaccccctgatggtgagcgacagaatggacctggacaccctggccagaagcagacagctggagaagagaatgagcgaggagatgagactgctggagatggagttcgaggagagaaagagagccgccgagcagagacagaaggccgagaacttctggaccggcgacaccagcagcgaccagctggtgctgggcaagaaggacatgggctggcccttccaggccgacggccaggagggccccctgggctggatgctgggcaacctgtggaacaccggcctgttctgcctgttcctggtgttcgagctgctgagacagaacatgcagcacgagcccgccttcgacagcagcagcgaggaggaggaggaggaggtgagagtggtgcccgtgaccagctacaactggctgaccgacttccccagccaggaggccctggacagcttctacaagcactacgtgcagaacgccatcagagacctgccctgcacctgcgagttcgtggagagcttcgtggacgacctgatcgaggcctgcagagtgctgagcagacaggaggcccacccccagctggaggactgcctgggcatcggcgccgccttcgagaagtggggcaccctgcacgagacccagaagttcgacatcctggtgcccatcgtgcccccccagggcaccatgttcgtgctggagatgagagaccccgccctgggcagaagatgcggctgcgtgctggtggagagcgagtgcgtgtgcaagagagagaagctgctgggcgacgtgctgtgcctggtgcaccaccacagagaccccagcgccgtgctgggcaagtgcagcagcagcatcaaggccgccctgtgcaccggcttccacctggacgtgtgcaagaccgtgcagtggttcagaaacatgatgggcaacgcctgggccctggtggcccacaagtacgacttcaagctgagcctgccccccagcaccaccagctgcaagctgagactggactacagaagcggcagattcctgagcatccacctggtgctgggcgtgcagagagaggacaccctggtgtacctggtgagccaggcccccgaccaggagcagctgaccagcgtggactggcccgagagcttcgtggcctgcgagcacctgttcctgaagctggtgggcagattcgcccccgagaacacctgccacctgaagtgcctgcagatcatcctgagcctgagacagcaccagagcctgccccacggcgccagcagacccatcctgaccagctaccacttcaagaccgccctgatgcacctgctgctgagactgcccctgaccgactgggcccacaacatgctgagccagagactgcaggacatcctgtggttcctgggcagaggcctgcagcagagaagcctgcaccacttcctgatcggcaacaacttcctgcccctgaccatccccatccccaagaccttcagaaacgccgagcccgtgaacctgttccagcacctggtgctgaaccccaaggcccacagccaggccgtggaggagttccagaacctgctgacccaggtgaagaccctgccccacgcccccctggccgccgccccctag

SEQ ID NO: 18825 - DNA, 1644 bp, Artificial Sequence; identical to SEQ ID NO: 18824
  Description of Artificial Sequence: Synthetic coding sequence

SEQ ID NO: 18826 - DNA, 1608 bp, Artificial Sequence
  Description of Artificial Sequence: Synthetic coding sequence
atgagcgtgcactacaccctgaacctgagagtgttctggcccctggtgaccggcctgtgcaccgccctggtgtgcctgtaccacgtgctgagaggcagcggcggcgccagagccgagcccgccgacggcgtggacggcggcttccccctgctgaaggtggccgtgctgctgctgctgagctacgtgctgctgagatgcagacacgccgtgagacagagattcctgcccggcagccccagactggagggccacgccgccttcagcagcagacacttcagagagcccggcctgagcatcctgctggagagctactacgagcacgaggtgagactgagcccccacgtgctgggccacagcaaggcccacgtgagcagaatcgtgggcgagctggtgagagccggcagagccagaggcagccccggcctgatccccggcggcgccctggccctggccttcagaggcgacttcatccaggtgggcagcgcctacgagcagcacaagatcagaagacccgacagcttcgacgtgctggtgcccctgagactgccccccctggtggccctggagcccagaagcctgggcgaggagcccgccctggcccccgccttcagaggctgcttcctgtgcgccctgaaggccccccccagccccagcggcgccagcggcggccactggctgagagactgcaagcccttcgccgacgccttctgcgtggacgtgagaggcagaagacacctgagcgccaccctggtgctgagatggttccagagccacctgcagagaagcctggccaccgtgagatacagcctggagggcagatgcagagtgaccctgacccccggcggcctggagcagccccccaccctgcacatcctgccctgcagaaccgactacggctgctgcagactgagcatggccgtgagactgatccccgccgtgcacctgggcgacggcgtgttcctggtggcccccccccccccccccctgcccagcgcccccctgctggagctgcccgagggcctgagagccgaggccctgtggggcgtgaacaccgccagacaggagcagaagctgctgagctggctgcaggagagagccgcccccggcgcctgctacctgaagtgcctgcagctgctgaaggccctgagagacctgggcgccagaggcctggacagcgccgccgccacccagtggggcagaatcctgagcagctacgtgctgaagaccgtgctgctggccgtgctgctgagaaagggcgcccccggccagggctgggacgaggagcacctgggcagatgcctggaggagctggtgcagttcctgagagactgcctgctgagaagacacaccctgttccactgcgtgctgggccccggcggcgccgccgccgaggtgggccccctgcccaaggccctgagagaggccgcccccgtggacctgctggccgccttcgacggccacgccagagagctggccgccgccagactgctgagcacctggcagagactgccccagctgctgagagcctacggcggccccagatacctggccagatgccccccccccagaagccagagaacccagggcttcctggagggcgagccctag

SEQ ID NO: 18827 - DNA, 3774 bp, Artificial Sequence
  Description of Artificial Sequence: Synthetic coding sequence
atggccagctgcagcttcaccagagaccaggccaccagaagactgagaggcgccgccgccgccgccgccgccgccctggccgccgtggtgaccacccccctgctgagcagcggcacccccaccgccctgatcggcaccggcagcagctgccccggcgccatgtggctgagcaccgccaccggcagcagaagcgacagcgagagcgaggaggaggacctgcccgtgggcgaggaggtgtgcaagagaggctacctgagaaagcagaagcacggccacagaagatacttcgtgctgaagctggagaccgccgacgcccccgccagactggagtactacgagaacgccagaaagttcagacacagcgtgagagccgccgccgccgccgccgccgccgccgccagcggcgccgccatcccccccctgatcccccccagaagagtgatcaccctgtaccagtgcttcagcgtgagccagagagccgacgccagatacagacacctgatcgccctgttcacccaggacgagtacttcgccatggtggccgagaacgagagcgagcaggagagctggtacctgctgctgagcagactgatcctggagagcaagagaagaagatgcggcaccctgggcgcccagcccgacggcgagcccgccgccctggccgccgccgccgccgccgagccccccttctacaaggacgtgtggcaggtgatcgtgaagcccagaggcctgggccacagaaaggagctgagcggcgtgttcagactgtgcctgaccgacgaggaggtggtgttcgtgagactgaacaccgaggtggccagcgtggtggtgcagctgctgagcatcagaagatgcggccacagcgagcagtacttcttcctggaggtgggcagaagcaccgtgatcggccccggcgagctgtggatgcaggtggacgactgcgtggtggcccagaacatgcacgagctgttcctggagaagatgagagccctgtgcgccgacgagtacagagccagatgcagaagctacagcatcagcatcggcgcccacctgctgaccctgctgagcgccagaagacacctgggcctggtgcccctggagcccggcggctggctgagaagaagcagattcgagcagttctgccacctgagagccatcggcgacggcgaggacgagatgctgttcaccagaagattcgtgacccccagcgagcccgtggcccacagcagaagaggcagactgcacctgcccagaggcagaagaagcagaagagccgtgagcgtgcccgccagcttcttcagaagactggcccccagccccgccagacccagacaccccgccgaggcccccaacaacggcgccagactgagcagcgaggtgagcggcagcggcagcggcaacttcggcgaggagggcaacccccagggcaaggaggaccaggagggcagcggcggcgactacatgcccatgaacaactggggcagcggcaacggcagaggcagcggcggcggccagggcagcaacggccagggcagcagcagccacagcagcggcggcaaccagtgcagcggcgagggccagggcagcagaggcggccagggcagcaacggccagggcagcggcggcaaccagtgcagcagagacggccagggcaccgccggcggccacggcagcggcggcggccagagacccggcggcggccacggcagcggcggcggccagggccccggcgacggccacggcagcggcggcggcaagaacagcggcggcggcaagggcagcggcagcggcaagggcagcgacggcgacggcgagagaggcaagagcctgaagaagagaagctacttcggcaagctgacccagagcaagcagcagcagatgccccccccccccccccccccccccccccccccccccgccggcggcaccggcggcaagggcaagagcggcggcagattcagactgtacttctgcgtggacagaggcgccaccaaggagtgcaaggaggccaaggaggtgaaggacgccgagatccccgagggcgccgccagaggcccccacagagccagagccttcgacgaggacgaggacgacccctacgtgcccatgagacccggcgtggccacccccctggtgagcagcagcgactacatgcccatggccccccagaacgtgagcgccagcaagaagagacacagcagaagccccttcgaggacagcagaggctacatgatgatgttccccagagtgagccccccccccgcccccagcccccccaaggcccccgacaccaacaaggaggacgacagcaaggacaacgacagcgagagcgactacatgttcatggcccccggcgccggcgccatccccaagaaccccagaaacccccagggcggcagcagcagcaagagctggagcagctacttcagcctgcccaaccccttcagaagcagccccctgggccagaacgacaacagcgagtacgtgcccatgctgcccggcaagttcctgggcagaggcctggacaaggaggtgagctacaactgggaccccaaggacgccgccagcaagcccagcggcgagggcagcttcagcaagcccggcgacggcggcagccccagcaagcccagcgaccacgagccccccaagaacaaggccaagagacccaacagactgagcttcatcaccaagggctacaagatcaagcccaagccccagaagcccacccacgagcagagagaggccgacagcagcagcgactacgtgaacatggacttcaccaagagagagagcaacacccccgcccccagcacccagggcctgcccgacagctggggcatcatcgccgagcccagacagagcgccttcagcaactacgtgaacgtggagttcggcgtgcccttccccaaccccgccaacgacctgagcgacctgctgagagccatccccagagccaaccccctgagcctggacagcgccagatggcccctgccccccctgcccctgagcgccaccggcagcaacgccatcgaggaggagggcgactacatcgaggtgatcttcaacagcgccatgacccccgccatggccctggccgacagcgccatcagatacgacgccgagaccggcagaatctacgtggtggaccccttcagcgagtgctgcatggacatcagcctgagccccagcagatgcagcgagcccccccccgtggccagactgctgcaggaggaggagcaggagagaagaagaccccagagcagaagccagagcttcttcgccgccgccagagccgccgtgagcgccttccccaccgacagcctggagagagacctgagccccagcagcgcccccgccgtggccagcgccgccgagcccaccctggccctgagccaggtggtggccgccgccagcgccctggccgccgcccccggcatcggcgccgccgccgccgccgccggcttcgacagcgccagcgccagatggttccagcccgtggccaacgccgccgacgccgaggccgtgagaggcgcccaggacgtggccggcggcagcaaccccggcgcccacaaccccagcgccaacctggccagaggcgacaaccaggccggcggcgccgccgccgccgccgccgcccccgagcccccccccagaagcagaagagtgcccagaccccccgagagagaggacagcgacaacgacgacgacacccacgtgagaatggacttcgccagaagagacaaccagttcgacagccccaagagaggcagatag

SEQ ID NO: 18828 - DNA, 7185 bp, Artificial Sequence
  Description of Artificial Sequence: Synthetic coding sequence
atgtggctgagcggcaagagccaggtgcagaagagaggcgccgtgagatacctgcaggccccccccgtgaacggcgaggccagcgcctgccccgccccccccacccacctggacagaaccacctgcgccagaagaagacccgccagactgccccccccctggggcgccgccggcatcagacccgcccccagagccagcagagccagcttctgggccagattccccccccactgcttccccagcggctgcagcggcagcagagtgctggagggcggcgagatcggcttcagattcagaggcggcagagtggccgccgccgccctgagaagcagatgggccagaggcgacgccgccgccgccggcagcagagagggcagaggcagaatgaacagagccaagcccaccaccgtgagaagacccagcgccgccgccaagcccagcggccaccccccccccggcgacttcatcgccctgggcagcaagggccaggccaacgagagcaagaccgccagcaccctgctgaagcccgcccccagcggcctgcccagcgagagaaagagagacgccgccgccgccctgagcagcgccagcgccctgaccggcctgaccaagagacccaagctgagcagcaccccccccctgagcgccctgggcagactggccgaggccgccgtggccgagaagagagccatcagccccagcatcaaggagcccagcgtggtgcccatcgaggtgctgcccaccgtgctgctggacgagatcgaggccgccgagctggagggcaacgacgacagaatcgagggcgtgctgtgcggcgccgtgaagcagctgaaggtgaccagagccaagcccgacagcaccctgtacctgagcctgatgtacctggccaagatcaagcccaacatcttcgccaccgagggcgtgatcgaggccctgtgcagcctgctgagaagagacgccagcatcaacttcaaggccaagggcaacagcctggtgagcgtgctggcctgcaacctgctgatggccgcctacgaggaggacgagaactggcccgagatcttcgtgaaggtgtacatcgaggacagcctgggcgagagaatctgggtggacagcccccactgcaagaccttcgtggacaacatccagaccgccttcaacaccagaatgccccccagaagcgtgctgctgcagggcgaggccggcagagtggccggcgacctgggcgccggcagcagcccccaccccagcctgaccgaggaggaggacagccagaccgagctgctgatcgccgaggagaagctgagccccgagcaggagggccagctgatgcccagatacgaggagctggccgagagcgtggaggagtacgtgctggacatgctgagagaccagctgaacagaagacagcccatcgacaacgtgagcagaaacctgctgagactgctgaccagcacctgcggctacaaggaggtgagactgctggccgtgcagaagctggagatgtggctgcagaaccccaagctgaccagacccgcccaggacctgctgatgagcgtgtgcatgaactgcaacacccacggcagcgaggacatggacgtgatcagccacctgatcaagatcagactgaagcccaaggtgctgctgaaccacttcatgctgtgcatcagagagctgctgagcgcccacaaggacaacctgggcaccaccatcaagctggtgatcttcaacgagctgagcagcgccagaaaccccaacaacatgcaggtgctgtacaccgccctgcagcacagcagcgagctggcccccaagttcctggccatggtgttccaggacctgctgaccaacaaggacgactacctgagagccagcagagccctgctgagagagatcatcaagcagaccaagcacgagatcaacttccaggccttctgcctgggcctgatgcaggagagaaaggagccccagtacctggagatggagttcaaggagagattcgtggtgcacatcaccgacgtgctggccgtgagcatgatgctgggcatcaccgcccaggtgaaggaggccggcatcgcctgggacaagggcgagaagagaaacctggaggtgctgagaagcttccagaaccagatcgccgccatccagagagacgccgtgtggtggctgcacaccgtggtgcccagcatcagcaagctggcccccaaggactacgtgcactgcctgcacaaggtgctgttcaccgagcagcccgagacctactacaagtgggacaactggccccccgagagcgacagaaacttcttcctgagactgtgcagcgaggtgcccatcctggaggacaccctgatgagaatcctggtgatcggcctgagcagagagctgcccctgggccccgccgacgccatggagctggccgaccacctggtgaagagagccgccgccgtgcaggccgacgacgtggaggtgctgaaggtgggcagaacccagctgatcgacgccgtgctgaacctgtgcacctaccaccaccccgagaacatccagctgccccccggctaccagccccccaacctggccatcagcaccctgtactggaaggcctggcccctgctgctggtggtggccgccttcaaccccgagaacatcggcctggccgcctgggaggagtaccccaccctgaagatgctgatggagatggtgatgaccaacaactacagctaccccccctgcaccctgaccgacgaggagaccagaaccgagatgctgaacagagagctgcagaccgcccagagagagaagcaggagatcctggccttcgagggccacctggccgccgccagcaccaagcagaccatcaccgagagcagcagcctgctgctgagccagctgaccagcctggacccccagtacgccgcccacaccgcccccccctgcgcctgcagaagagacctgggcccccccagaagaccccccccccacatcctggaccaggtgaagagcctgaaccagagcctgagactgggccacctgctgtgcagaagcagaaaccccgacttcctgctgcacatcatccagagacaggccagcagccagagcatgccctggctggccgacctggtgcagagcagcgagggcagcctggacgtgctgcccgtgcagtgcctgtgcgagttcctgctgcacgacgccgtggacgacgccgccagcggcgaggaggacgacgagggcgagagcaaggagcagaaggccaagaagagacagagacagcagaagcagagacagctgctgggcagactgcaggacctgctgctgggccccaaggccgacgagcagaccacctgcgaggtgctggactacttcctgagaagactgggcagcagccaggtggccagcagagtgctggccatgaagggcgagaccctgcccgccctgcccaaggccggccccgcccacgagtgcctgccccagggcctgagcctggtgctgagcgagggcagcctgagagacggcgaggagaaggagccccccatggaggaggacgtgggcgacaccgacgtgctgcagggctaccagtggctgctgagagacctgcccagactgcccctgttcgacagcgtgagaagcaccaccgccctggccctgcagcaggccatccacatggagaccgacccccagaccatcagcgcctacctgatctacctgagccagcacacccccgtggaggagcaggcccagcacagcgacctggccctggacgtggccagactggtggtggagagaagcaccatcatgagccacctgttcagcaagctgagccccagcgccgccagcgacgccgtgctgagcgccctgctgagcatcttcagcagatacgtgagaagaatgagacagagcaaggagggcgaggaggtgtacagctggagcgagagccaggaccaggtgttcctgagatggagcagcggcgagaccgccaccatgcacatcctggtggtgcacgccatggtgatcctgctgaccctgggcccccccagagccgacgacagcgagttccaggccctgctggacatctggttccccgaggagaagcccctgcccaccgccttcctggtggacaccagcgaggaggccctgctgctgcccgactggctgaagctgagaatgatcagaagcgaggtgctgagactggtggacgccgccctgcaggacctggagccccagcagctgctgctgttcgtgcagagcttcggcatccccgtgagcagcatgagcaagctgctgcagttcctggaccaggccgtggcccacgacccccagaccctggagcagaacatcatggacaagagcaagatgcccggcacctgcggcgtgggcagccacaccctgaccgagccccagcccggccaggccttcggcgcctgggtgagagccggcgtgaccctgctgagattcgccgactacatggcccacctggtggaggtgcagcacgagagaggcgccagcggcggccagaccttccacagcctgctgaccgccagcctgccccccagaagagacagcaccgaggcccccaagcccaagagcagccccgagcagcccatcggccagggcagaatcagagtgggcacccagctgagagtgctgggccccgaggacgacctggccggcatgttcctgcagatcttccccctgagccccgaccccagatggcagagcagcagccccagacccgtggccctggccctgcagcaggccctgggccaggagctggccagagtggtgcagggcagccccgaggtgcccggcatcaccgtgagagtgctgcaggccctggccaccctgctgagcagcccccacggcggcgccctggtgatgagcatgcacagaagccacttcctggcctgccccctgctgagacagctgtgccagtaccagagatgcgtgccccaggacaccggcttcagcagcctgttcctgaaggtgctgctgcagatgctgcagtggctggacagccccggcgtggagggcggccccctgagagcccagctgagaatgctggccagccaggccagcgccggcagaagactgagcgacgtgagaggcggcctgctgagactggccgaggccctggccttcagacaggacctggaggtggtgagcagcaccgtgagagccgtgatcgccaccctgagaagcggcgagcagtgcagcgtggagcccgacctgatcagcaaggtgctgcagggcctgatcgaggtgagaagcccccacctggaggagctgctgaccgccttcttcagcgccaccgccgacgccgccagccccttccccgcctgcaagcccgtggtggtggtgagcagcctgctgctgcaggaggaggagcccctggccggcggcaagcccggcgccgacggcggcagcctggaggccgtgagactgggccccagcagcggcctgctggtggactggctggagatgctggaccccgaggtggtgagcagctgccccgacctgcagctgagactgctgttcagcagaagaaagggcaagggccaggcccaggtgcccagcttcagaccctacctgctgaccctgttcacccaccagagcagctggcccaccctgcaccagtgcatcagagtgctgctgggcaagagcagagagcagagattcgaccccagcgccagcctggacttcctgtgggcctgcatccacgtgcccagaatctggcagggcagagaccagagaaccccccaggccggcctgggcagaaagagaagagaggagctggtgctgagagtgcagggccccgagctgatcagcctggtggagctgatcctggccgaggccgagaccagaagccaggacggcgacaccgccgcctgcagcctgatccaggccagactgcccctgctgctgagctgctgctgcggcgacgacgagagcgtgagaaaggtgaccgagcacctgagcggctgcatccagcagtggggcgacagcgtgctgggcagaagatgcagagacctgctgctgcagctgtacctgcagagacccgagctgagagtgcccgtgcccgaggtgctgctgcacagcgagggcgccgccagcagcagcgtgtgcaagctggacggcctgatccacagattcatcaccctgctggccgacaccagcgacagcagagccctggagaacagaggcgccgacgccagcatggcctgcagaaagctggccgtggcccaccccctgctgctgctgagacacctgcccatgatcgccgccctgctgcacggcagaacccacctgaacttccaggagttcagacagcagaaccacctgagctgcttcctgcacgtgctgggcctgctggagctgctgcagccccacgtgttcagaagcgagcaccagggcgccctgtgggactgcctgctgagcttcatcagactgctgctgaactacagaaagagcagcagacacctggccgccttcatcaacaagttcgtgcagttcatccacaagtacatcacctacaacgcccccgccgccatcagcttcctgcagaagcacgccgaccccctgcacgacctgagcttcgacaacagcgacctggtgatgctgaagagcctgctggccggcctgagcctgcccagcagagacgacagaaccgacagaggcctggacgaggagggcgaggaggagagcagcgccggcagcctgcccctggtgagcgtgagcctgttcacccccctgaccgccgccgagatggccccctacatgaagagactgagcagaggccagaccgtggaggacctgctggaggtgctgagcgacatcgacgagatgagcagaagaagacccgagatcctgagcttcttcagcaccaacctgcagagactgatgagcagcgccgaggagtgctgcagaaacctggccttcagcctggccctgagaagcatgcagaacagccccagcatcgccgccgccttcctgcccaccttcatgtactgcctgggcagccaggacttcgaggtggtgcagaccgccctgagaaacctgcccgagtacgccctgctgtgccaggagcacgccgccgtgctgctgcacagagccttcctggtgggcatgtacggccagatggaccccagcgcccagatcagcgaggccctgagaatcctgcacatggaggccgtgatgtag

SEQ ID NO: 18829 - DNA, 6573 bp, Artificial Sequence
  Description of Artificial Sequence: Synthetic coding sequence
atgaacagagccaagcccaccaccgtgagaagacccagcgccgccgccaagcccagcggccaccccccccccggcgacttcatcgccctgggcagcaagggccaggccaacgagagcaagaccgccagcaccctgctgaagcccgcccccagcggcctgcccagcgagagaaagagagacgccgccgccgccctgagcagcgccagcgccctgaccggcctgaccaagagacccaagctgagcagcaccccccccctgagcgccctgggcagactggccgaggccgccgtggccgagaagagagccatcagccccagcatcaaggagcccagcgtggtgcccatcgaggtgctgcccaccgtgctgctggacgagatcgaggccgccgagctggagggcaacgacgacagaatcgagggcgtgctgtgcggcgccgtgaagcagctgaaggtgaccagagccaagcccgacagcaccctgtacctgagcctgatgtacctggccaagatcaagcccaacatcttcgccaccgagggcgtgatcgaggccctgtgcagcctgctgagaagagacgccagcatcaacttcaaggccaagggcaacagcctggtgagcgtgctggcctgcaacctgctgatggccgcctacgaggaggacgagaactggcccgagatcttcgtgaaggtgtacatcgaggacagcctgggcgagagaatctgggtggacagcccccactgcaagaccttcgtggacaacatccagaccgccttcaacaccagaatgccccccagaagcgtgctgctgcagggcgaggccggcagagtggccggcgacctgggcgccggcagcagcccccaccccagcctgaccgaggaggaggacagccagaccgagctgctgatcgccgaggagaagctgagccccgagcaggagggccagctgatgcccagatacgaggagctggccgagagcgtggaggagtacgtgctggacatgctgagagaccagctgaacagaagacagcccatcgacaacgtgagcagaaacctgctgagactgctgaccagcacctgcggctacaaggaggtgagactgctggccgtgcagaagctggagatgtggctgcagaaccccaagctgaccagacccgcccaggacctgctgatgagcgtgtgcatgaactgcaacacccacggcagcgaggacatggacgtgatcagccacctgatcaagatcagactgaagcccaaggtgctgctgaaccacttcatgctgtgcatcagagagctgctgagcgcccacaaggacaacctgggcaccaccatcaagctggtgatcttcaacgagctgagcagcgccagaaaccccaacaacatgcaggtgctgtacaccgccctgcagcacagcagcgagctggcccccaagttcctggccatggtgttccaggacctgctgaccaacaaggacgactacctgagagccagcagagccctgctgagagagatcatcaagcagaccaagcacgagatcaacttccaggccttctgcctgggcctgatgcaggagagaaaggagccccagtacctggagatggagttcaaggagagattcgtggtgcacatcaccgacgtgctggccgtgagcatgatgctgggcatcaccgcccaggtgaaggaggccggcatcgcctgggacaagggcgagaagagaaacctggaggtgctgagaagcttccagaaccagatcgccgccatccagagagacgccgtgtggtggctgcacaccgtggtgcccagcatcagcaagctggcccccaaggactacgtgcactgcctgcacaaggtgctgttcaccgagcagcccgagacctactacaagtgggacaactggccccccgagagcgacagaaacttcttcctgagactgtgcagcgaggtgcccatcctggaggacaccctgatgagaatcctggtgatcggcctgagcagagagctgcccctgggccccgccgacgccatggagctggccgaccacctggtgaagagagccgccgccgtgcaggccgacgacgtggaggtgctgaaggtgggcagaacccagctgatcgacgccgtgctgaacctgtgcacctaccaccaccccgagaacatccagctgccccccggctaccagccccccaacctggccatcagcaccctgtactggaaggcctggcccctgctgctggtggtggccgccttcaaccccgagaacatcggcctggccgcctgggaggagtaccccaccctgaagatgctgatggagatggtgatgaccaacaactacagctaccccccctgcaccctgaccgacgaggagaccagaaccgagatgctgaacagagagctgcagaccgcccagagagagaagcaggagatcctggccttcgagggccacctggccgccgccagcaccaagcagaccatcaccgagagcagcagcctgctgctgagccagctgaccagcctggacccccagggcccccccagaagaccccccccccacatcctggaccaggtgaagagcctgaaccagagcctgagactgggccacctgctgtgcagaagcagaaaccccgacttcctgctgcacatcatccagagacaggccagcagccagagcatgccctggctggccgacctggtgcagagcagcgagggcagcctggacgtgctgcccgtgcagtgcctgtgcgagttcctgctgcacgacgccgtggacgacgccgccagcggcgaggaggacgacgagggcgagagcaaggagcagaaggccaagaagagacagagacagcagaagcagagacagctgctgggcagactgcaggacctgctgctgggccccaaggccgacgagcagaccacctgcgaggtgctggactacttcctgagaagactgggcagcagccaggtggccagcagagtgctggccatgaagggcctgagcctggtgctgagcgagggcagcctgagagacggcgaggagaaggagccccccatggaggaggacgtgggcgacaccgacgtgctgcagggctaccagtggctgctgagagacctgcccagactgcccctgttcgacagcgtgagaagcaccaccgccctggccctgcagcaggccatccacatggagaccgacccccagaccatcagcgcctacctgatctacctgagccagcacacccccgtggaggagcaggcccagcacagcgacctggccctggacgtggccagactggtggtggagagaagcaccatcatgagccacctgttcagcaagctgagccccagcgccgccagcgacgccgtgctgagcgccctgctgagcatcttcagcagatacgtgagaagaatgagacagagcaaggagggcgaggaggtgtacagctggagcgagagccaggaccaggtgttcctgagatggagcagcggcgagaccgccaccatgcacatcctggtggtgcacgccatggtgatcctgctgaccctgggcccccccagagccgacgacagcgagttccaggccctgctggacatctggttccccgaggagaagcccctgcccaccgccttcctggtggacaccagcgaggaggccctgctgctgcccgactggctgaagctgagaatgatcagaagcgaggtgctgagactggtggacgccgccctgcaggacctggagccccagcagctgctgctgttcgtgcagagcttcggcatccccgtgagcagcatgagcaagctgctgcagttcctggaccaggccgtggcccacgacccccagaccctggagcagaacatcatggacaagaactacatggcccacctggtggaggtgcagcacgagagaggcgccagcggcggccagaccttccacagcctgctgaccgccagcctgccccccagaagagacagcaccgaggcccccaagcccaagagcagccccgagcagcccatcggccagggcagaatcagagtgggcacccagctgagagtgctgggccccgaggacgacctggccggcatgttcctgcagatcttccccctgagccccgaccccagatggcagagcagcagccccagacccgtggccctggccctgcagcaggccctgggccaggagctggccagagtggtgcagggcagccccgaggtgcccggcatcaccgtgagagtgctgcaggccctggccaccctgctgagcagcccccacggcggcgccctggtgatgagcatgcacagaagccacttcctggcctgccccctgctgagacagctgtgccagtaccagagatgcgtgccccaggacaccggcttcagcagcctgttcctgaaggtgctgctgcagatgctgcagtggctggacagccccggcgtggagggcggccccctgagagcccagctgagaatgctggccagccaggccagcgccggcagaagactgagcgacgtgagaggcggcctgctgagactggccgaggccctggccttcagacaggacctggaggtggtgagcagcaccgtgagagccgtgatcgccaccctgagaagcggcgagcagtgcagcgtggagcccgacctgatcagcaaggtgctgcagggcctgatcgaggtgagaagcccccacctggaggagctgctgaccgccttcttcagcgccaccgccgacgccgccagccccttccccgcctgcaagcccgtggtggtggtgagcagcctgctgctgcaggaggaggagcccctggccggcggcaagcccggcgccgacggcggcagcctggaggccgtgagactgggccccagcagcggcctgctggtggactggctggagatgctggaccccgaggtggtgagcagctgccccgacctgcagctgagactgctgttcagcagaagaaagggcaagggccaggcccaggtgcccagcttcagaccctacctgctgaccctgttcacccaccagagcagctggcccaccctgcaccagtgcatcagagtgctgctgggcaagagcagagagcagagattcgaccccagcgccagcctggacttcctgtgggcctgcatccacgtgcccagaatctggcagggcagagaccagagaaccccccagaagagaagagaggagctggtgctgagagtgcagggccccgagctgatcagcctggtggagctgatcctggccgaggccgagaccagaagccaggacggcgacaccgccgcctgcagcctgatccaggccagactgcccctgctgctgagctgctgctgcggcgacgacgagagcgtgagaaaggtgaccgagcacctgagcggctgcatccagcagtggggcgacagcgtgctgggcagaagatgcagagacctgctgctgcagctgtacctgcagagacccgagctgagagtgcccgtgcccgaggtgctgctgcacagcgagggcgccgccagcagcagcgtgtgcaagctggacggcctgatccacagattcatcaccctgctggccgacaccagcgacagcagagccctggagaacagaggcgccgacgccagcatggcctgcagaaagctggccgtggcccaccccctgctgctgctgagacacctgcccatgatcgccgccctgctgcacggcagaacccacctgaacttccaggagttcagacagcagaaccacctgagctgcttcctgcacgtgctgggcctgctggagctgctgcagccccacgtgttcagaagcgagcaccagggcgccctgtgggactgcctgctgagcttcatcagactgctgctgaactacagaaagagcagcagacacctggccgccttcatcaacaagttcgtgcagttcatccacaagtacatcacctacaacgcccccgccgccatcagcttcctgcagaagcacgccgaccccctgcacgacctgagcttcgacaacagcgacctggtgatgctgaagagcctgctggccggcctgagcctgcccagcagagacgacagaaccgacagaggcctggacgaggagggcgaggaggagagcagcgccggcagcctgcccctggtgagcgtgagcctgttcacccccctgaccgccgccgagatggccccctacatgaagagactgagcagaggccagaccgtggaggacctgctggaggtgctgagcgacatcgacgagatgagcagaagaagacccgagatcctgagcttcttcagcaccaacctgcagagactgatgagcagcgccgaggagtgctgcagaaacctggccttcagcctggccctgagaagcatgcagaacagccccagcatcgccgccgccttcctgcccaccttcatgtactgcctgggcagccaggacttcgaggtggtgcagaccgccctgagaaacctgcccgagtacgccctgctgtgccaggagcacgccgccgtgctgctgcacagagccttcctggtgggcatgtacggccagatggaccccagcgcccagatcagcgaggccctgagaatcctgcacatggaggccgtgatgtag

SEQ ID NO: 18830 - DNA, 3612 bp, Artificial Sequence
  Description of Artificial Sequence: Synthetic coding sequence
aaggaccagcagaccgtgatcatgaccgagtgcaccagcctgcagttcgtgagccccttcgccttcgaggccatgcagaaggtggacgtggtgtgcctggccagcctgagcgaccccgagctgagactgctgctgccctgcctggtgagaatggccctgtgcgcccccgccgaccagagccagagctgggcccaggacaagaagctgatcctgagactgctgagcggcgtggaggccgtgaacagcatcgtggccctgctgagcgtggacttccacgccctggagcaggacgccagcaaggagcagcagctgagacacaagctgggcggcggcagcggcgagagcatcctggtgagccagctgcagcacggcctgaccctggagttcgagcacagcgacagccccagaagactgagactggtgctgagcgagctgctggccatcatgaacaaggtgagcgagagcaacggcgagttcttcttcaagagcagcgagctgttcgagagccccgtgtacctggaggaggccgccgacgtgctgtgcatcctgcaggccgagctgcccagcctgctgcccatcgtggacgtggccgaggccctgctgcacgtgagaaacggcgcctggttcctgtgcctgctggtggccaacgtgcccgacagcttcaacgaggtgtgcagaggcctgatcaagaacggcgagagacaggacgaggagagcctgggcggcagaagaagaaccgacgccctgagattcctgtgcaagatgaaccccagccaggccctgaaggtgagaggcatggtggtggaggagtgccacctgcccggcctgggcgtggccctgaccctggaccacaccaagaacgaggcctgcgaggacggcgtgagcgacctggtgtgcttcgtgagcggcctgctgctgggcaccaacgccaaggtgagaacctggttcggcaccttcatcagaaacggccagcagagaaagagagagaccagcagcagcgtgctgtggcagatgagaagacagctgctgctggagctgatgggcatcctgcccaccgtgagaagcaccagaatcgtggaggaggccgacgtggacatggagcccaacgtgagcgtgtacagcggcctgaaggaggagcacgtggtgaaggccagcgccctgctgagactgtactgcgccctgatgggcatcgccggcctgaagcccaccgaggaggaggccgagcagctgctgcagctgatgaccagcagaccccccgccacccccgccggcgtgagattcgtgagcctgagcttctgcatgctgctggccttcagcaccctggtgagcacccccgagcaggagcagctgatggtggtgtggctgagctggatgatcaaggaggaggcctacttcgagagcaccagcggcgtgagcgccagcttcggcgagatgctgctgctggtggccatgtacttccacagcaaccagctgagcgccatcatcgacctggtgtgcagcaccctgggcatgaagatcgtgatcaagcccagcagcctgagcagaatgaagaccatcttcacccaggagatcttcaccgagcaggtggtgaccgcccacgccgtgagagtgcccgtgaccagcaacctgagcgccaacatcaccggcttcctgcccatccactgcatctaccagctgctgagaagcagaagcttcaccaagcacaaggtgagcatcaaggactggatctacagacagctgtgcgagaccagcacccccctgcacccccagctgctgcccctgatcgacgtgtacatcaacagcatcctgacccccgccagcaagagcaaccccgaggccaccaaccagcccgtgaccgagcaggagatcctgaacatcttccagggcgtgatcggcggcgacaacatcagactgaaccagagattcagcatcaccgcccagctgctggtgctgtactacatcctgagctacgaggaggccctgctggccaacaccaagaccctggccgccatgcagagaaagcccaagagctacagcagcagcctgatggaccagatccccatcaagttcctgatcagacaggcccagggcctgcagcaggagctgggcggcctgcacagcgccctgctgagactgctggccaccaactacccccacctgtgcatcgtggacgactggatctgcgaggaggagatcaccggcaccgacgccctgctgagaagaatgctgctgaccaacaacgccaagaaccacagccccaagcagctgcaggaggccttcagcgccgtgcccgtgaacaacacccaggtgatgcagatcatcgagcacctgaccctgctgagcgccagcgagctgatcccctacgccgaggtgctgaccagcaacatgagccagctgctgaacagcggcgtgcccagaagaatcctgcagaccgtgaacaagctgtggatggtgctgaacaccgtgatgcccagaagactgtgggtgatgaccgtgaacgccctgcagcccagcatcaagttcgtgagacagcagaagtacacccagaacgacctgatgatcgaccccctgatcgtgctgagatgcgaccagagagtgcacagatgcccccccctgatggacatcaccctgcacatgctgaacggctacctgctggccagcaaggcctacctgagcgcccacctgaaggagaccgagcaggacagacccagccagaacaacaccatcggcctggtgggccagaccgacgcccccgaggtgaccagagaggagctgaagaacgccctgctggccgcccaggacagcgccgccgtgcagatcctgctggagatctgcctgcccaccgaggaggagaaggccaacggcgtgaaccccgacagcctgctgagaaacgtgcagagcgtgatcaccaccagcgcccccaacaagggcatggaggagggcgaggacaacctgctgtgcaacctgagagaggtgcagtgcctgatctgctgcctgctgcaccagatgtacatcgccgaccccaacatcgccaagctggtgcacttccagggctacccctgcgagctgctgcccctgaccgtggccggcatccccagcatgcacatctgcctggacttcatccccgagctgatcgcccagcccgagctggagaagcagatcttcgccatccagctgctgagccacctgtgcatccagtacgccctgcccaagagcctgagcgtggccagactggccgtgaacgtgatgggcaccctgctgaccgtgctgacccaggccaagagatacgccttcttcatgcccaccctgcccagcctggtgagcttctgcagagccttcccccccctgtacgaggacatcatgagcctgctgatccagatcggccaggtgtgcgccagcgacgtggccacccagaccagagacatcgaccccatcatcaccagactgcagcagatcaaggagaagcccagcggctggagccagatctgcaaggacagcagctacaagaacggcagcagagacaccggcagcatggaccccgacgtgcagctgtgccactgcatcgagagaaccgtgatcgagatcatcaacatgagcgtgagcggcatctag

SEQ ID NO: 18831 - DNA, 3615 bp, Artificial Sequence
  Description of Artificial Sequence: Synthetic coding sequence
atgaaggaccagcagaccgtgatcatgaccgagtgcaccagcctgcagttcgtgagccccttcgccttcgaggccatgcagaaggtggacgtggtgtgcctggccagcctgagcgaccccgagctgagactgctgctgccctgcctggtgagaatggccctgtgcgcccccgccgaccagagccagagctgggcccaggacaagaagctgatcctgagactgctgagcggcgtggaggccgtgaacagcatcgtggccctgctgagcgtggacttccacgccctggagcaggacgccagcaaggagcagcagctgagacacaagctgggcggcggcagcggcgagagcatcctggtgagccagctgcagcacggcctgaccctggagttcgagcacagcgacagccccagaagactgagactggtgctgagcgagctgctggccatcatgaacaaggtgagcgagagcaacggcgagttcttcttcaagagcagcgagctgttcgagagccccgtgtacctggaggaggccgccgacgtgctgtgcatcctgcaggccgagctgcccagcctgctgcccatcgtggacgtggccgaggccctgctgcacgtgagaaacggcgcctggttcctgtgcctgctggtggccaacgtgcccgacagcttcaacgaggtgtgcagaggcctgatcaagaacggcgagagacaggacgaggagagcctgggcggcagaagaagaaccgacgccctgagattcctgtgcaagatgaaccccagccaggccctgaaggtgagaggcatggtggtggaggagtgccacctgcccggcctgggcgtggccctgaccctggaccacaccaagaacgaggcctgcgaggacggcgtgagcgacctggtgtgcttcgtgagcggcctgctgctgggcaccaacgccaaggtgagaacctggttcggcaccttcatcagaaacggccagcagagaaagagagagaccagcagcagcgtgctgtggcagatgagaagacagctgctgctggagctgatgggcatcctgcccaccgtgagaagcaccagaatcgtggaggaggccgacgtggacatggagcccaacgtgagcgtgtacagcggcctgaaggaggagcacgtggtgaaggccagcgccctgctgagactgtactgcgccctgatgggcatcgccggcctgaagcccaccgaggaggaggccgagcagctgctgcagctgatgaccagcagaccccccgccacccccgccggcgtgagattcgtgagcctgagcttctgcatgctgctggccttcagcaccctggtgagcacccccgagcaggagcagctgatggtggtgtggctgagctggatgatcaaggaggaggcctacttcgagagcaccagcggcgtgagcgccagcttcggcgagatgctgctgctggtggccatgtacttccacagcaaccagctgagcgccatcatcgacctggtgtgcagcaccctgggcatgaagatcgtgatcaagcccagcagcctgagcagaatgaagaccatcttcacccaggagatcttcaccgagcaggtggtgaccgcccacgccgtgagagtgcccgtgaccagcaacctgagcgccaacatcaccggcttcctgcccatccactgcatctaccagctgctgagaagcagaagcttcaccaagcacaaggtgagcatcaaggactggatctacagacagctgtgcgagaccagcacccccctgcacccccagctgctgcccctgatcgacgtgtacatcaacagcatcctgacccccgccagcaagagcaaccccgaggccaccaaccagcccgtgaccgagcaggagatcctgaacatcttccagggcgtgatcggcggcgacaacatcagactgaaccagagattcagcatcaccgcccagctgctggtgctgtactacatcctgagctacgaggaggccctgctggccaacaccaagaccctggccgccatgcagagaaagcccaagagctacagcagcagcctgatggaccagatccccatcaagttcctgatcagacaggcccagggcctgcagcaggagctgggcggcctgcacagcgccctgctgagactgctggccaccaactacccccacctgtgcatcgtggacgactggatctgcgaggaggagatcaccggcaccgacgccctgctgagaagaatgctgctgaccaacaacgccaagaaccacagccccaagcagctgcaggaggccttcagcgccgtgcccgtgaacaacacccaggtgatgcagatcatcgagcacctgaccctgctgagcgccagcgagctgatcccctacgccgaggtgctgaccagcaacatgagccagctgctgaacagcggcgtgcccagaagaatcctgcagaccgtgaacaagctgtggatggtgctgaacaccgtgatgcccagaagactgtgggtgatgaccgtgaacgccctgcagcccagcatcaagttcgtgagacagcagaagtacacccagaacgacctgatgatcgaccccctgatcgtgctgagatgcgaccagagagtgcacagatgcccccccctgatggacatcaccctgcacatgctgaacggctacctgctggccagcaaggcctacctgagcgcccacctgaaggagaccgagcaggacagacccagccagaacaacaccatcggcctggtgggccagaccgacgcccccgaggtgaccagagaggagctgaagaacgccctgctggccgcccaggacagcgccgccgtgcagatcctgctggagatctgcctgcccaccgaggaggagaaggccaacggcgtgaaccccgacagcctgctgagaaacgtgcagagcgtgatcaccaccagcgcccccaacaagggcatggaggagggcgaggacaacctgctgtgcaacctgagagaggtgcagtgcctgatctgctgcctgctgcaccagatgtacatcgccgaccccaacatcgccaagctggtgcacttccagggctacccctgcgagctgctgcccctgaccgtggccggcatccccagcatgcacatctgcctggacttcatccccgagctgatcgcccagcccgagctggagaagcagatcttcgccatccagctgctgagccacctgtgcatccagtacgccctgcccaagagcctgagcgtggccagactggccgtgaacgtgatgggcaccctgctgaccgtgctgacccaggccaagagatacgccttcttcatgcccaccctgcccagcctggtgagcttctgcagagccttcccccccctgtacgaggacatcatgagcctgctgatccagatcggccaggtgtgcgccagcgacgtggccacccagaccagagacatcgaccccatcatcaccagactgcagcagatcaaggagaagcccagcggctggagccagatctgcaaggacagcagctacaagaacggcagcagagacaccggcagcatggaccccgacgtgcagctgtgccactgcatcgagagaaccgtgatcgagatcatcaacatgagcgtgagcggcatctag

SEQ ID NO: 18832 - DNA, 3060 bp, Artificial Sequence
  Description of Artificial Sequence: Synthetic coding sequence
atgagcgccctgtgcgacccccccggcgcccccggcccccccggccccgcccccgccacccacggccccgcccccctgagcgcccaggagctgagccaggagatcaaggccttcctgaccggcgtggaccccatcctgggccaccagctgagcgccagagagcacgccagatgcggcctgctgctgctgagaagcctgccccccgccagagccgccgtgctggaccacctgagaggcgtgttcgacgagagcgtgagagcccacctggccgccctggacgagacccccgtggccggccccccccacctgagaccccccccccccagccacgtgcccgccggcggccccggcctggaggacgtggtgcaggaggtgcagcaggtgctgagcgagttcatcagagccaaccccaaggcctgggcccccgtgatcagcgcctggagcatcgacctgatgggccagctgagcagcacctacagcggccagcaccagagagtgccccacgccaccggcgccctgaacgagctgctgcagctgtggatgggctgcagagccaccagaaccctgatggacatctacgtgcagtgcctgagcgccctgatcggcagctgccccgacgcctgcgtggacgccctgctggacaccagcgtgcagcacagcccccacttcgactgggtggtggcccacatcggcagcagcttccccggcaccatcatcagcagagtgctgagctgcggcctgaaggacttctgcgtgcacggcggcgccggcggcggcgccggcagcagcggcggcagcagcagccagacccccagcaccgaccccttccccggcagccccgccatccccgccgagaagagagtgcccaagatcgccagcgtggtgggcatcctgggccacctggccagcagacacggcgacagcatcagaagagagctgctgagaatgttccacgacagcctggccggcggcagcggcggcagaagcggcgaccccagcctgcaggccaccgtgcccttcctgctgcagctggccgtgatgagccccgccctgctgggcaccgtgagcggcgagctggtggactgcctgaagccccccgccgtgctgagccagctgcagcagcacctgcagggcttccccagagaggagctggacaacatgctgaacctggccgtgcacctggtgagccaggccagcggcgccggcgcctacagactgctgcagttcctggtggacaccgccatgcccgccagcgtgatcaccacccagggcctggccgtgcccgacaccgtgagagaggcctgcgacagactgatccagctgctgctgctgcacctgcagaagctggtgcaccacagaggcggcagccccggcgagggcgtgctgggccccccccccccccccagactggtgcccttcctggacgccctgaagaaccacgtgggcgagctgtgcggcgagaccctgagactggagagaaagagattcctgtggcagcaccagctgctgggcctgctgagcgtgtacaccagacccagctgcggccccgaggccctgggccacctgctgagcagagccagaagccccgaggagctgagcctggccacccagctgtacgccggcctggtggtgagcctgagcggcctgctgcccctggccttcagaagctgcctggccagagtgcacgccggcaccctgcagccccccttcaccgccagattcctgagaaacctggccctgctggtgggctgggagcagcagggcggcgagggccccgccgccctgggcgcccacttcggcgagagcgccagcgcccacctgagcgacctggcccccctgctgctgcaccccgaggaggaggtggccgaggccgccgccagcctgctggccatctgccccttccccagcgaggccctgagccccagccagctgctgggcctggtgagagccggcgtgcacagattcttcgccagcctgagactgcacggcccccccggcgtggccagcgcctgccagctgctgaccagactgagccagaccagccccgccggcctgaaggccgtgctgcagctgctggtggagggcgccctgcacagaggcaacaccgagctgttcggcggccaggtggacggcgacaacgagaccctgagcgtggtgagcgccagcctggccagcgccagcctgctggacaccaacagaagacacaccgccgccgtgcccggccccggcggcatctggagcgtgttccacgccggcgtgatcggcagaggcctgaagccccccaagttcgtgcagagcagaaaccagcaggaggtgatctacaacacccagagcctgctgagcctgctggtgcactgctgcagcgcccccggcggcaccgagtgcggcgagtgctggggcgcccccatcctgagccccgaggccgccaaggccgtggccgtgaccctggtggagagcgtgtgccccgacgccgccggcgccgagctggcctggccccccgaggagcacgccagagccaccgtggagagagacctgagaatcggcagaagattcagagagcagcccctgctgttcgagctgctgaagctggtggccgccgccccccccgccctgtgctactgcagcgtgctgctgagaggcctgctggccgccctgctgggccactgggaggccagcagacaccccgacaccacccacagcccctggcacctggaggccagctgcaccctggtggccgtgatggccgagggcagcctgctgccccccgccctgggcaacatgcacgaggtgttcagccagctggcccccttcgaggtgagactgctgctgctgagcgtgtggggcttcctgagagagcacggccccctgccccagaagttcatcttccagagcgagagaggcagattcatcagagacttcagcagagagggcggcggcgagggcggcccccacctggccgtgctgcacagcgtgctgcacagaaacatcgacagactgggcctgttcagcggcagattccaggcccccagccccagcaccctgctgagacagggcacctag

SEQ ID NO: 18833 - DNA, 1659 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggcgacagaatccaggacgtgctgttcctgtacaagaacaccaacagcagcaacaacttcagcagaagctgcgtggacgagggcttcagcagcccctgcaccttcgccgccgccgtgagcggcgccaacggcagcaccctgtgggagagacccgtggcccaggacgtggccctggtggagtgcgccgtgccccagcccagaggcagcgaggcccccagcgcctgcatcctggtgggcagacccagcagcttcatcgccgtgaacctgttcaccggcgagaccctgtggaaccacagcagcagcttcagcggcaacgccagcatcctgagccccctgctgcaggtgcccgacgtggacggcgacggcgcccccgacctgctggtgctgacccaggagagagaggaggtgagcggccacctgtacagcggcagcaccggccaccagatcggcctgagaggcagcctgggcgtggacggcgagagcggcttcctgctgcacgtgaccagaaccggcgcccactacatcctgttcccctgcgccagcagcctgtgcggctgcagcgtgaagggcctgtacgagaaggtgaccggcagcggcggccccttcaagagcgacccccactgggagagcatgctgaacgccaccaccagaagaatgctgagccacagcagcggcgccgtgagatacctgatgcacgtgcccggcaacgccggcgccgacgtgctgctggtgggcagcgaggccttcgtgctgctggacggccaggagctgacccccagatggacccccaaggccgcccacgtgctgagaaagcccatcttcggcagatacaagcccgacaccctggccgtggccgtggagaacggcaccggcaccgacagacagatcctgttcctggacctgggcaccggcgccgtgctgtgcagcctggccctgcccagcctgcccggcggccccctgagcgccagcctgcccaccgccgaccacagaagcgccttcttcttctggggcctgcacgagctgggcagcaccagcgagaccgagaccggcgaggccagacacagcctgtacatgttccaccccaccctgcccagagtgctgctggagctggccaacgtgagcacccacatcgtggccttcgacgccgtgctgttcgagcccagcagacacgccgcctacatcctgctgaccggccccgccgacagcgaggcccccggcctggtgagcgtgatcaagcacaaggtgagagacctggtgcccagcagcagagtggtgagactgggcgagggcggccccgacagcgaccaggccatcagagacagattcagcagactgagataccagagcgaggcctag

SEQ ID NO: 18834 - DNA, 1659 bp, Artificial Sequence; identical to SEQ ID NO: 18833
  Description of Artificial Sequence: Synthetic coding sequence

SEQ ID NO: 18835 - DNA, 210 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgtag

SEQ ID NO: 18836 - DNA, 309 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggctag

SEQ ID NO: 18837 - DNA, 702 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggcgacagaatccaggacgtgctgttcctgtacaagaacaccaacagcagcaacaacttcagcagaagctgcgtggacgagggcttcagcagcccctgcaccttcgccgccgccgtgagcggcgccaacggcagcaccctgtgggagagacccgtggcccaggacgtggccctggtggagtgcgccgtgccccagcccagaggcagcgaggcccccagcgcctgcatcctggtgggcagacccagcagcttcatcgccgtgaacctgttcaccggcgagaccctgtggaaccacagcagcagcttcagcggcaacgccagcatcctgagccccctgctgcaggtgcccgacgtggacggcgacggcgcccccgacctgctggtgctgacccaggagtag

SEQ ID NO: 18838 - DNA, 156 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgcctag

SEQ ID NO: 18839 - DNA, 1596 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggcgacagaatccaggacgtgctgttcctgtacaagaacaccaacagcagcaacaacttcagcagaagctgcgtggacgagggcttcagcagcccctgcaccttcgccgccgccgtgagcggcgccaacggcagcaccctgtgggagagacccgtggcccaggacgtggccctggtggagtgcgccgtgccccagcccagaggcagcgaggcccccagcgcctgcatcctggtgggcagacccagcagcttcatcgccgtgaacctgttcaccggcgagaccctgtggaaccacagcagcagcttcagcggcaacgccagcatcctgagccccctgctgcaggtgcccgacgtggacggcgacggcgcccccgacctgctggtgctgacccaggagagagaggaggtgagcggccacctgtacagcggcagcaccggccaccagatcggcctgagaggcagcctgggcgtggacggcgagagcggcttcctgctgcacgtgaccagaaccggcgcccactacatcctgttcccctgcgccagcagcctgtgcggctgcagcgtgaagggcctgtacgagaaggtgaccggcagcggcggccccttcaagagcgacccccactgggagagcatgctgaacgccaccaccagaagaatgctgagccacagcagcggcgccgtgagatacctgatgcacgtgcccggcaacgccggcgccgacgtgctgctggtgggcagcgaggccttcgtgctgctggacggccaggagctgacccccagatggacccccaaggccgcccacgtgctgagaaagcccatcttcggcagatacaagcccgacaccctggccgtggccgtggagaacggcaccggcaccgacagacagatcctgttcctggacctgggcaccggcgccgtgctgtgcagcctggccctgcccagcctgcccggcggccccctgagcgccagcctgcccaccgccgaccacagaagcgccttcttcttctggggcctgcacgagctgggcagcaccagcgagaccgagaccggcgaggccagacacagcctgtacatgttccaccccaccctgcccagagtgctgctggagctggccaacgtgagcacccacatcgtggccttcgacggcagccactgggccaccgccgagagactgctggacggcgccgagctggcccccagacccgcctgccccagactggtgaccggcgtgtgggaggccgccagactgtgcatcctgctgcccggcatcagatggctgatctactggttctag

SEQ ID NO: 18840 - DNA, 264 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagctag

SEQ ID NO: 18841 - DNA, 1623 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggcgacagaatccaggacgtgctgttcctgtacaagaacaccaacagcagcaacaacttcagcagaagctgcgtggacgagggcttcagcagcccctgcaccttcgccgccgccgtgagcggcgccaacggcagcaccctgtgggagagacccgtggcccaggacgtggccctggtggagtgcgccgtgccccagcccagaggcagcgaggcccccagcgcctgcatcctggtgggcagacccagcagcttcatcgccgtgaacctgttcaccggcgagaccctgtggaaccacagcagcagcttcagcggcaacgccagcatcctgagccccctgctgcaggtgcccgacgtggacggcgacggcgcccccgacctgctggtgctgacccaggagagagaggaggtgagcggccacctgtacagcggcagcaccggccaccagatcggcctgagaggcagcctgggcgtggacggcgagagcggcttcctgctgcacgtgaccagaaccggcgcccactacatcctgttcccctgcgccagcagcctgtgcggctgcagcgtgaagggcctgtacgagaaggtgaccggcagcggcggccccttcaagagcgacccccactgggagagcatgctgaacgccaccaccagaagaatgctgagccacagcagcggcgccgtgagatacctgatgcacgtgcccggcaacgccggcgccgacgtgctgctggtgggcagcgaggccttcgtgctgctggacggccaggagctgacccccagatggacccccaaggccgcccacgtgctgagaaagcccatcttcggcagatacaagcccgacaccctggccgtggccgtggagaacggcaccggcaccgacagacagatcctgttcctggacctgggcaccggcgccgtgctgtgcagcctggccctgcccagcctgcccggcggccccctgagcgccagcctgcccaccgccgaccacagaagcgccttcttcttctggggcctgcacgagctgggcagcaccagcgagaccgagaccggcgaggccagacacagcctgtacatgttccaccccaccctgcccagagtgctgctggagctggccaacgtgagcacccacatcgtggccttcgacgccgtgctgttcgagcccagcagacacgccgcctacatcctgctgaccggccccgccgacagcgaggcccccggcctggtgagcgtgatcaagcacaaggcccacaccggcagacagagaagaggcagctggaccggccagagcagcagaagagacctgcacgtgagagtgctgtag

SEQ ID NO: 18842 - DNA, 711 bp, Artificial Sequence
  Description of Artificial Sequence: Synthetic coding sequence
atgctggaccacaaggacctggaggccgagatccaccccctgaagaacgaggagagaaagagccaggagaacctgggcaaccccagcaagaacgaggacaacgtgaagagcgcccccccccagagcagactgagcagatgcagagccgccgccttcttcctgagcctgttcctgtgcctgttcgtggtgttcgtggtgagcttcgtgatcccctgccccgacagacccgccagccagagaatgtggagaatcgactacagcgccgccgtgatctacgacttcctggccgtggacgacatcaacggcgacagaatccaggacgtgctgttcctgtacaagaacaccaacagcagcaacaacttcagcagaagctgcgtggacgagggcttcagcagcccctgcaccttcgccgccgccgtgagcggcgccaacggcagcaccctgtgggagagacccgtggcccaggacgtggccctggtggagtgcgccgtgccccagcccagaggcagcgaggcccccagcgcctgcatcctggtgggcagacccagcagcttcatcgccgtgaacctgttcaccggcgagaccctgtggaaccacagcagcagcttcagcggcaacgccagcatcctgagccccctgctgcaggtgcccgacgtggacggcgacggcgcccccgacctgctggtgctgacccaggagagagaggagtag

SEQ ID NO: 18843 - DNA, 3504 bp, Artificial Sequence
  Description of Artificial Sequence: Synthetic coding sequence
atggagctgcccttcgtgacccacctgttcctgcccctggtgttcctgaccggcctgtgcagccccttcaacctggacgagcaccaccccagactgttccccggcccccccgaggccgagttcggctacagcgtgctgcagcacgtgggcggcggccagagatggatgctggtgggcgccccctgggacggccccagcggcgacagaagaggcgacgtgtacagatgccccgtgggcggcgcccacaacgccccctgcgccaagggccacctgggcgactaccagctgggcaacagcagccaccccgccgtgaacatgcacctgggcatgagcctgctggagaccgacggcgacggcggcttcatggcctgcgcccccctgtggagcagagcctgcggcagcagcgtgttcagcagcggcatctgcgccagagtggacgccagcttccagccccagggcagcctggcccccaccgcccagagatgccccacctacatggacgtggtgatcgtgctggacggcagcaacagcatctacccctggagcgaggtgcagaccttcctgagaagactggtgggcaagctgttcatcgaccccgagcagatccaggtgggcctggtgcagtacggcgagagccccgtgcacgagtggagcctgggcgacttcagaaccaaggaggaggtggtgagagccgccaagaacctgagcagaagagagggcagagagaccaagaccgcccaggccatcatggtggcctgcaccgagggcttcagccagagccacggcggcagacccgaggccgccagactgctggtggtggtgaccgacggcgagagccacgacggcgaggagctgcccgccgccctgaaggcctgcgaggccggcagagtgaccagatacggcatcgccgtgctgggccactacctgagaagacagagagaccccagcagcttcctgagagagatcagaaccatcgccagcgaccccgacgagagattcttcttcaacgtgaccgacgaggccgccctgaccgacatcgtggacgccctgggcgacagaatcttcggcctggagggcagccacgccgagaacgagagcagcttcggcctggagatgagccagatcggcttcagcacccacagactgaaggacggcatcctgttcggcatggtgggcgcctacgactggggcggcagcgtgctgtggctggagggcggccacagactgttcccccccagaatggccctggaggacgagttcccccccgccctgcagaaccacgccgcctacctgggctacagcgtgagcagcatgctgctgagaggcggcagaagactgttcctgagcggcgcccccagattcagacacagaggcaaggtgatcgccttccagctgaagaaggacggcgccgtgagagtggcccagagcctgcagggcgagcagatcggcagctacttcggcagcgagctgtgccccctggacaccgacagagacggcaccaccgacgtgctgctggtggccgcccccatgttcctgggcccccagaacaaggagaccggcagagtgtacgtgtacctggtgggccagcagagcctgctgaccctgcagggcaccctgcagcccgagcccccccaggacgccagattcggcttcgccatgggcgccctgcccgacctgaaccaggacggcttcgccgacgtggccgtgggcgcccccctggaggacggccaccagggcgccctgtacctgtaccacggcacccagagcggcgtgagaccccaccccgcccagagaatcgccgccgccagcatgccccacgccctgagctacttcggcagaagcgtggacggcagactggacctggacggcgacgacctggtggacgtggccgtgggcgcccagggcgccgccatcctgctgagcagcagacccatcgtgcacctgacccccagcctggaggtgaccccccaggccatcagcgtggtgcagagagactgcagaagaagaggccaggaggccgtgtgcctgaccgccgccctgtgcttccaggtgaccagcagaacccccggcagatgggaccaccagttctacatgagattcaccgccagcctggacgagtggaccgccggcgccagagccgccttcgacggcagcggccagagactgagccccagaagactgagactgagcgtgggcaacgtgacctgcgagcagctgcacttccacgtgctggacaccagcgactacctgagacccgtggccctgaccgtgaccttcgccctggacaacaccaccaagcccggccccgtgctgaacgagggcagccccaccagcatccagaagctggtgcccttcagcaaggactgcggccccgacaacgagtgcgtgaccgacctggtgctgcaggtgaacatggacatcagaggcagcagaaaggcccccttcgtggtgagaggcggcagaagaaaggtgctggtgagcaccaccctggagaacagaaaggagaacgcctacaacaccagcctgagcctgatcttcagcagaaacctgcacctggccagcctgaccccccagagagagagccccatcaaggtggagtgcgccgcccccagcgcccacgccagactgtgcagcgtgggccaccccgtgttccagaccggcgccaaggtgaccttcctgctggagttcgagttcagctgcagcagcctgctgagccaggtgttcgtgaagctgaccgccagcagcgacagcctggagagaaacggcaccctgcaggacaacaccgcccagaccagcgcctacatccagtacgagccccacctgctgttcagcagcgagagcaccctgcacagatacgaggtgcacccctacggcaccctgcccgtgggccccggccccgagttcaagaccaccctgagagtgcagaacctgggctgctacgtggtgagcggcctgatcatcagcgccctgctgcccgccgtggcccacggcggcaactacttcctgagcctgagccaggtgatcaccaacaacgccagctgcatcgtgcagaacctgaccgagccccccggcccccccgtgcaccccgaggagctgcagcacaccaacagactgaacggcagcaacacccagtgccaggtggtgagatgccacctgggccagctggccaagggcaccgaggtgagcgtgggcctgctgagactggtgcacaacgagttcttcagaagagccaagttcaagagcctgaccgtggtgagcaccttcgagctgggcaccgaggagggcagcgtgctgcagctgaccgaggccagcagatggagcgagagcctgctggaggtggtgcagaccagacccatcctgatcagcctgtggatcctgatcggcagcgtgctgggcggcctgctgctgctggccctgctggtgttctgcctgtggaagctgggcttcttcgcccacaagaagatccccgaggaggagaagagagaggagaagctggagcagtag

SEQ ID NO: 18844 - DNA, 3111 bp, Artificial Sequence
  Description of Artificial Sequence: Synthetic coding sequence
atgaacatcacccacgcctacagccagggccaccagaagctgaacctggacaccgtgagctacaacatgctgggcgtggacagcgacggctgccccacctacatggacgtggtgatcgtgctggacggcagcaacagcatctacccctggagcgaggtgcagaccttcctgagaagactggtgggcaagctgttcatcgaccccgagcagatccaggtgggcctggtgcagtacggcgagagccccgtgcacgagtggagcctgggcgacttcagaaccaaggaggaggtggtgagagccgccaagaacctgagcagaagagagggcagagagaccaagaccgcccaggccatcatggtggcctgcaccgagggcttcagccagagccacggcggcagacccgaggccgccagactgctggtggtggtgaccgacggcgagagccacgacggcgaggagctgcccgccgccctgaaggcctgcgaggccggcagagtgaccagatacggcatcgccgtgctgggccactacctgagaagacagagagaccccagcagcttcctgagagagatcagaaccatcgccagcgaccccgacgagagattcttcttcaacgtgaccgacgaggccgccctgaccgacatcgtggacgccctgggcgacagaatcttcggcctggagggcagccacgccgagaacgagagcagcttcggcctggagatgagccagatcggcttcagcacccacagactgaaggacggcatcctgttcggcatggtgggcgcctacgactggggcggcagcgtgctgtggctggagggcggccacagactgttcccccccagaatggccctggaggacgagttcccccccgccctgcagaaccacgccgcctacctgggctacagcgtgagcagcatgctgctgagaggcggcagaagactgttcctgagcggcgcccccagattcagacacagaggcaaggtgatcgccttccagctgaagaaggacggcgccgtgagagtggcccagagcctgcagggcgagcagatcggcagctacttcggcagcgagctgtgccccctggacaccgacagagacggcaccaccgacgtgctgctggtggccgcccccatgttcctgggcccccagaacaaggagaccggcagagtgtacgtgtacctggtgggccagcagagcctgctgaccctgcagggcaccctgcagcccgagcccccccaggacgccagattcggcttcgccatgggcgccctgcccgacctgaaccaggacggcttcgccgacgtggccgtgggcgcccccctggaggacggccaccagggcgccctgtacctgtaccacggcacccagagcggcgtgagaccccaccccgcccagagaatcgccgccgccagcatgccccacgccctgagctacttcggcagaagcgtggacggcagactggacctggacggcgacgacctggtggacgtggccgtgggcgcccagggcgccgccatcctgctgagcagcagacccatcgtgcacctgacccccagcctggaggtgaccccccaggccatcagcgtggtgcagagagactgcagaagaagaggccaggaggccgtgtgcctgaccgccgccctgtgcttccaggtgaccagcagaacccccggcagatgggaccaccagttctacatgagattcaccgccagcctggacgagtggaccgccggcgccagagccgccttcgacggcagcggccagagactgagccccagaagactgagactgagcgtgggcaacgtgacctgcgagcagctgcacttccacgtgctggacaccagcgactacctgagacccgtggccctgaccgtgaccttcgccctggacaacaccaccaagcccggccccgtgctgaacgagggcagccccaccagcatccagaagctggtgcccttcagcaaggactgcggccccgacaacgagtgcgtgaccgacctggtgctgcaggtgaacatggacatcagaggcagcagaaaggcccccttcgtggtgagaggcggcagaagaaaggtgctggtgagcaccaccctggagaacagaaaggagaacgcctacaacaccagcctgagcctgatcttcagcagaaacctgcacctggccagcctgaccccccagagagagagccccatcaaggtggagtgcgccgcccccagcgcccacgccagactgtgcagcgtgggccaccccgtgttccagaccggcgccaaggtgaccttcctgctggagttcgagttcagctgcagcagcctgctgagccaggtgttcgtgaagctgaccgccagcagcgacagcctggagagaaacggcaccctgcaggacaacaccgcccagaccagcgcctacatccagtacgagccccacctgctgttcagcagcgagagcaccctgcacagatacgaggtgcacccctacggcaccctgcccgtgggccccggccccgagttcaagaccaccctgagagtgcagaacctgggctgctacgtggtgagcggcctgatcatcagcgccctgctgcccgccgtggcccacggcggcaactacttcctgagcctgagccaggtgatcaccaacaacgccagctgcatcgtgcagaacctgaccgagccccccggcccccccgtgcaccccgaggagctgcagcacaccaacagactgaacggcagcaacacccagtgccaggtggtgagatgccacctgggccagctggccaagggcaccgaggtgagcgtgggcctgctgagactggtgcacaacgagttcttcagaagagccaagttcaagagcctgaccgtggtgagcaccttcgagctgggcaccgaggagggcagcgtgctgcagctgaccgaggccagcagatggagcgagagcctgctggaggtggtgcagaccagacccatcctgatcagcctgtggatcctgatcggcagcgtgctgggcggcctgctgctgctggccctgctggtgttctgcctgtggaagctgggcttcttcgcccacaagaagatccccgaggaggagaagagagaggagaagctggagcagtag

SEQ ID NO: 18845 - DNA, 3075 bp, Artificial Sequence
  Description of Artificial Sequence: Synthetic coding sequence
atggagctgcccttcgtgacccacctgttcctgcccctggtgttcctgaccggctgccccacctacatggacgtggtgatcgtgctggacggcagcaacagcatctacccctggagcgaggtgcagaccttcctgagaagactggtgggcaagctgttcatcgaccccgagcagatccaggtgggcctggtgcagtacggcgagagccccgtgcacgagtggagcctgggcgacttcagaaccaaggaggaggtggtgagagccgccaagaacctgagcagaagagagggcagagagaccaagaccgcccaggccatcatggtggcctgcaccgagggcttcagccagagccacggcggcagacccgaggccgccagactgctggtggtggtgaccgacggcgagagccacgacggcgaggagctgcccgccgccctgaaggcctgcgaggccggcagagtgaccagatacggcatcgccgtgctgggccactacctgagaagacagagagaccccagcagcttcctgagagagatcagaaccatcgccagcgaccccgacgagagattcttcttcaacgtgaccgacgaggccgccctgaccgacatcgtggacgccctgggcgacagaatcttcggcctggagggcagccacgccgagaacgagagcagcttcggcctggagatgagccagatcggcttcagcacccacagactgaaggacggcatcctgttcggcatggtgggcgcctacgactggggcggcagcgtgctgtggctggagggcggccacagactgttcccccccagaatggccctggaggacgagttcccccccgccctgcagaaccacgccgcctacctgggctacagcgtgagcagcatgctgctgagaggcggcagaagactgttcctgagcggcgcccccagattcagacacagaggcaaggtgatcgccttccagctgaagaaggacggcgccgtgagagtggcccagagcctgcagggcgagcagatcggcagctacttcggcagcgagctgtgccccctggacaccgacagagacggcaccaccgacgtgctgctggtggccgcccccatgttcctgggcccccagaacaaggagaccggcagagtgtacgtgtacctggtgggccagcagagcctgctgaccctgcagggcaccctgcagcccgagcccccccaggacgccagattcggcttcgccatgggcgccctgcccgacctgaaccaggacggcttcgccgacgtggccgtgggcgcccccctggaggacggccaccagggcgccctgtacctgtaccacggcacccagagcggcgtgagaccccaccccgcccagagaatcgccgccgccagcatgccccacgccctgagctacttcggcagaagcgtggacggcagactggacctggacggcgacgacctggtggacgtggccgtgggcgcccagggcgccgccatcctgctgagcagcagacccatcgtgcacctgacccccagcctggaggtgaccccccaggccatcagcgtggtgcagagagactgcagaagaagaggccaggaggccgtgtgcctgaccgccgccctgtgcttccaggtgaccagcagaacccccggcagatgggaccaccagttctacatgagattcaccgccagcctggacgagtggaccgccggcgccagagccgccttcgacggcagcggccagagactgagccccagaagactgagactgagcgtgggcaacgtgacctgcgagcagctgcacttccacgtgctggacaccagcgactacctgagacccgtggccctgaccgtgaccttcgccctggacaacaccaccaagcccggccccgtgctgaacgagggcagccccaccagcatccagaagctggtgcccttcagcaaggactgcggccccgacaacgagtgcgtgaccgacctggtgctgcaggtgaacatggacatcagaggcagcagaaaggcccccttcgtggtgagaggcggcagaagaaaggtgctggtgagcaccaccctggagaacagaaaggagaacgcctacaacaccagcctgagcctgatcttcagcagaaacctgcacctggccagcctgaccccccagagagagagccccatcaaggtggagtgcgccgcccccagcgcccacgccagactgtgcagcgtgggccaccccgtgttccagaccggcgccaaggtgaccttcctgctggagttcgagttcagctgcagcagcctgctgagccaggtgttcgtgaagctgaccgccagcagcgacagcctggagagaaacggcaccctgcaggacaacaccgcccagaccagcgcctacatccagtacgagccccacctgctgttcagcagcgagagcaccctgcacagatacgaggtgcacccctacggcaccctgcccgtgggccccggccccgagttcaagaccaccctgagagtgcagaacctgggctgctacgtggtgagcggcctgatcatcagcgccctgctgcccgccgtggcccacggcggcaactacttcctgagcctgagccaggtgatcaccaacaacgccagctgcatcgtgcagaacctgaccgagccccccggcccccccgtgcaccccgaggagctgcagcacaccaacagactgaacggcagcaacacccagtgccaggtggtgagatgccacctgggccagctggccaagggcaccgaggtgagcgtgggcctgctgagactggtgcacaacgagttcttcagaagagccaagttcaagagcctgaccgtggtgagcaccttcgagctgggcaccgaggagggcagcgtgctgcagctgaccgaggccagcagatggagcgagagcctgctggaggtggtgcagaccagacccatcctgatcagcctgtggatcctgatcggcagcgtgctgggcggcctgctgctgctggccctgctggtgttctgcctgtggaagctgggcttcttcgcccacaagaagatccccgaggaggagaagagagaggagaagctggagcagtag

SEQ ID NO: 18846 - DNA, 3288 bp, Artificial Sequence
  Description of Artificial Sequence: Synthetic coding sequence
atgaacatcacccacgcctacagccagggccaccagaagctgaacctggacaccgtgagctacaacatgctgggcgtggacagcgacggctgctggtgggccccccccggcatgggcctgcaggccaccggcggcggcgcccacaacgccccctgcgccaagggccacctgggcgactaccagctgggcaacagcagccaccccgccgtgaacatgcacctgggcatgagcctgctggagaccgacggcgacggcggcttcatggcctgcgcccccctgtggagcagagcctgcggcagcagcgtgttcagcagcggcatctgcgccagagtggacgccagcttccagccccagggcagcctggcccccaccgcccagagatgccccacctacatggacgtggtgatcgtgctggacggcagcaacagcatctacccctggagcgaggtgcagaccttcctgagaagactggtgggcaagctgttcatcgaccccgagcagatccaggtgggcctggtgcagtacggcgagagccccgtgcacgagtggagcctgggcgacttcagaaccaaggaggaggtggtgagagccgccaagaacctgagcagaagagagggcagagagaccaagaccgcccaggccatcatggtggcctgcaccgagggcttcagccagagccacggcggcagacccgaggccgccagactgctggtggtggtgaccgacggcgagagccacgacggcgaggagctgcccgccgccctgaaggcctgcgaggccggcagagtgaccagatacggcatcgccgtgctgggccactacctgagaagacagagagaccccagcagcttcctgagagagatcagaaccatcgccagcgaccccgacgagagattcttcttcaacgtgaccgacgaggccgccctgaccgacatcgtggacgccctgggcgacagaatcttcggcctggagggcagccacgccgagaacgagagcagcttcggcctggagatgagccagatcggcttcagcacccacagactgaaggacggcatcctgttcggcatggtgggcgcctacgactggggcggcagcgtgctgtggctggagggcggccacagactgttcccccccagaatggccctggaggacgagttcccccccgccctgcagaaccacgccgcctacctgggctacagcgtgagcagcatgctgctgagaggcggcagaagactgttcctgagcggcgcccccagattcagacacagaggcaaggtgatcgccttccagctgaagaaggacggcgccgtgagagtggcccagagcctgcagggcgagcagatcggcagctacttcggcagcgagctgtgccccctggacaccgacagagacggcaccaccgacgtgctgctggtggccgcccccatgttcctgggcccccagaacaaggagaccggcagagtgtacgtgtacctggtgggccagcagagcctgctgaccctgcagggcaccctgcagcccgagcccccccaggacgccagattcggcttcgccatgggcgccctgcccgacctgaaccaggacggcttcgccgacgtggccgtgggcgcccccctggaggacggccaccagggcgccctgtacctgtaccacggcacccagagcggcgtgagaccccaccccgcccagagaatcgccgccgccagcatgccccacgccctgagctacttcggcagaagcgtggacggcagactggacctggacggcgacgacctggtggacgtggccgtgggcgcccagggcgccgccatcctgctgagcagcagacccatcgtgcacctgacccccagcctggaggtgaccccccaggccatcagcgtggtgcagagagactgcagaagaagaggccaggaggccgtgtgcctgaccgccgccctgtgcttccaggtgaccagcagaacccccggcagatgggaccaccagttctacatgagattcaccgccagcctggacgagtggaccgccggcgccagagccgccttcgacggcagcggccagagactgagccccagaagactgagactgagcgtgggcaacgtgacctgcgagcagctgcacttccacgtgctggacaccagcgactacctgagacccgtggccctgaccgtgaccttcgccctggacaacaccaccaagcccggccccgtgctgaacgagggcagccccaccagcatccagaagctggtgcccttcagcaaggactgcggccccgacaacgagtgcgtgaccgacctggtgctgcaggtgaacatggacatcagaggcagcagaaaggcccccttcgtggtgagaggcggcagaagaaaggtgctggtgagcaccaccctggagaacagaaaggagaacgcctacaacaccagcctgagcctgatcttcagcagaaacctgcacctggccagcctgaccccccagagagagagccccatcaaggtggagtgcgccgcccccagcgcccacgccagactgtgcagcgtgggccaccccgtgttccagaccggcgccaaggtgaccttcctgctggagttcgagttcagctgcagcagcctgctgagccaggtgttcgtgaagctgaccgccagcagcgacagcctggagagaaacggcaccctgcaggacaacaccgcccagaccagcgcctacatccagtacgagccccacctgctgttcagcagcgagagcaccctgcacagatacgaggtgcacccctacggcaccctgcccgtgggccccggccccgagttcaagaccaccctgagagtgcagaacctgggctgctacgtggtgagcggcctgatcatcagcgccctgctgcccgccgtggcccacggcggcaactacttcctgagcctgagccaggtgatcaccaacaacgccagctgcatcgtgcagaacctgaccgagccccccggcccccccgtgcaccccgaggagctgcagcacaccaacagactggccaagttcaagagcctgaccgtggtgagcaccttcgagctgggcaccgaggagggcagcgtgctgcagctgaccgaggccagcagatggagcgagagcctgctggaggtggtgcagaccagacccatcctgatcagcctgtggatcctgatcggcagcgtgctgggcggcctgctgctgctggccctgctggtgttctgcctgtggaagctgggcttcttcgcccacaagaagatccccgaggaggagaagagagaggagaagctggagcagtag

SEQ ID NO: 18847 - DNA, 3192 bp, Artificial Sequence
  Description of Artificial Sequence: Synthetic coding sequence
atgagccccggcgccagcagaggccccagaggcagccaggcccccctgatcgcccccctgtgctgcgccgccgccgccctgggcatgctgctgtggagccccgcctgccaggccttcaacctggacgtggagaagctgaccgtgtacagcggccccaagggcagctacttcggctacgccgtggacttccacatccccgacgccagaaccgccagcgtgctggtgggcgcccccaaggccaacaccagccagcccgacatcgtggagggcggcgccgtgtactactgcccctggcccgccgagggcagcgcccagtgcagacagatccccttcgacaccaccaacaacagaaagatcagagtgaacggcaccaaggagcccatcgagttcaagagcaaccagtggttcggcgccaccgtgaaggcccacaagggcaaggtggtggcctgcgcccccctgtaccactggagaaccctgaagcccacccccgagaaggaccccgtgggcacctgctacgtggccatccagaacttcagcgcctacgccgagttcagcccctgcagaaacagcaacgccgaccccgagggccagggctactgccaggccggcttcagcctggacttctacaagaacggcgacctgatcgtgggcggccccggcagcttctactggcagggccaggtgatcaccgccagcgtggccgacatcatcgccaactacagcttcaaggacatcctgagaaagctggccggcgagaagcagaccgaggtggcccccgccagctacgacgacagctacctgggctacagcgtggccgccggcgagttcaccggcgacagccagcaggagctggtggccggcatccccagaggcgcccagaacttcggctacgtgagcatcatcaacagcaccgacatgaccttcatccagaacttcaccggcgagcagatggccagctacttcggctacaccgtggtggtgagcgacgtgaacagcgacggcctggacgacgtgctggtgggcgcccccctgttcatggagagagagttcgagagcaaccccagagaggtgggccagatctacctgtacctgcaggtgagcagcctgctgttcagagacccccagatcctgaccggcaccgagaccttcggcagattcggcagcgccatggcccacctgggcgacctgaaccaggacggctacaacgacatcgccatcggcgtgcccttcgccggcaaggaccagagaggcaaggtgctgatctacaacggcaacaaggacggcctgaacaccaagcccagccaggtgctgcagggcgtgtgggccagccacgccgtgcccagcggcttcggcttcaccctgagaggcgacagcgacatcgacaagaacgactaccccgacctgatcgtgggcgccttcggcaccggcaaggtggccgtgtacagagccagacccgtggtgaccgtggacgcccagctgctgctgcaccccatgatcatcaacctggagaacaagacctgccaggtgcccgacagcatgaccagcgccgcctgcttcagcctgagagtgtgcgccagcgtgaccggccagagcatcgccaacaccatcgtgctgatggccgaggtgcagctggacagcctgaagcagaagggcgccatcaagagaaccctgttcctggacaaccaccaggcccacagagtgttccccctggtgatcaagagacagaagagccaccagtgccaggacttcatcgtgtacctgagagacgagaccgagttcagagacaagctgagccccatcaacatcagcctgaactacagcctggacgagagcaccttcaaggagggcctggaggtgaagcccatcctgaactactacagagagaacatcgtgagcgagcaggcccacatcctggtggactgcggcgaggacaacctgtgcgtgcccgacctgaagctgagcgccagacccgacaagcaccaggtgatcatcggcgacgagaaccacctgatgctgatcatcaacgccagaaacgagggcgagggcgcctacgaggccgagctgttcgtgatgatccccgaggaggccgactacgtgggcatcgagagaaacaacaagggcttcagacccctgagctgcgagtacaagatggagaacgtgaccagaatggtggtgtgcgacctgggcaaccccatggtgagcggcaccaactacagcctgggcctgagattcgccgtgcccagactggagaagaccaacatgagcatcaacttcgacctgcagatcagaagcagcaacaaggacaaccccgacagcaacttcgtgagcctgcagatcaacatcaccgccgtggcccaggtggagatcagaggcgtgagccaccccccccagatcgtgctgcccatccacaactgggagcccgaggaggagccccacaaggaggaggaggtgggccccctggtggagcacatctacgagctgcacaacatcggccccagcaccatcagcgacaccatcctggaggtgggctggcccttcagcgccagagacgagttcctgctgtacatcttccacatccagaccctgggccccctgcagtgccagcccaaccccaacatcaacccccaggacatcaagcccgccgccagccccgaggacacccccgagctgagcgccttcctgagaaacagcaccatcccccacctggtgagaaagagagacgtgcacgtggtggagttccacagacagagccccgccaagatcctgaactgcaccaacatcgagtgcctgcagatcagctgcgccgtgggcagactggagggcggcgagagcgccgtgctgaaggtgagaagcagactgtgggcccacaccttcctgcagagaaagaacgacccctacgccctggccagcctggtgagcttcgaggtgaagaagatgccctacaccgaccagcccgccaagctgcccgagggcagcatcgtgatcaagaccagcgtgatctgggccacccccaacgtgagcttcagcatccccctgtgggtgatcatcctggccatcctgctgggcctgctggtgctggccatcctgaccctggccctgtggaagtgcggcttcttcgacagagccagacccccccaggaggacatgaccgacagagagcagctgaccaacgacaagacccccgaggcctag

SEQ ID NO: 18848 - DNA, 3147 bp, Artificial Sequence
  Description of Artificial Sequence: Synthetic coding sequence
atgagccccggcgccagcagaggccccagaggcagccaggcccccctgatcgcccccctgtgctgcgccgccgccgccctgggcatgctgctgtggagccccgcctgccaggccttcaacctggacgtggagaagctgaccgtgtacagcggccccaagggcagctacttcggctacgccgtggacttccacatccccgacgccagaaccgccagcgtgctggtgggcgcccccaaggccaacaccagccagcccgacatcgtggagggcggcgccgtgtactactgcccctggcccgccgagggcagcgcccagtgcagacagatccccttcgacaccaccaacaacagaaagatcagagtgaacggcaccaaggagcccatcgagttcaagagcaaccagtggttcggcgccaccgtgaaggcccacaagggcaaggtggtggcctgcgcccccctgtaccactggagaaccctgaagcccacccccgagaaggaccccgtgggcacctgctacgtggccatccagaacttcagcgcctacgccgagttcagcccctgcagaaacagcaacgccgaccccgagggccagggctactgccaggccggcttcagcctggacttctacaagaacggcgacctgatcgtgggcggccccggcagcttctactggcagggccaggtgatcaccgccagcgtggccgacatcatcgccaactacagcttcaaggacatcctgagaaagctggccggcgagaagcagaccgaggtggcccccgccagctacgacgacagctacctggagctggtggccggcatccccagaggcgcccagaacttcggctacgtgagcatcatcaacagcaccgacatgaccttcatccagaacttcaccggcgagcagatggccagctacttcggctacaccgtggtggtgagcgacgtgaacagcgacggcctggacgacgtgctggtgggcgcccccctgttcatggagagagagttcgagagcaaccccagagaggtgggccagatctacctgtacctgcaggtgagcagcctgctgttcagagacccccagatcctgaccggcaccgagaccttcggcagattcggcagcgccatggcccacctgggcgacctgaaccaggacggctacaacgacatcgccatcggcgtgcccttcgccggcaaggaccagagaggcaaggtgctgatctacaacggcaacaaggacggcctgaacaccaagcccagccaggtgctgcagggcgtgtgggccagccacgccgtgcccagcggcttcggcttcaccctgagaggcgacagcgacatcgacaagaacgactaccccgacctgatcgtgggcgccttcggcaccggcaaggtggccgtgtacagagccagacccgtggtgaccgtggacgcccagctgctgctgcaccccatgatcatcaacctggagaacaagacctgccaggtgcccgacagcatgaccagcgccgcctgcttcagcctgagagtgtgcgccagcgtgaccggccagagcatcgccaacaccatcgtgctgatggccgaggtgcagctggacagcctgaagcagaagggcgccatcaagagaaccctgttcctggacaaccaccaggcccacagagtgttccccctggtgatcaagagacagaagagccaccagtgccaggacttcatcgtgtacctgagagacgagaccgagttcagagacaagctgagccccatcaacatcagcctgaactacagcctggacgagagcaccttcaaggagggcctggaggtgaagcccatcctgaactactacagagagaacatcgtgagcgagcaggcccacatcctggtggactgcggcgaggacaacctgtgcgtgcccgacctgaagctgagcgccagacccgacaagcaccaggtgatcatcggcgacgagaaccacctgatgctgatcatcaacgccagaaacgagggcgagggcgcctacgaggccgagctgttcgtgatgatccccgaggaggccgactacgtgggcatcgagagaaacaacaagggcttcagacccctgagctgcgagtacaagatggagaacgtgaccagaatggtggtgtgcgacctgggcaaccccatggtgagcggcaccaactacagcctgggcctgagattcgccgtgcccagactggagaagaccaacatgagcatcaacttcgacctgcagatcagaagcagcaacaaggacaaccccgacagcaacttcgtgagcctgcagatcaacatcaccgccgtggcccaggtggagatcagaggcgtgagccaccccccccagatcgtgctgcccatccacaactgggagcccgaggaggagccccacaaggaggaggaggtgggccccctggtggagcacatctacgagctgcacaacatcggccccagcaccatcagcgacaccatcctggaggtgggctggcccttcagcgccagagacgagttcctgctgtacatcttccacatccagaccctgggccccctgcagtgccagcccaaccccaacatcaacccccaggacatcaagcccgccgccagccccgaggacacccccgagctgagcgccttcctgagaaacagcaccatcccccacctggtgagaaagagagacgtgcacgtggtggagttccacagacagagccccgccaagatcctgaactgcaccaacatcgagtgcctgcagatcagctgcgccgtgggcagactggagggcggcgagagcgccgtgctgaaggtgagaagcagactgtgggcccacaccttcctgcagagaaagaacgacccctacgccctggccagcctggtgagcttcgaggtgaagaagatgccctacaccgaccagcccgccaagctgcccgagggcagcatcgtgatcaagaccagcgtgatctgggccacccccaacgtgagcttcagcatccccctgtgggtgatcatcctggccatcctgctgggcctgctggtgctggccatcctgaccctggccctgtggaagtgcggcttcttcgacagagccagacccccccaggaggacatgaccgacagagagcagctgaccaacgacaagacccccgaggcctag

SEQ ID NO: 18849 - DNA, 3540 bp, Artificial Sequence
  Description of Artificial Sequence: Synthetic coding sequence
atgtggctgttccacaccctgctgtgcatcgccagcctggccctgctggccgccttcaacgtggacgtggccagaccctggctgacccccaagggcggcgcccccttcgtgctgagcagcctgctgcaccaggaccccagcaccaaccagacctggctgctggtgaccagccccagaaccaagagaacccccggccccctgcacagatgcagcctggtgcaggacgagatcctgtgccaccccgtggagcacgtgcccatccccaagggcagacacagaggcgtgaccgtggtgagaagccaccacggcgtgctgatctgcatccaggtgctggtgagaagaccccacagcctgagcagcgagctgaccggcacctgcagcctgctgggccccgacctgagaccccaggcccaggccaacttcttcgacctggagaacctgctggaccccgacgccagagtggacaccggcgactgctacagcaacaaggagggcggcggcgaggacgacgtgaacaccgccagacagagaagagccctggagaaggaggaggaggaggacaaggaggaggaggaggacgaggaggaggaggaggccggcaccgagatcgccatcatcctggacggcagcggcagcatcgacccccccgacttccagagagccaaggacttcatcagcaacatgatgagaaacttctacgagaagtgcttcgagtgcaacttcgccctggtgcagtacggcggcgtgatccagaccgagttcgacctgagagacagccaggacgtgatggccagcctggccagagtgcagaacatcacccaggtgggcagcgtgaccaagaccgccagcgccatgcagcacgtgctggacagcatcttcaccagcagccacggcagcagaagaaaggccagcaaggtgatggtggtgctgaccgacggcggcatcttcgaggaccccctgaacctgaccaccgtgatcaacagccccaagatgcagggcgtggagagattcgccatcggcgtgggcgaggagttcaagagcgccagaaccgccagagagctgaacctgatcgccagcgaccccgacgagacccacgccttcaaggtgaccaactacatggccctggacggcctgctgagcaagctgagatacaacatcatcagcatggagggcaccgtgggcgacgccctgcactaccagctggcccagatcggcttcagcgcccagatcctggacgagagacaggtgctgctgggcgccgtgggcgccttcgactggagcggcggcgccctgctgtacgacaccagaagcagaagaggcagattcctgaaccagaccgccgccgccgccgccgacgccgaggccgcccagtacagctacctgggctacgccgtggccgtgctgcacaagacctgcagcctgagctacatcgccggcgcccccagatacaagcaccacggcgccgtgttcgagctgcagaaggagggcagagaggccagcttcctgcccgtgctggagggcgagcagatgggcagctacttcggcagcgagctgtgccccgtggacatcgacatggacggcagcaccgacttcctgctggtggccgcccccttctaccacgtgcacggcgaggagggcagagtgtacgtgtacagactgagcgagcaggacggcagcttcagcctggccagaatcctgagcggccaccccggcttcaccaacgccagattcggcttcgccatggccgccatgggcgacctgagccaggacaagctgaccgacgtggccatcggcgcccccctggagggcttcggcgccgacgacggcgccagcttcggcagcgtgtacatctacaacggccactgggacggcctgagcgccagccccagccagagaatcagagccagcaccgtggcccccggcctgcagtacttcggcatgagcatggccggcggcttcgacatcagcggcgacggcctggccgacatcaccgtgggcaccctgggccaggccgtggtgttcagaagcagacccgtggtgagactgaaggtgagcatggccttcacccccagcgccctgcccatcggcttcaacggcgtggtgaacgtgagactgtgcttcgagatcagcagcgtgaccaccgccagcgagagcggcctgagagaggccctgctgaacttcaccctggacgtggacgtgggcaagcagagaagaagactgcagtgcagcgacgtgagaagctgcctgggctgcctgagagagtggagcagcggcagccagctgtgcgaggacctgctgctgatgcccaccgagggcgagctgtgcgaggaggactgcttcagcaacgccagcgtgaaggtgagctaccagctgcagacccccgagggccagaccgaccacccccagcccatcctggacagatacaccgagcccttcgccatcttccagctgccctacgagaaggcctgcaagaacaagctgttctgcgtggccgagctgcagctggccaccaccgtgagccagcaggagctggtggtgggcctgaccaaggagctgaccctgaacatcaacctgaccaacagcggcgaggacagctacatgaccagcatggccctgaactaccccagaaacctgcagctgaagagaatgcagaagccccccagccccaacatccagtgcgacgacccccagcccgtggccagcgtgctgatcatgaactgcagaatcggccaccccgtgctgaagagaagcagcgcccacgtgagcgtggtgtggcagctggaggagaacgccttccccaacagaaccgccgacatcaccgtgaccgtgaccaacagcaacgagagaagaagcctggccaacgagacccacaccctgcagttcagacacggcttcgtggccgtgctgagcaagcccagcatcatgtacgtgaacaccggccagggcctgagccaccacaaggagttcctgttccacgtgcacggcgagaacctgttcggcgccgagtaccagctgcagatctgcgtgcccaccaagctgagaggcctgcaggtggtggccgtgaagaagctgaccagaacccaggccagcaccgtgtgcacctggagccaggagagagcctgcgcctacagcagcgtgcagcacgtggaggagtggcacagcgtgagctgcgtgatcgccagcgacaaggagaacgtgaccgtggccgccgagatcagctgggaccacagcgaggagctgctgaaggacgtgaccgagctgcagatcctgggcgagatcagcttcaacaagagcctgtacgagggcctgaacgccgagaaccacagaaccaagatcaccgtggtgttcctgaaggacgagaagtaccacagcctgcccatcatcatcaagggcagcgtgggcggcctgctggtgctgatcgtgatcctggtgatcctgttcaagtgcggcttcttcaagagaaagtaccagcagctgaacctggagagcatcagaaaggcccagctgaagagcgagaacctgctggaggaggagaactag

SEQ ID NO: 18850 - DNA, 2400 bp, Artificial Sequence
  Description of Artificial Sequence: Synthetic coding sequence
atgcccagagcccccgcccccctgtacgcctgcctgctgggcctgtgcgccctgctgcccagactggccggcctgaacatctgcaccagcggcagcgccaccagctgcgaggagtgcctgctgatccaccccaagtgcgcctggtgcagcaaggaggacttcggcagccccagaagcatcaccagcagatgcgacctgagagccaacctggtgaagaacggctgcggcggcgagatcgagagccccgccagcagcttccacgtgctgagaagcctgcccctgagcagcaagggcagcggcagcgccggctgggacgtgatccagatgaccccccaggagatcgccgtgaacctgagacccggcgacaagaccaccttccagctgcaggtgagacaggtggaggactaccccgtggacctgtactacctgatggacctgagcctgagcatgaaggacgacctggacaacatcagaagcctgggcaccaagctggccgaggagatgagaaagctgaccagcaacttcagactgggcttcggcagcttcgtggacaaggacatcagccccttcagctacaccgcccccagataccagaccaacccctgcatcggctacaagctgttccccaactgcgtgcccagcttcggcttcagacacctgctgcccctgaccgacagagtggacagcttcaacgaggaggtgagaaagcagagagtgagcagaaacagagacgcccccgagggcggcttcgacgccgtgctgcaggccgccgtgtgcaaggagaagatcggctggagaaaggacgccctgcacctgctggtgttcaccaccgacgacgtgccccacatcgccctggacggcaagctgggcggcctggtgcagccccacgacggccagtgccacctgaacgaggccaacgagtacaccgccagcaaccagatggactaccccagcctggccctgctgggcgagaagctggccgagaacaacatcaacctgatcttcgccgtgaccaagaaccactacatgctgtacaagaacttcaccgccctgatccccggcaccaccgtggagatcctggacggcgacagcaagaacatcatccagctgatcatcaacgcctacaacagcatcagaagcaaggtggagctgagcgtgtgggaccagcccgaggacctgaacctgttcttcaccgccacctgccaggacggcgtgagctaccccggccagagaaagtgcgagggcctgaagatcggcgacaccgccagcttcgaggtgagcctggaggccagaagctgccccagcagacacaccgagcacgtgttcgccctgagacccgtgggcttcagagacagcctggaggtgggcgtgacctacaactgcacctgcggctgcagcgtgggcctggagcccaacagcgccagatgcaacggcagcggcacctacgtgtgcggcctgtgcgagtgcagccccggctacctgggcaccagatgcgagtgccaggacggcgagaaccagagcgtgtaccagaacctgtgcagagaggccgagggcaagcccctgtgcagcggcagaggcgactgcagctgcaaccagtgcagctgcttcgagagcgagttcggcaagatctacggccccttctgcgagtgcgacaacttcagctgcgccagaaacaagggcgtgctgtgcagcggccacggcgagtgccactgcggcgagtgcaagtgccacgccggctacatcggcgacaactgcaactgcagcaccgacatcagcacctgcagaggcagagacggccagatctgcagcgagagaggccactgcctgtgcggccagtgccagtgcaccgagcccggcgccttcggcgagatgtgcgagaagtgccccacctgccccgacgcctgcagcaccaagagagactgcgtggagtgcctgctgctgcacagcggcaagcccgacaaccagacctgccacagcctgtgcagagacgaggtgatcacctgggtggacaccatcgtgaaggacgaccaggaggccgtgctgtgcttctacaagaccgccaaggactgcgtgatgatgttcacctacgtggagctgcccagcggcaagagcaacctgaccgtgctgagagagcccgagtgcggcaacacccccaacgccatgaccatcctgctggccgtggtgggcagcatcctgctggtgggcctggccctgctggccatctggaagctgctggtgaccatccacgacagaagagagttcgccaagttccagagcgagagaagcagagccagatacgagatggccagcaaccccctgtacagaaagcccatcagcacccacaccgtggacttcaccttcaacaagttcaacaagagctacaacggcaccgtggactag

SEQ ID NO: 18851 - DNA, 1065 bp, Artificial Sequence
  Description of Artificial Sequence: Synthetic coding sequence
atgggcagactggtggccgtgggcctgctgggcatcgccctggccctgctgggcgagagactgctggccctgagaaacagactgaaggccagcagagaggtggagagcgtggacctgccccactgccacctgatcaagggcatcgaggccggcagcgaggacatcgacatcctgcccaacggcctggccttcttcagcgtgggcctgaagttccccggcctgcacagcttcgcccccgacaagcccggcggcatcctgatgatggacctgaaggaggagaagcccagagccagagagctgagaatcagcagaggcttcgacctggccagcttcaacccccacggcatcagcaccttcatcgacaacgacgacaccgtgtacctgttcgtggtgaaccaccccgagttcaagaacaccgtggagatcttcaagttcgaggaggccgagaacagcctgctgcacctgaagaccgtgaagcacgagctgctgcccagcgtgaacgacatcaccgccgtgggccccgcccacttctacgccaccaacgaccactacttcagcgaccccttcctgaagtacctggagacctacctgaacctgcactgggccaacgtggtgtactacagccccaacgaggtgaaggtggtggccgagggcttcgacagcgccaacggcatcaacatcagccccgacgacaagtacatctacgtggccgacatcctggcccacgagatccacgtgctggagaagcacaccaacatgaacctgacccagctgaaggtgctggagctggacaccctggtggacaacctgagcatcgaccccagcagcggcgacatctgggtgggctgccaccccaacggccagaagctgttcgtgtacgaccccaacaacccccccagcagcgaggtgctgagaatccagaacatcctgagcgagaagcccaccgtgaccaccgtgtacgccaacaacggcagcgtgctgcagggcagcagcgtggccagcgtgtacgacggcaagctgctgatcggcaccctgtaccacagagccctgtactgcgagctgtag

SEQ ID NO: 18852 - DNA, 1905 bp, Artificial Sequence
  Description of Artificial Sequence: Synthetic coding sequence
atgctgaaggtgcaccccctgaagaagtaccccgtggacctgtactacctggtggacgtgagcgccagcatgcacaacaacatcgagaagctgaacagcgtgggcaacgacctgagcagaaagatggccttcttcagcagagacttcagactgggcttcggcagctacgtggacaagaccgtgagcccctacatcagcatccaccccgagagaatccacaaccagtgcagcgactacaacctggactgcatgcccccccacggctacatccacgtgctgagcctgaccgagaacatcaccgagttcgagaaggccgtgcacagacagaagatcagcggcaacatcgacacccccgagggcggcttcgacgccatgctgcaggccgccgtgtgcgagagccacatcggctggagaaaggaggccaagagactgctgctggtgatgaccgaccagaccagccacctggccctggacagcaagctggccggcatcgtggtgcccaacgacggcaactgccacctgaagaacaacgtgtacgtgaagagcaccaccatggagcaccccagcctgggccagctgagcgagaagctgatcgacaacaacatcaacgtgatcttcgccgtgcagggcaagcagttccactggtacaaggacctgctgcccctgctgcccggcaccatcgccggcgagatcgagagcaaggccgccaacctgaacaacctggtggtggaggcctaccagaagctgatcagcgaggtgaaggtgcaggtggagaaccaggtgcagggcatctacttcaacatcaccgccatctgccccgacggcagcagaaagcccggcatggagggctgcagaaacgtgaccagcaacgacgaggtgctgttcaacgtgaccgtgaccatgaagaagtgcgacgtgaccggcggcaagaactacgccatcatcaagcccatcggcttcaacgagaccgccaagatccacatccacagaaactgcagctgccagtgcgaggacaacagaggccccaagggcaagtgcgtggacgagaccttcctggacagcaagtgcttccagtgcgacgagaacaagtgccacttcgacgaggaccagttcagcagcgagagctgcaagagccacaaggaccagcccgtgtgcagcggcagaggcgtgtgcgtgtgcggcaagtgcagctgccacaagatcaagctgggcaaggtgtacggcaagtactgcgagaaggacgacttcagctgcccctaccaccacggcaacctgtgcgccggccacggcgagtgcgaggccggcagatgccagtgcttcagcggctgggagggcgacagatgccagtgccccagcgccgccgcccagcactgcgtgaacagcaagggccaggtgtgcagcggcagaggcacctgcgtgtgcggcagatgcgagtgcaccgaccccagaagcatcggcagattctgcgagcactgccccacctgctacaccgcctgcaaggagaactggaactgcatgcagtgcctgcacccccacaacctgagccaggccatcctggaccagtgcaagaccagctgcgccctgatggagcagcagcactacgtggaccagaccagcgagtgcttcagcagccccagctacctgagaatcttcttcatcatcttcatcgtgaccttcctgatcggcctgctgaaggtgctgatcatcagacaggtgatcctgcagtggaacagcaacaagatcaagagcagcagcgactacagagtgagcgccagcaagaaggacaagctgatcctgcagagcgtgtgcaccagagccgtgacctacagaagagagaagcccgaggagatcaagatggacatcagcaagctgaacgcccacgagaccttcagatgcaacttctag

SEQ ID NO: 18853 - DNA, 1314 bp, Artificial Sequence
  Description of Artificial Sequence: Synthetic coding sequence
atgaccagctacatggccatcgacggcagcgccctggtgcccctgagacagaagcccagaagaaagacccagggcttcctgaccatgagcagaagaagaatcagctgcaaggacctgggccacgccgactgccagggctggctgtacaagaagaaggagaagggcagcttcctgagcaacaagtggaagaagttctgggtgatcctgaagggcagcagcctgtactggtacagcaaccagatggccgagaaggccgacggcttcgtgaacctgcccgacttcaccgtggagagagccagcgagtgcaagaagaagcacgccttcaagatcagccacccccagatcaagaccttctacttcgccgccgagaacgtgcaggagatgaacgtgtggctgaacaagctgggcagcgccgtgatccaccaggagagcaccaccaaggacgaggagtgctacagcgagagcgagcaggaggaccccgagatcgccgccgagacccccccccccccccacgccagccagacccagagcctgaccgcccagcaggccagcagcagcagccccagcctgagcggcaccagctacagcttcagcagcctggagaacaccgtgaagacccccagcagcttccccagcagcctgagcaaggagagacagagcctgcccgacaccgtgaacagcctgagcgccgccgaggacgagggccagcccatcaccttcgccgtgcaggtgcacagccccgtgcccagcgaggccggcatccacaaggccctggagaacagcttcgtgaccagcgagagcggcttcctgaacagcctgagcagcgacgacaccagcagcctgagcagcaaccacgaccacctgaccgtgcccgacaagcccgccggcagcaagatcatggacaaggaggagaccaaggtgagcgaggacgacgagatggagaagctgtacaagagcctggagcaggccagcctgagccccctgggcgacagaagacccagcaccaagaaggagctgagaaagagcttcgtgaagagatgcaagaaccccagcatcaacgagaagctgcacaagatcagaaccctgaacagcaccctgaagtgcaaggagcacgacctggccatgatcaaccagctgctggacgaccccaagctgaccgccagaaagtacagagagtggaaggtgatgaacaccctgctgatccaggacatctaccagcagcagagagccagccccgcccccgacgacaccgacgacaccccccaggagctgaagaagagccccagcagccccagcgtggagaacagcatctag

SEQ ID NO: 18854 - DNA, 1317 bp, Artificial Sequence
  Description of Artificial Sequence: Synthetic coding sequence
atgaccagctacatggccatcgacggcagcgccctgcaggtgcccctgagacagaagcccagaagaaagacccagggcttcctgaccatgagcagaagaagaatcagctgcaaggacctgggccacgccgactgccagggctggctgtacaagaagaaggagaagggcagcttcctgagcaacaagtggaagaagttctgggtgatcctgaagggcagcagcctgtactggtacagcaaccagatggccgagaaggccgacggcttcgtgaacctgcccgacttcaccgtggagagagccagcgagtgcaagaagaagcacgccttcaagatcagccacccccagatcaagaccttctacttcgccgccgagaacgtgcaggagatgaacgtgtggctgaacaagctgggcagcgccgtgatccaccaggagagcaccaccaaggacgaggagtgctacagcgagagcgagcaggaggaccccgagatcgccgccgagacccccccccccccccacgccagccagacccagagcctgaccgcccagcaggccagcagcagcagccccagcctgagcggcaccagctacagcttcagcagcctggagaacaccgtgaagacccccagcagcttccccagcagcctgagcaaggagagacagagcctgcccgacaccgtgaacagcctgagcgccgccgaggacgagggccagcccatcaccttcgccgtgcaggtgcacagccccgtgcccagcgaggccggcatccacaaggccctggagaacagcttcgtgaccagcgagagcggcttcctgaacagcctgagcagcgacgacaccagcagcctgagcagcaaccacgaccacctgaccgtgcccgacaagcccgccggcagcaagatcatggacaaggaggagaccaaggtgagcgaggacgacgagatggagaagctgtacaagagcctggagcaggccagcctgagccccctgggcgacagaagacccagcaccaagaaggagctgagaaagagcttcgtgaagagatgcaagaaccccagcatcaacgagaagctgcacaagatcagaaccctgaacagcaccctgaagtgcaaggagcacgacctggccatgatcaaccagctgctggacgaccccaagctgaccgccagaaagtacagagagtggaaggtgatgaacaccctgctgatccaggacatctaccagcagcagagagccagccccgcccccgacgacaccgacgacaccccccaggagctgaagaagagccccagcagccccagcgtggagaacagcatctag

SEQ ID NO: 18855 - DNA, 1317 bp, Artificial Sequence; identical to SEQ ID NO: 18854
  Description of Artificial Sequence: Synthetic coding sequence

SEQ ID NO: 18856 - DNA, 237 bp, Artificial Sequence
  Description of Artificial Sequence: Synthetic coding sequence
atgaccagctacatggccatcgacggcagcgccctggtgcccctgagacagaagcccagaagaaagacccagggcttcctgaccatgagcagaagaagaatcagctgcaaggacctgggccacgccgactgccagggctggctgtacaagaagaaggagaagggcagcttcctgagcaacaagtggaagaagttctgggtgatcctgaagggcagcagcctgtactggtacagctag

SEQ ID NO: 18857 - DNA, 396 bp, Artificial Sequence
  Description of Artificial Sequence: Synthetic coding sequence
atgttcagcgacaacagccactgccccgactgcggccagcagtggttccccagcctggagctgggccactggctgtaccagaccgagctggtggagaacgagtgctaccaggtgttcctggacagaatcaacagagccgactactgccccgagtgctaccccgacaaccccgccaacagaagcctggtgctgccctggagcttccccctggagtgggccccccagaacctgaccagatggaccttcgagaaggcctgccaccccttcctgctgggcccccccctggtgagaaagagaatccacgacagcagagtggccggcttcaaccccgccctgcagctgatcctgaccagaaccgacaagaccctgaacaagaagctgggccagaacaagtag

SEQ ID NO: 18858 - DNA, 687 bp, Artificial Sequence
  Description of Artificial Sequence: Synthetic coding sequence
atgagagagggcaagagaggccccccctgcatcctgagcttcagaggcaccctggagagagtggaggcccagtgggagctggaggcccagggccccggccagtgccccgcccccctgggcgaccccgccagcaccaccgacggcgcccaggaggccagagtgcccctggacggcgccttctggatccccagaccccccgccggcagccccaagggctgcttcgcctgcgtgagcaagccccccgccctgcaggcccccgccgcccccgcccccgagcccagcgccagcccccccatggcccccaccctgttccccatggagagcaagagcagcaagaccgacagcgtgagagccgccggcgccccccccgcctgcaagcacctggccgagaagaagaccatgaccaaccccaccaccgtgatcgaggtgtaccccgacaccaccgaggtgaacgactactacctgtggagcatcttcaacttcgtgtacctgaacttctgctgcctgggcttcatcgccctggcctacagcctgaaggtgagagacaagaagctgctgaacgacctgaacggcgccgtggaggacgccaagaccgccagactgttcaacatcaccagcagcgccctggccgccagctgcatcatcctggtgttcatcttcctgagataccccctgaccgactactag

SEQ ID NO: 18859 - DNA, 399 bp, Artificial Sequence
  Description of Artificial Sequence: Synthetic coding sequence
atggacaccgcctaccccagagaggacaccagagcccccacccccagcaaggccggcgcccacaccgccctgaccctgggcgccccccaccccccccccagagaccacctgatctggagcgtgttcagcaccctgtacctgaacctgtgctgcctgggcttcctggccctggcctacagcatcaaggccagagaccagaaggtggtgggcgacctggaggccgccagaagattcggcagcaaggccaagtgctacaacatcctggccgccatgtggaccctggtgccccccctgctgctgctgggcctggtggtgaccggcgccctgcacctggccagactggccaaggacagcgccgccttcttcagcaccaagttcgacgacgccgactacgactag

SEQ ID NO: 18860 - DNA, 1551 bp, Artificial Sequence
  Description of Artificial Sequence: Synthetic coding sequence
atgcccgtgcccgagagacccgccgccggccccgacagccccagacccggcaccagaagagccgcccccagagtgctgttcggcgagtggctgctgggcgagatcagcagcggctgctacgagggcctgcagtggctggacgaggccagaacctgcttcagagtgccctggaagcacttcgccagaaaggacctgagcgaggccgacgccagaatcttcaaggcctgggccgtggccagaggcagatggccccccagcagcagaggcggcggccccccccccgaggccgagaccgccgagagagccggctggaagaccaacttcagatgcgccctgagaagcaccagaagattcgtgatgctgagagacaacagcggcgaccccgccgacccccacaaggtgtacgccctgagcagagagctgtgctggagagagggccccggcaccgaccagaccgaggccgaggcccccgccgccgtgccccccccccagggcggcccccccggccccttcctggcccacacccacgccggcctgcaggcccccggccccctgcccgcccccgccggcgacaagggcgacctgctgctgcaggccgtgcagcagagctgcctggccgaccacctgctgaccgccagctggggcgccgaccccgtgcccaccaaggcccccggcgagggccaggagggcctgcccctgaccggcgcctgcgccggcggccccggcctgcccgccggcgagctgtacggctgggccgtggagaccacccccagccccggcccccagcccgccgccctgaccaccggcgaggccgccgcccccgagagcccccaccaggccgagccctacctgagccccagccccagcgcctgcaccgccgtgcaggagcccagccccggcgccctggacgtgaccatcatgtacaagggcagaaccgtgctgcagaaggtggtgggccaccccagctgcaccttcctgtacggcccccccgaccccgccgtgagagccaccgacccccagcaggtggccttccccagccccgccgagctgcccgaccagaagcagctgagatacaccgaggagctgctgagacacgtggcccccggcctgcacctggagctgagaggcccccagctgtgggccagaagaatgggcaagtgcaaggtgtactgggaggtgggcggcccccccggcagcgccagccccagcacccccgcctgcctgctgcccagaaactgcgacacccccatcttcgacttcagagtgttcttccaggagctggtggagttcagagccagacagagaagaggcagccccagatacaccatctacctgggcttcggccaggacctgagcgccggcagacccaaggagaagagcctggtgctggtgaagctggagccctggctgtgcagagtgcacctggagggcacccagagagagggcgtgagcagcctggacagcagcagcctgagcctgtgcctgagcagcgccaacagcctgtacgacgacatcgagtgcttcctgatggagctggagcagcccgcctag

SEQ ID NO: 18861 - DNA, 1425 bp, Artificial Sequence
  Description of Artificial Sequence: Synthetic coding sequence
atggccctggcccccgagagagccgcccccagagtgctgttcggcgagtggctgctgggcgagatcagcagcggctgctacgagggcctgcagtggctggacgaggccagaacctgcttcagagtgccctggaagcacttcgccagaaaggacctgagcgaggccgacgccagaatcttcaaggcctgggccgtggccagaggcagatggccccccagcagcagaggcggcggccccccccccgaggccgagaccgccgagagagccggctggaagaccaacttcagatgcgccctgagaagcaccagaagattcgtgatgctgagagacaacagcggcgaccccgccgacccccacaaggtgtacgccctgagcagagagctgtgctggagagagggccccggcaccgaccagaccgaggccgaggcccccgccgccgtgccccccccccagggcggcccccccggccccttcctggcccacacccacgccggcctgcaggcccccggccccctgcccgcccccgccggcgacaagggcgacctgctgctgcaggccgtgcagcagagctgcctggccgaccacctgctgaccgccagctggggcgccgaccccgtgcccaccaaggcccccggcgagggccaggagggcctgcccctgaccggcgcctgcgccggcggcgaggccgccgcccccgagagcccccaccaggccgagccctacctgagccccagccccagcgcctgcaccgccgtgcaggagcccagccccggcgccctggacgtgaccatcatgtacaagggcagaaccgtgctgcagaaggtggtgggccaccccagctgcaccttcctgtacggcccccccgaccccgccgtgagagccaccgacccccagcaggtggccttccccagccccgccgagctgcccgaccagaagcagctgagatacaccgaggagctgctgagacacgtggcccccggcctgcacctggagctgagaggcccccagctgtgggccagaagaatgggcaagtgcaaggtgtactgggaggtgggcggcccccccggcagcgccagccccagcacccccgcctgcctgctgcccagaaactgcgacacccccatcttcgacttcagagtgttcttccaggagctggtggagttcagagccagacagagaagaggcagccccagatacaccatctacctgggcttcggccaggacctgagcgccggcagacccaaggagaagagcctggtgctggtgaagctggagccctggctgtgcagagtgcacctggagggcacccagagagagggcgtgagcagcctggacagcagcagcctgagcctgtgcctgagcagcgccaacagcctgtacgacgacatcgagtgcttcctgatggagctggagcagcccgcctag

SEQ ID NO: 18862 - DNA, 633 bp, Artificial Sequence
  Description of Artificial Sequence: Synthetic coding sequence
atgtacaagggcagaaccgtgctgcagaaggtggtgggccaccccagctgcaccttcctgtacggcccccccgaccccgccgtgagagccaccgacccccagcaggtggccttccccagccccgccgagctgcccgaccagaagcagctgagatacaccgaggagctgctgagacacgtggcccccggcctgcacctggagctgagaggcccccagctgtgggccagaagaatgggcaagtgcaaggtgtactgggaggtgggcggcccccccggcagcgccagccccagcacccccgcctgcctgctgcccagaaactgcgacacccccatcttcgacttcagagtgttcttccaggagctggtggagttcagagccagacagagaagaggcagccccagatacaccatctacctgggcttcggccaggacctgagcgccggcagacccaaggagaagagcctggtgctggtgaagctggagccctggctgtgcagagtgcacctggagggcacccagagagagggcgtgagcagcctggacagcagcagcctgagcctgtgcctgagcagcgccaacagcctgtacgacgacatcgagtgcttcctgatggagctggagcagcccgcctag

SEQ ID NO: 18863 - DNA, 1551 bp, Artificial Sequence; identical to SEQ ID NO: 18860
  Description of Artificial Sequence: Synthetic coding sequence

SEQ ID NO: 18864 - DNA, 1425 bp, Artificial Sequence; identical to SEQ ID NO: 18861
  Description of Artificial Sequence: Synthetic coding sequence

SEQ ID NO: 18865 - DNA, 1512 bp, Artificial Sequence
  Description of Artificial Sequence: Synthetic coding sequence
atggccctggcccccgagagagccgcccccagagtgctgttcggcgagtggctgctgggcgagatcagcagcggctgctacgagggcctgcagtggctggacgaggccagaacctgcttcagagtgccctggaagcacttcgccagaaaggacctgagcgaggccgacgccagaatcttcaaggcctgggccgtggccagaggcagatggccccccagcagcagaggcggcggccccccccccgaggccgagaccgccgagagagccggctggaagaccaacttcagatgcgccctgagaagcaccagaagattcgtgatgctgagagacaacagcggcgaccccgccgacccccacaaggtgtacgccctgagcagagagctgtgctggagagagggccccggcaccgaccagaccgaggccgaggcccccgccgccgtgccccccccccagggcggcccccccggccccttcctggcccacacccacgccggcctgcaggcccccggccccctgcccgcccccgccggcgacaagggcgacctgctgctgcaggccgtgcagcagagctgcctggccgaccacctgctgaccgccagctggggcgccgaccccgtgcccaccaaggcccccggcgagggccaggagggcctgcccctgaccggcgcctgcgccggcggccccggcctgcccgccggcgagctgtacggctgggccgtggagaccacccccagccccggcccccagcccgccgccctgaccaccggcgaggccgccgcccccgagagcccccaccaggccgagccctacctgagccccagccccagcgcctgcaccgccgtgcaggagcccagccccggcgccctggacgtgaccatcatgtacaagggcagaaccgtgctgcagaaggtggtgggccaccccagctgcaccttcctgtacggcccccccgaccccgccgtgagagccaccgacccccagcaggtggccttccccagccccgccgagctgcccgaccagaagcagctgagatacaccgaggagctgctgagacacgtggcccccggcctgcacctggagctgagaggcccccagctgtgggccagaagaatgggcaagtgcaaggtgtactgggaggtgggcggcccccccggcagcgccagccccagcacccccgcctgcctgctgcccagaaactgcgacacccccatcttcgacttcagagtgttcttccaggagctggtggagttcagagccagacagagaagaggcagccccagatacaccatctacctgggcttcggccaggacctgagcgccggcagacccaaggagaagagcctggtgctggtgaagctggagccctggctgtgcagagtgcacctggagggcacccagagagagggcgtgagcagcctggacagcagcagcctgagcctgtgcctgagcagcgccaacagcctgtacgacgacatcgagtgcttcctgatggagctggagcagcccgcctag

SEQ ID NO: 18866 - DNA, 315 bp, Artificial Sequence
  Description of Artificial Sequence: Synthetic coding sequence
atgggcaaggagagcggctgggacagcggcagagccgccgtggccgccgtggtgggcggcgtggtggccgtgggcaccgtgctggtggccctgagcgccatgggcttcaccagcgtgggcatcgccgccagcagcatcgccgccaagatgatgagcaccgccgccatcgccaacggcggcggcgtggccgccggcagcctggtggccatcctgcagagcgtgggcgccgccggcctgagcgtgaccagcaaggtgatcggcggcttcgccggcaccgccctgggcgcctggctgggcagcccccccagcagctag

SEQ ID NO: 18867 - DNA, 315 bp, Artificial Sequence; identical to SEQ ID NO: 18866
  Description of Artificial Sequence: Synthetic coding sequence

SEQ ID NO: 18868 - DNA, 393 bp, Artificial Sequence
  Description of Artificial Sequence: Synthetic coding sequence
atgatgaagagagccgccgccgccgccgtgggcggcgccctggccgtgggcgccgtgcccgtggtgctgagcgccatgggcttcaccggcgccggcatcgccgccagcagcatcgccgccaagatgatgagcgccgccgccatcgccaacggcggcggcgtgagcgccggcagcctggtggccaccctgcagagcgtgggcgccgccggcctgagcaccagcagcaacatcctgctggccagcgtgggcagcgtgctgggcgcctgcctgggcaacagccccagcagcagcctgcccgccgagcccgaggccaaggaggacgaggccagagagaacgtgccccagggcgagccccccaagccccccctgaagagcgagaagcacgaggagtag

SEQ ID NO: 18869 - DNA, 417 bp, Artificial Sequence
  Description of Artificial Sequence: Synthetic coding sequence
atgagacagaaggccgtgagcctgttcctgtgctacctgctgctgttcacctgcagcggcgtggaggccggcgagaacgccggcaaggacgccggcaagaagaagtgcagcgagagcagcgacagcggcagcggcttctggaaggccctgaccttcatggccgtgggcggcggcctggccgtggccggcctgcccgccctgggcttcaccggcgccggcatcgccgccaacagcgtggccgccagcctgatgagctggagcgccatcctgaacggcggcggcgtgcccgccggcggcctggtggccaccctgcagagcctgggcgccggcggcagcagcgtggtgatcggcaacatcggcgccctgatgggctacgccacccacaagtacctggacagcgaggaggacgaggagtag

SEQ ID NO: 18870 - DNA, 393 bp, Artificial Sequence
  Description of Artificial Sequence: Synthetic coding sequence
atgagacagaaggccgtgagcctgttcctgtgctacctgctgctgttcacctgcagcggcgtggaggccggcaagaagaagtgcagcgagagcagcgacagcggcagcggcttctggaaggccctgaccttcatggccgtgggcggcggcctggccgtggccggcctgcccgccctgggcttcaccggcgccggcatcgccgccaacagcgtggccgccagcctgatgagctggagcgccatcctgaacggcggcggcgtgcccgccggcggcctggtggccaccctgcagagcctgggcgccggcggcagcagcgtggtgatcggcaacatcggcgccctgatgggctacgccacccacaagtacctggacagcgaggaggacgaggagtag

SEQ ID NO: 18871 - DNA, 405 bp, Artificial Sequence
  Description of Artificial Sequence: Synthetic coding sequence
atgagacagaaggccgtgagcctgttcctgtgctacctgctgctgttcacctgcagcggcgtggaggccggcgagaacgccggcaagaagaagtgcagcgagagcagcgacagcggcagcggcttctggaaggccctgaccttcatggccgtgggcggcggcctggccgtggccggcctgcccgccctgggcttcaccggcgccggcatcgccgccaacagcgtggccgccagcctgatgagctggagcgccatcctgaacggcggcggcgtgcccgccggcggcctggtggccaccctgcagagcctgggcgccggcggcagcagcgtggtgatcggcaacatcggcgccctgatgggctacgccacccacaagtacctggacagcgaggaggacgaggagtag

SEQ ID NO: 18872 - DNA, 978 bp, Artificial Sequence
  Description of Artificial Sequence: Synthetic coding sequence
atggcctggagcctgggcagctggctgggcggctgcctgctggtgagcgccctgggcatggtgcccccccccgagaacgtgagaatgaacagcgtgaacttcaagaacatcctgcagtgggagagccccgccttcgccaagggcaacctgaccttcaccgcccagtacctgagctacagaatcttccaggacaagtgcatgaacaccaccctgaccgagtgcgacttcagcagcctgagcaagtacggcgaccacaccctgagagtgagagccgagttcgccgacgagcacagcgactgggtgaacatcaccttctgccccgtggacgacaccatcatcggcccccccggcatgcaggtggaggtgctggccgacagcctgcacatgagattcctggcccccaagatcgagaacgagtacgagacctggaccatgaagaacgtgtacaacagctggacctacaacgtgcagtactggaagaacggcaccgacgagaagttccagatcaccccccagtacgacttcgaggtgctgagaaacctggagccctggaccacctactgcgtgcaggtgagaggcttcctgcccgacagaaacaaggccggcgagtggagcgagcccgtgtgcgagcagaccacccacgacgagaccgtgcccagctggatggtggccgtgatcctgatggccagcgtgttcatggtgtgcctggccctgctgggctgcttcgccctgctgtggtgcgtgtacaagaagaccaagtacgccttcagccccagaaacagcctgccccagcacctgaaggagttcctgggccacccccaccacaacaccctgctgttcttcagcttccccctgagcgacgagaacgacgtgttcgacaagctgagcgtgatcgccgaggacagcgagagcggcaagcagaaccccggcgacagctgcagcctgggcaccccccccggccagggcccccagagctag

SEQ ID NO: 18873 - DNA, 969 bp, Artificial Sequence
  Description of Artificial Sequence: Synthetic coding sequence
atggcctggagcctgggcagctggctgggcggctgcctgctggtgagcgccctgggcatggtgcccccccccgagaacgtgagaatgaacagcgtgaacttcaagaacatcctgcagtgggagagccccgccttcgccaagggcaacctgaccttcaccgcccagtacctgagctacagaatcttccaggacaagtgcatgaacaccaccctgaccgagtgcgacttcagcagcctgagcaagtacggcgaccacaccctgagagtgagagccgagttcgccgacgagcacagcgactgggtgaacatcaccttctgccccgtggacgacaccatcatcggcccccccggcatgcaggtggaggtgctggccgacagcctgcacatgagattcctggcccccaagatcgagaacgagtacgagacctggaccatgaagaacgtgtacaacagctggacctacaacgtgcagtactggaagaacggcaccgacgagaagttccagatcaccccccagtacgacttcgaggtgctgagaaacctggagccctggaccacctactgcgtgcaggtgagaggcttcctgcccgacagaaacaaggccggcgagtggagcgagcccgtgtgcgagcagaccacccacgacgagaccgtgcccagctggatggtggccgtgatcctgatggccagcgtgttcatggtgtgcctggccctgctgggctgcttcgccctgctgtggtgcgtgtacaagaagaccaagtacgccttcagccccagaaacagcctgccccagcacctgaaggagttcctgggccacccccaccacaacaccctgctgttcttcagcttccccctgagcgacgagaacgacgtgttcgacaagctgagcgtgatcgccgaggacagcgagagcggcaagcagaaccccggcgacagccccaccagcagaacccccagaccctggacctag

SEQ ID NO: 18874 - DNA, 444 bp, Artificial Sequence
  Description of Artificial Sequence: Synthetic coding sequence
atgaagcacctgctgatgtggagccccgtgatcgcccccggcgagaccgtgtactacagcgtggagtaccagggcgagtacgagagcctgtacaccagccacatctggatccccagcagctggtgcagcctgaccgagggccccgagtgcgacgtgaccgacgacatcaccgccaccgtgccctacaacctgagagtgagagccaccctgggcagccagaccagcgcctggagcatcctgaagcaccccttcaacagaaacagcaccatcctgaccagacccggcatggagatcaccaaggacggcttccacctggtgatcgagctggaggacctgggcccccagttcgagttcctggtggcctactggagaagagagcccggcgccgaggagagacccttcccctggtactggccctgcctgcccctgctggccagctgctag

SEQ ID NO: 18875 - DNA, 936 bp, Artificial Sequence
  Description of Artificial Sequence: Synthetic coding sequence
atgcagaccttcaccatggtgctggaggagatctggaccagcctgttcatgtggttcttctacgccctgatcccctgcctgctgaccgacgaggtggccatcctgcccgccccccagaacctgagcgtgctgagcaccaacatgaagcacctgctgatgtggagccccgtgatcgcccccggcgagaccgtgtactacagcgtggagtaccagggcgagtacgagagcctgtacaccagccacatctggatccccagcagctggtgcagcctgaccgagggccccgagtgcgacgtgaccgacgacatcaccgccaccgtgccctacaacctgagagtgagagccaccctgggcagccagaccagcgcctggagcatcctgaagcaccccttcaacagaaacagcaccatcctgaccagacccggcatggagatcaccaaggacggcttccacctggtgatcgagctggaggacctgggcccccagttcgagttcctggtggcctactggagaagagagcccggcgccgaggagcacgtgaagatggtgagaagcggcggcatccccgtgcacctggagaccatggagcccggcgccgcctactgcgtgaaggcccagaccttcgtgaaggccatcggcagatacagcgccttcagccagaccgagtgcgtggaggtgcagggcgaggccatccccctggtgctggccctgttcgccttcgtgggcttcatgctgatcctggtggtggtgcccctgttcgtgtggaagatgggcagactgctgcagtacagctgctgccccgtggtggtgctgcccgacaccctgaagatcaccaacagcccccagaagctgatcagctgcagaagagaggaggtggacgcctgcgccaccgccgtgatgagccccgaggagctgctgagagcctggatcagctag

SEQ ID NO: 18876 - DNA, 1725 bp, Artificial Sequence
  Description of Artificial Sequence: Synthetic coding sequence
atgagaaccctgctgaccatcctgaccgtgggcagcctggccgcccacgcccccgaggaccccagcgacctgctgcagcacgtgaagttccagagcagcaacttcgagaacatcctgacctgggacagcggccccgagggcacccccgacaccgtgtacagcatcgagtacaagacctacggcgagagagactgggtggccaagaagggctgccagagaatcaccagaaagagctgcaacctgaccgtggagaccggcaacctgaccgagctgtactacgccagagtgaccgccgtgagcgccggcggcagaagcgccaccaagatgaccgacagattcagcagcctgcagcacaccaccctgaagccccccgacgtgacctgcatcagcaaggtgagaagcatccagatgatcgtgcaccccacccccacccccatcagagccggcgacggccacagactgaccctggaggacatcttccacgacctgttctaccacctggagctgcaggtgaacagaacctaccagatgcacctgggcggcaagcagagagagtacgagttcttcggcctgacccccgacaccgagttcctgggcaccatcatgatctgcgtgcccacctgggccaaggagagcgccccctacatgtgcagagtgaagaccctgcccgacagaacctggacctacagcttcagcggcgccttcctgttcagcatgggcttcctggtggccgtgctgtgctacctgagctacagatacgtgaccaagccccccgccccccccaacagcctgaacgtgcagagagtgctgaccttccagcccctgagattcatccaggagcacgtgctgatccccgtgttcgacctgagcggccccagcagcctggcccagcccgtgcagtacagccagatcagagtgagcggccccagagagcccgccggcgccccccagagacacagcctgagcgagatcacctacctgggccagcccgacatcagcatcctgcagcccagcaacgtgccccccccccagatcctgagccccctgagctacgcccccaacgccgcccccgaggtgggcccccccagctacgccccccaggtgacccccgaggcccagttccccttctacgccccccaggccatcagcaaggtgcagcccagcagctacgccccccaggccacccccgacagctggccccccagctacggcgtgtgcatggagggcagcggcaaggacagccccaccggcaccctgagcagccccaagcacctgagacccaagggccagctgcagaaggagccccccgccggcagctgcatgctgggcggcctgagcctgcaggaggtgaccagcctggccatggaggagagccaggaggccaagagcctgcaccagcccctgggcatctgcaccgacagaaccagcgaccccaacgtgctgcacagcggcgaggagggcaccccccagtacctgaagggccagctgcccctgctgagcagcgtgcagatcgagggccaccccatgagcctgcccctgcagccccccagcagaccctgcagccccagcgaccagggccccagcccctggggcctgctggagagcctggtgtgccccaaggacgaggccaagagccccgcccccgagaccagcgacctggagcagcccaccgagctggacagcctgttcagaggcctggccctgaccgtgcagtgggagagctag

SEQ ID NO: 18877 - DNA, 1911 bp, Artificial Sequence
  Description of Artificial Sequence: Synthetic coding sequence
atgagaggcggcagaggcgcccccttctggctgtggcccctgcccaagctggccctgctgcccctgctgtgggtgctgttccagagaaccagaccccagggcagcgccggccccctgcagtgctacggcgtgggccccctgggcgacctgaactgcagctgggagcccctgggcgacctgggcgcccccagcgagctgcacctgcagagccagaagtacagaagcaacaagacccagaccgtggccgtggccgccggcagaagctgggtggccatccccagagagcagctgaccatgagcgacaagctgctggtgtggggcaccaaggccggccagcccctgtggccccccgtgttcgtgaacctggagacccagatgaagcccaacgcccccagactgggccccgacgtggacttcagcgaggacgaccccctggaggccaccgtgcactgggccccccccacctggcccagccacaaggtgctgatctgccagttccactacagaagatgccaggaggccgcctggaccctgctggagcccgagctgaagaccatccccctgacccccgtggagatccaggacctggagctggccaccggctacaaggtgtacggcagatgcagaatggagaaggaggaggacctgtggggcgagtggagccccatcctgagcttccagaccccccccagcgcccccaaggacgtgtgggtgagcggcaacctgtgcggcacccccggcggcgaggagcccctgctgctgtggaaggcccccggcccctgcgtgcaggtgagctacaaggtgtggttctgggtgggcggcagagagctgagccccgagggcatcacctgctgctgcagcctgatccccagcggcgccgagtgggccagagtgagcgccgtgaacgccaccagctgggagcccctgaccaacctgagcctggtgtgcctggacagcgccagcgcccccagaagcgtggccgtgagcagcatcgccggcagcaccgagctgctggtgacctggcagcccggccccggcgagcccctggagcacgtggtggactgggccagagacggcgaccccctggagaagctgaactgggtgagactgccccccggcaacctgagcgccctgctgcccggcaacttcaccgtgggcgtgccctacagaatcaccgtgaccgccgtgagcgccagcggcctggccagcgccagcagcgtgtggggcttcagagaggagctggcccccctggtgggccccaccctgtggagactgcaggacgccccccccggcacccccgccatcgcctggggcgaggtgcccagacaccagctgagaggccacctgacccactacaccctgtgcgcccagagcggcaccagccccagcgtgtgcatgaacgtgagcggcaacacccagagcgtgaccctgcccgacctgccctggggcccctgcgagctgtgggtgaccgccagcaccatcgccggccagggcccccccggccccatcctgagactgcacctgcccgacaacaccctgagatggaaggtgctgcccggcatcctgttcctgtggggcctgttcctgctgggctgcggcctgagcctggccaccagcggcagatgctaccacctgagacacaaggtgctgcccagatgggtgtgggagaaggtgcccgaccccgccaacagcagcagcggccagccccacatggagcaggtgcccgaggcccagcccctgggcgacctgcccatcctggaggtggaggagatggagcccccccccgtgatggagagcagccagcccgcccaggccaccgcccccctggacagcggctacgagaagcacttcctgcccacccccgaggagctgggcctgctgggcccccccagaccccaggtgctggcctag

SEQ ID NO: 18878 - DNA, 453 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttcgaggaccccgacgtgaacatcaccaacctggagttcgagatctgcggcgccctggtggaggtgaagtgcctgaacttcagaaagctgcaggagatctacttcatcgagaccaagaagttcctgctgatcggcaagagcaacatctgcgtgaaggtgggcgagaagagcctgacctgcaagaagatcgacctgaccaccatcggcaagaagctgtacatcaaggtgtggctgagcctgctgggctacctgaagaccctgtgcctggacatcctgtag

SEQ ID NO: 18879 - DNA, 543 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttcgaggaccccgacgtgaacatcaccaacctggagttcgagatctgcggcgccctggtggaggtgaagtgcctgaacttcagaaagctgcaggagatctacttcatcgagaccaagaagttcctgctgatcggcaagagcaacatctgcgtgaaggtgggcgagaagagcctgacctgcaagaagatcgacctgaccaccatcgtgaagcccgaggcccccttcgacctgagcgtggtgtacagagagggcgccaacgacttcgtggtgaccttcaacaccagccacctgcagaagaagtacgtgaaggtgctgatgcacgacgtggcctacagacaggagaaggacgagaacaagtggaccgactag

SEQ ID NO: 18880 - DNA, 1893 bp, Artificial Sequence
  Description of Artificial Sequence: Synthetic coding sequence
atgcccctgggcggcagagccagcctgaccccccagaagctgtggctgggcaccgccaagcccggcagcctgacccaggccctgaacagccccctgacctgggagcacgcctggaccggcgtgcccggcggcacccccgactgcctgaccgacaccttcagagtgaagagaccccacctgagaagaagcgccagcaacggccacgtgcccggcacccccgtgtacagagagaaggaggacatgtacgacgagatcatcgagctgaagaagagcctgcacgtgcagaagagcgacgtggacctgatgagaaccaagctgagaagactggaggaggagaacagcagaaaggacagacagatcgagcagctgctggaccccagcagaggcaccgacttcgtgagaaccctggccgagaagagacccgacgccagctgggtgatcaacggcctgaagcagagaatcctgaagctggagcagcagtgcaaggagaaggacggcaccatcagcaagctgcagaccgacatgaagaccaccaacctggaggagatgagaatcgccatggagacctactacgaggaggtgcacagactgcagaccctgctggccagcagcgagaccaccggcaagaagcccctgggcgagaagaagaccggcgccaagagacagaagaagatgggcagcgccctgctgagcctgagcagaagcgtgcaggagctgaccgaggagaaccagagcctgaaggaggacctggacagagtgctgagcaccagccccaccatcagcaagacccagggctacgtggagtggagcaagcccagactgctgagaagaatcgtggagctggagaagaagctgagcgtgatggagagcagcaagagccacgccgccgagcccgtgagaagccacccccccgcctgcctggccagcagcagcgccctgcacagacagcccagaggcgacagaaacaaggaccacgagagactgagaggcgccgtgagagacctgaaggaggagagaaccgccctgcaggagcagctgctgcagagagacctggaggtgaagcagctgctgcaggccaaggccgacctggagaaggagctggagtgcgccagagagggcgaggaggagagaagagagagagaggaggtgctgagagaggagatccagaccctgaccagcaagctgcaggagctgcaggagatgaagaaggaggagaaggaggactgccccgaggtgccccacaaggcccaggagctgcccgcccccacccccagcagcagacactgcgagcaggactggccccccgacagcagcgaggagggcctgcccagacccagaagcccctgcagcgacggcagaagagacgccgccgccagagtgctgcaggcccagtggaaggtgtacaagcacaagaagaagaaggccgtgctggacgaggccgccgtggtgctgcaggccgccttcagaggccacctgaccagaaccaagctgctggccagcaaggcccacggcagcgagccccccagcgtgcccggcctgcccgaccagagcagccccgtgcccagagtgcccagccccatcgcccaggccaccggcagccccgtgcaggaggaggccatcgtgatcatccagagcgccctgagagcccacctggccagagccagacacagcgccaccggcaagagaaccaccaccgccgccagcaccagaagaagaagcgccagcgccacccacggcgacgccagcagcccccccttcctggccgccctgcccgaccccagccccagcggcccccaggccctggcccccctgcccggcgacgacgtgaacagcgacgacagcgacgacatcgtgatcgcccccagcctgcccaccaagaacttccccgtgtag

SEQ ID NO: 18881 - DNA, 2088 bp, Artificial Sequence
  Description of Artificial Sequence: Synthetic coding sequence
atgttcctgggcaccggcgagcccgccctggacaccggcgacgacagcctgagcgccgtgaccttcgacagcgacgtggagaccaaggccaagagaaaggccttccacaagcccccccccaccagccccaagagcccctacctgagcaagcccagaaaggtggccagctggagaagcctgagaaccgccggcagcatgcccctgggcggcagagccagcctgaccccccagaagctgtggctgggcaccgccaagcccggcagcctgacccaggccctgaacagccccctgacctgggagcacgcctggaccggcgtgcccggcggcacccccgactgcctgaccgacaccttcagagtgaagagaccccacctgagaagaagcgccagcaacggccacgtgcccggcacccccgtgtacagagagaaggaggacatgtacgacgagatcatcgagctgaagaagagcctgcacgtgcagaagagcgacgtggacctgatgagaaccaagctgagaagactggaggaggagaacagcagaaaggacagacagatcgagcagctgctggaccccagcagaggcaccgacttcgtgagaaccctggccgagaagagacccgacgccagctgggtgatcaacggcctgaagcagagaatcctgaagctggagcagcagtgcaaggagaaggacggcaccatcagcaagctgcagaccgacatgaagaccaccaacctggaggagatgagaatcgccatggagacctactacgaggaggtgcacagactgcagaccctgctggccagcagcgagaccaccggcaagaagcccctgggcgagaagaagaccggcgccaagagacagaagaagatgggcagcgccctgctgagcctgagcagaagcgtgcaggagctgaccgaggagaaccagagcctgaaggaggacctggacagagtgctgagcaccagccccaccatcagcaagacccagggctacgtggagtggagcaagcccagactgctgagaagaatcgtggagctggagaagaagctgagcgtgatggagagcagcaagagccacgccgccgagcccgtgagaagccacccccccgcctgcctggccagcagcagcgccctgcacagacagcccagaggcgacagaaacaaggaccacgagagactgagaggcgccgtgagagacctgaaggaggagagaaccgccctgcaggagcagctgctgcagagagacctggaggtgaagcagctgctgcaggccaaggccgacctggagaaggagctggagtgcgccagagagggcgaggaggagagaagagagagagaggaggtgctgagagaggagatccagaccctgaccagcaagctgcaggagctgcaggagatgaagaaggaggagaaggaggactgccccgaggtgccccacaaggcccaggagctgcccgcccccacccccagcagcagacactgcgagcaggactggccccccgacagcagcgaggagggcctgcccagacccagaagcccctgcagcgacggcagaagagacgccgccgccagagtgctgcaggcccagtggaaggtgtacaagcacaagaagaagaaggccgtgctggacgaggccgccgtggtgctgcaggccgccttcagaggccacctgaccagaaccaagctgctggccagcaaggcccacggcagcgagccccccagcgtgcccggcctgcccgaccagagcagccccgtgcccagagtgcccagccccatcgcccaggccaccggcagccccgtgcaggaggaggccatcgtgatcatccagagcgccctgagagcccacctggccagagccagacacagcgccaccggcaagagaaccaccaccgccgccagcaccagaagaagaagcgccagcgccacccacggcgacgccagcagcccccccttcctggccgccctgcccgaccccagccccagcggcccccaggccctggcccccctgcccggcgacgacgtgaacagcgacgacagcgacgacatcgtgatcgcccccagcctgcccaccaagaacttccccgtgtag

SEQ ID NO: 18882 - DNA, 1935 bp, Artificial Sequence
  Description of Artificial Sequence: Synthetic coding sequence
atgttcctgggcaccggcgagcccgccctggacaccagccacctgatcagcctgagcagagccagcctgaccccccagaagctgtggctgggcaccgccaagcccggcagcctgacccaggccctgaacagccccctgacctgggagcacgcctggaccggcgtgcccggcggcacccccgactgcctgaccgacaccttcagagtgaagagaccccacctgagaagaagcgccagcaacggccacgtgcccggcacccccgtgtacagagagaaggaggacatgtacgacgagatcatcgagctgaagaagagcctgcacgtgcagaagagcgacgtggacctgatgagaaccaagctgagaagactggaggaggagaacagcagaaaggacagacagatcgagcagctgctggaccccagcagaggcaccgacttcgtgagaaccctggccgagaagagacccgacgccagctgggtgatcaacggcctgaagcagagaatcctgaagctggagcagcagtgcaaggagaaggacggcaccatcagcaagctgcagaccgacatgaagaccaccaacctggaggagatgagaatcgccatggagacctactacgaggaggtgcacagactgcagaccctgctggccagcagcgagaccaccggcaagaagcccctgggcgagaagaagaccggcgccaagagacagaagaagatgggcagcgccctgctgagcctgagcagaagcgtgcaggagctgaccgaggagaaccagagcctgaaggaggacctggacagagtgctgagcaccagccccaccatcagcaagacccagggctacgtggagtggagcaagcccagactgctgagaagaatcgtggagctggagaagaagctgagcgtgatggagagcagcaagagccacgccgccgagcccgtgagaagccacccccccgcctgcctggccagcagcagcgccctgcacagacagcccagaggcgacagaaacaaggaccacgagagactgagaggcgccgtgagagacctgaaggaggagagaaccgccctgcaggagcagctgctgcagagagacctggaggtgaagcagctgctgcaggccaaggccgacctggagaaggagctggagtgcgccagagagggcgaggaggagagaagagagagagaggaggtgctgagagaggagatccagaccctgaccagcaagctgcaggagctgcaggagatgaagaaggaggagaaggaggactgccccgaggtgccccacaaggcccaggagctgcccgcccccacccccagcagcagacactgcgagcaggactggccccccgacagcagcgaggagggcctgcccagacccagaagcccctgcagcgacggcagaagagacgccgccgccagagtgctgcaggcccagtggaaggtgtacaagcacaagaagaagaaggccgtgctggacgaggccgccgtggtgctgcaggccgccttcagaggccacctgaccagaaccaagctgctggccagcaaggcccacggcagcgagccccccagcgtgcccggcctgcccgaccagagcagccccgtgcccagagtgcccagccccatcgcccaggccaccggcagccccgtgcaggaggaggccatcgtgatcatccagagcgccctgagagcccacctggccagagccagacacagcgccaccggcaagagaaccaccaccgccgccagcaccagaagaagaagcgccagcgccacccacggcgacgccagcagcccccccttcctggccgccctgcccgaccccagccccagcggcccccaggccctggcccccctgcccggcgacgacgtgaacagcgacgacagcgacgacatcgtgatcgcccccagcctgcccaccaagaacttccccgtgtag

SEQ ID NO: 18883 - DNA, 387 bp, Artificial Sequence
  Description of Artificial Sequence: Synthetic coding sequence
atgcccctgggcggcagagccagcctgaccccccagaagctgtggctgggcaccgccaagcccggcagcctgacccaggccctgaacagccccctgacctgggagcacgcctggaccggcgtgcccggcggcacccccgactgcctgaccgacaccttcagagtgaagagaccccacctgagaagaagcgccagcaacggccacgtgcccggcacccccgtgtacagagagaaggaggacatgtacgacgagatcatcgagctgaagaagagcctgcacgtgcagaagagcgacgtggacctgatgagaaccaagctgagaagactggaggaggagaacagcagaaaggacagacagatcgagcagctgctggaccccagcagatag

SEQ ID NO: 18884 - DNA, 387 bp, Artificial Sequence; identical to SEQ ID NO: 18883
  Description of Artificial Sequence: Synthetic coding sequence

SEQ ID NO: 18885 - DNA, 2040 bp, Artificial Sequence
  Description of Artificial Sequence: Synthetic coding sequence
atgttcctgggcaccggcgagcccgccctggacaccaaggccaagagaaaggccttccacaagcccccccccaccagccccaagagcccctacctgagcaagcccagaaaggtggccagctggagaagcctgagaaccgccggcagcatgcccctgggcggcagagccagcctgaccccccagaagctgtggctgggcaccgccaagcccggcagcctgacccaggccctgaacagccccctgacctgggagcacgcctggaccggcgtgcccggcggcacccccgactgcctgaccgacaccttcagagtgaagagaccccacctgagaagaagcgccagcaacggccacgtgcccggcacccccgtgtacagagagaaggaggacatgtacgacgagatcatcgagctgaagaagagcctgcacgtgcagaagagcgacgtggacctgatgagaaccaagctgagaagactggaggaggagaacagcagaaaggacagacagatcgagcagctgctggaccccagcagaggcaccgacttcgtgagaaccctggccgagaagagacccgacgccagctgggtgatcaacggcctgaagcagagaatcctgaagctggagcagcagtgcaaggagaaggacggcaccatcagcaagctgcagaccgacatgaagaccaccaacctggaggagatgagaatcgccatggagacctactacgaggaggtgcacagactgcagaccctgctggccagcagcgagaccaccggcaagaagcccctgggcgagaagaagaccggcgccaagagacagaagaagatgggcagcgccctgctgagcctgagcagaagcgtgcaggagctgaccgaggagaaccagagcctgaaggaggacctggacagagtgctgagcaccagccccaccatcagcaagacccagggctacgtggagtggagcaagcccagactgctgagaagaatcgtggagctggagaagaagctgagcgtgatggagagcagcaagagccacgccgccgagcccgtgagaagccacccccccgcctgcctggccagcagcagcgccctgcacagacagcccagaggcgacagaaacaaggaccacgagagactgagaggcgccgtgagagacctgaaggaggagagaaccgccctgcaggagcagctgctgcagagagacctggaggtgaagcagctgctgcaggccaaggccgacctggagaaggagctggagtgcgccagagagggcgaggaggagagaagagagagagaggaggtgctgagagaggagatccagaccctgaccagcaagctgcaggagctgcaggagatgaagaaggaggagaaggaggactgccccgaggtgccccacaaggcccaggagctgcccgcccccacccccagcagcagacactgcgagcaggactggccccccgacagcagcgaggagggcctgcccagacccagaagcccctgcagcgacggcagaagagacgccgccgccagagtgctgcaggcccagtggaaggtgtacaagcacaagaagaagaaggccgtgctggacgaggccgccgtggtgctgcaggccgccttcagaggccacctgaccagaaccaagctgctggccagcaaggcccacggcagcgagccccccagcgtgcccggcctgcccgaccagagcagccccgtgcccagagtgcccagccccatcgcccaggccaccggcagccccgtgcaggaggaggccatcgtgatcatccagagcgccctgagagcccacctggccagagccagacacagcgccaccggcaagagaaccaccaccgccgccagcaccagaagaagaagcgccagcgccacccacggcgacgccagcagcccccccttcctggccgccctgcccgaccccagccccagcggcccccaggccctggcccccctgcccggcgacgacgtgaacagcgacgacagcgacgacatcgtgatcgcccccagcctgcccaccaagaacttccccgtgtag

SEQ ID NO: 18886 - DNA, 4896 bp, Artificial Sequence
  Description of Artificial Sequence: Synthetic coding sequence
atggagagaagagccgccggccccggctgggccgcctacgagagactgaccgccgaggagatggacgagcagagaagacagaacgtggcctaccagtacctgtgcagactggaggaggccaagagatggatggaggcctgcctgaaggaggagctgcccagccccgtggagctggaggagagcctgagaaacggcgtgctgctggccaagctgggccactgcttcgcccccagcgtggtgcccctgaagaagatctacgacgtggagcagctgagataccaggccaccggcctgcacttcagacacaccgacaacatcaacttctggctgagcgccatcgcccacatcggcctgcccagcaccttcttccccgagaccaccgacatctacgacaagaagaacatgcccagagtggtgtactgcatccacgccctgagcctgttcctgttcagactgggcctggccccccagatccacgacctgtacggcaaggtgaagttcaccgccgaggagctgagcaacatggccagcgagctggccaagtacggcctgcagctgcccgccttcagcaagatcggcggcatcctggccaacgagctgagcgtggacgaggccgccgtgcacgccgccgtgctggccatcaacgaggccgtggagagaggcgtggtggaggacaccctggccgccctgcagaaccccagcgccctgctggagaacctgagagagcccctggccgccgtgtaccaggagatgctggcccaggccaagatggagaaggccgccaacgccagaaaccacgacgacagagagagccaggacatctacgaccactacctgacccaggccgagatccagggcaacatcaaccacgtgaacgtgcacggcgccctggaggtggtggacgacgccctggagagacagagccccgaggccctgctgaaggccctgcaggaccccgccctggccctgagaggcgtgagaagagacttcgccgactggtacctggagcagctgaacagcgacagagagcagaaggcccaggagctgggcctggtggagctgctggagaaggaggaggtgcaggccggcgtggccgccgccaacaccaagggcgaccaggagcaggccatgctgcacgccgtgcagagaatcaacaaggccatcagaagaagagtggccgccgacaccgtgaaggagctgatgtgccccgaggcccagctgccccccgtgtaccccgtggccagcagcatgtaccagctggagctggccgtgctgcagcagcagcagggcgagctgggccaggaggagctgttcgtggccgtggagatgctgagcgccgtggtgctgatcaacagagccctggaggccagagacgccagcggcttctggagcagcctggtgaaccccgccaccggcctggccgaggtggagggcgagaacgcccagagatacttcgacgccctgctgaagctgagacaggagagaggcatgggcgaggacttcctgagctggaacgacctgcaggccaccgtgagccaggtgaacgcccagacccaggaggagaccgacagagtgctggccgtgagcctgatcaacgaggccctggacaagggcagccccgagaagaccctgagcgccctgctgctgcccgccgccggcctggacgacgtgagcctgcccgtggcccccagataccacctgctgctggtggccgccaagagacagaaggcccaggtgaccggcgaccccggcgccgtgctgtggctggaggagatcagacagggcgtggtgagagccaaccaggacaccaacaccgcccagagaatggccctgggcgtggccgccatcaaccaggccatcaaggagggcaaggccgcccagaccgagagagtgctgagaaaccccgccgtggccctgagaggcgtggtgcccgactgcgccaacggctaccagagagccctggagagcgccatggccaagaagcagagacccgccgacaccgccttctgggtgcagcacgacatgaaggacggcaccgcctactacttccacctgcagaccttccagggcatctgggagcagccccccggctgccccctgaacaccagccacctgaccagagaggagatccagagcgccgtgaccaaggtgaccgccgcctacgacagacagcagctgtggaaggccaacgtgggcttcgtgatccagctgcaggccagactgagaggcttcctggtgagacagaagttcgccgagcacagccacttcctgagaacctggctgcccgccgtgatcaagatccaggcccactggagaggctacagacagagaaagatctacctggagtggctgcagtacttcaaggccaacctggacgccatcatcaagatccaggcctgggccagaatgtgggccgccagaagacagtacctgagaagactgcactacttccagaagaacgtgaacagcatcgtgaagatccaggccttcttcagagccagaaaggcccaggacgactacagaatcctggtgcacgccccccacccccccctgagcgtggtgagaagattcgcccacctgctgaaccagagccagcaggacttcctggccgaggccgagctgctgaagctgcaggaggaggtggtgagaaagatcagaagcaaccagcagctggagcaggacctgaacatcatggacatcaagatcggcctgctggtgaagaacagaatcaccctgcaggaggtggtgagccactgcaagaagctgaccaagagaaacaaggagcagctgagcgacatgatggtgctggacaagcagaagggcctgaagagcctgagcaaggagaagagacagaagctggaggcctaccagcacctgttctacctgctgcagacccagcccatctacctggccaagctgatcttccagatgccccagaacaagaccaccaagttcatggaggccgtgatcttcagcctgtacaactacgccagcagcagaagagaggcctacctgctgctgcagctgttcaagaccgccctgcaggaggagatcaagagcaaggtggagcagccccaggacgtggtgaccggcaaccccaccgtggtgagactggtggtgagattctacagaaacggcagaggccagagcgccctgcaggagatcctgggcaaggtgatccaggacgtgctggaggacaaggtgctgagcgtgcacaccgaccccgtgcacctgtacaagaactggatcaaccagaccgaggcccagaccggccagagaagccacctgccctacgacgtgacccccgagcaggccctgagccaccccgaggtgcagagaagactggacatcgccctgagaaacctgctggccatgaccgacaagttcctgctggccatcaccagcagcgtggaccagatcccctacggcatgagatacgtggccaaggtgctgaaggccaccctggccgagaagttccccgacgccaccgacagcgaggtgtacaaggtggtgggcaacctgctgtactacagattcctgaaccccgccgtggtggcccccgacgccttcgacatcgtggccatggccgccggcggcgccctggccgccccccagagacacgccctgggcgccgtggcccagctgctgcagcacgccgccgccggcaaggccttcagcggccagagccagcacctgagagtgctgaacgactacctggaggagacccacctgaagttcagaaagttcatccacagagcctgccaggtgcccgagcccgaggagagattcgccgtggacgagtacagcgacatggtggccgtggccaagcccatggtgtacatcaccgtgggcgagctggtgaacacccacagactgctgctggagcaccaggactgcatcgcccccgaccaccaggaccccctgcacgagctgctggaggacctgggcgagctgcccaccatccccgacctgatcggcgagagcatcgccgccgacggccacaccgacctgagcaagctggaggtgagcctgaccctgaccaacaagttcgagggcctggaggccgacgccgacgacagcaacaccagaagcctgctgctgagcaccaagcagctgctggccgacatcatccagttccaccccggcgacaccctgaaggagatcctgagcctgagcgccagcagagagcaggaggccgcccacaagcagctgatgagcagaagacaggcctgcaccgcccagacccccgagcccctgagaagacacagaagcctgaccgcccacagcctgctgcccctggccgagaagcagagaagagtgctgagaaacctgagaagactggaggccctgggcctggtgagcgccagaaacggctaccagggcctggtggacgagctggccaaggacatcagaaaccagcacagacacagacacagaagaaaggccgagctggtgaagctgcaggccaccctgcagggcctgagcaccaagaccaccttctacgaggagcagggcgactactacagccagtacatcagagcctgcctggaccacctggcccccgacagcaagagcagcggcaagggcaagaagcagcccagcctgcactacaccgccgcccagctgctggagaagggcgtgctggtggagatcgaggacctgcccgccagccacttcagaaacgtgatcttcgacatcacccccggcgacgaggccggcaagttcgaggtgaacgccaagttcctgggcgtggacatggagagattccagctgcactaccaggacctgctgcagctgcagtacgagggcgtggccgtgatgaagctgttcaacaaggccaaggtgaacgtgaacctgctgatcttcctgctgaacaagaagttcctgagaaagtag

SEQ ID NO: 18887 - DNA, 465 bp, Artificial Sequence
  Description of Artificial Sequence: Synthetic coding sequence
atggccgccgcctggggcagcagcctgaccgccgccacccagagagccgtgaccccctggcccagaggcagactgctgaccgccagcctgggcccccaggccagaagagaggccagcagcagcagccccgaggccggcgagggccagatcagactgaccgacagctgcgtgcagagactgctggagatcaccgagggcagcgagttcctgagactgcaggtggagggcggcggctgcagcggcttccagtacaagttcagcctggacaccgtgatcaaccccgacgacagagtgttcgagcagggcggcgccagagtggtggtggacagcgacagcctggccttcgtgaagggcgcccaggtggacttcagccaggagctgatcagaagcagcttccaggtgctgaacaacccccaggcccagcagggctgcagctgcggcagcagcttcagcatcaagctgtag

SEQ ID NO: 18888 - DNA, 666 bp, Artificial Sequence
  Description of Artificial Sequence: Synthetic coding sequence
atgcccctggccctgaccctgctgctgctgagcggcctgggcgcccccggcggctggggctgcctgcagtgcgaccccctggtgctggaggccctgggccacctgagaagcgccctgatccccagcagattccagctggagcagctgcaggccagagccggcgccgtgctgatgggcatggagggccccttcttcagagactacgccctgaacgtgttcgtgggcaaggtggagaccaaccagctggacctggtggccagcttcgtgaagaaccagacccagcacctgatgggcaacagcctgaaggacgagcccctgctggaggagctggtgaccctgagagccaacgtgatcaaggagttcaagaaggtgctgatcagctacgagctgaaggcctgcaaccccaagctgtgcagactgctgaaggaggaggtgctggactgcctgcactgccagagaatcacccccaagtgcatccacaagaagtactgcttcgtggacagacagcccagagtggccctgcagtaccagatggacagcaagtaccccagaaaccaggccctgctgggcatcctgatcagcgtgagcctggccgtgttcgtgttcgtggtgatcgtggtgagcgcctgcacctacagacagaacagaaagctgctgctgcagtag

SEQ ID NO: 18889 - DNA, 579 bp, Artificial Sequence
  Description of Artificial Sequence: Synthetic coding sequence
atgcccctggccctgaccctgctgctgctgagcggcctgggcgcccccggcggctggggctgcctgcagtgcgaccccctggtgctggaggccctgggccacctgagaagcgccctgatccccagcagattccagctggagcagctgcaggccagagccggcgccgtgctgatgggcatggagggccccttcttcagagactacgccctgaacgtgttcgtgggcaaggtggagaccaaccagctggacctggtggccagcttcgtgaagaaccagacccagcacctgatgggcaacagcctgaaggacgagcccctgctggaggagctggtgaccctgagagccaacgtgatcaaggagttcaagaaggtgctgatcagctacgagctgaaggccggcaaccccgcctggccctgcagcaccagatggaccgccaacaccagaggcaccagaagatgctgggccagcagcttcctgtgcctgtggctgagcctgagcagctggagcagctggagcagactggtgcacaccgacaagaccgagaacagctgctgcagcagaaccgtggtgtggggctag

SEQ ID NO: 18890 - DNA, 720 bp, Artificial Sequence
  Description of Artificial Sequence: Synthetic coding sequence
atgggcgacctgtggctgttcctgctgctgcccctgagcgccttccacggcgtgaagggctgcctggagtgcgaccccaagttcatcgaggacgtgggcagcctgctgggcaacctgatccccagcgaggtgcccggcagaacccagctgctggagagacagatcaaggagatgatccacctgagcttcaaggtgagccacagcgacaagagactgagagtgctggccgtgcagcaggtggtgaagctgagaacctggctgaagaacgagttctacaagctgggcaacgagacctggaagggcgtgttcatctaccagggcaagctgctggacgtgtgccagaacctggagagcaagctgaaggagctgctgaagaacttcagcgagatcgcctgcagcgaggactgcatcgtggtggagggccccatcctggactgctggacctgcctgagaatgaccaacagatgcttcaagggcgagtactgcggcgacgaggaccccagaaaggccgagaacagagagatcgccctgttcctgatcctgctggccaccgccgtgatcctgggcagcgccgtgctgctgttccacttctgcatcttccacagaagaaagatgaaggccatcagaagaagcctgaaggagtacgtggagaagaagctggaggagctgatgggcaagatcgacgagaaggaggagaaggacttcagactgagaaagtag

SEQ ID NO: 18891 - DNA, 1053 bp, Artificial Sequence
  Description of Artificial Sequence: Synthetic coding sequence
atgggcccccacttcaccctgctgtgcgccgccctggccggctgcctgctgcccgccgagggctgcgtgatctgcgaccccagcgtggtgctggccctgaagagcctggagaaggactacctgcccggccacctggacgccaagcaccacaaggccatgatggagagagtggagaacgccgtgaaggacttccaggagctgagcctgaacgaggacgcctacatgggcgtggtggacgaggccaccctgcagaagggcagctggagcctgctgaaggacctgaagagaatcaccgacagcgacgtgaagggcgacctgttcgtgaaggagctgttctggatgctgcacctgcagaaggagaccttcgccacctacgtggccagattccagaaggaggcctactgccccaacaagtgcggcgtgatgctgcagaccctgatctggtgcaagaactgcaagaaggaggtgcacgcctgcagaaagagctacgactgcggcgagagaaacgtggaggtgccccagatggaggacatgatcctggactgcgagctgaactggcaccaggccagcgagggcctgaccgactacagcttctacagagtgtggggcaacaacaccgagaccctggtgagcaagggcaaggaggccaccctgaccaagcccatggtgggccccgaggacgccggcagctacagatgcgagctgggcagcgtgaacagcagccccgccaccatcatcaacttccacgtgaccgtgctgcccaagatgatcaaggaggagaagcccagccccaacatcgtgacccccggcgaggccaccaccgagagcagcatcagcctgcagcccctgcagcccgagaagatgctggccagcagactgctgggcctgctgatctgcggcagcctggccctgatcaccggcctgaccttcgccatcttcagaagaagaaaggtgatcgacttcatcaagagcagcctgttcggcctgggcagcggcgccgccgagcagacccaggtgcccaaggagaaggccaccgacagcagacagcagtag

SEQ ID NO: 18892 - DNA, 552 bp, Artificial Sequence
  Description of Artificial Sequence: Synthetic coding sequence
atggccagcagagccggccccagagccgccggcaccgacggcagcgacttccagcacagagagagagtggccatgcactaccagatgagcgtgaccctgaagtacgagatcaagaagctgatctacgtgcacctggtgatctggctgctgctggtggccaagatgagcgtgggccacctgagactgctgagccacgaccaggtggccatgccctaccagtgggagtacccctacctgctgagcatcctgcccagcctgctgggcctgctgagcttccccagaaacaacatcagctacctggtgctgagcatgatcagcatgggcctgttcagcatcgcccccctgatctacggcagcatggagatgttccccgccgcccagcagctgtacagacacggcaaggcctacagattcctgttcggcttcagcgccgtgagcatcatgtacctggtgctggtgctggccgtgcaggtgcacgcctggcagctgtactacagcaagaagctgctggacagctggttcaccagcacccaggagaagaagcacaagtag

SEQ ID NO: 18893 - DNA, 546 bp, Artificial Sequence
  Description of Artificial Sequence: Synthetic coding sequence
atggccagcagagccggccccagagccgccggcaccgacggcagcgacttccagcacagagagagagtggccatgcactaccagatgagcgtgaccctgaagtacgagatcaagaagctgatctacgtgcacctggtgatctggctgctgctggtggccaagatgagcgtgggccacctgagactgctgagccacgaccaggtggccatgccctaccagtgggagtacccctacctgctgagcatcctgcccagcctgctgggcctgctgagcttccccagaaacaacatcagctacctggtgctgagcatgatcagcatgggcctgttccacagaagcacccacctgtggcagcacggcgacgtgccctgctgcaccgccgccaccgccatggccagacccaccgtgagcagcctggtgttcctgcccttccccatgtacctggtgctggtgctggccgtgcaggtgcacgcctggcagctgtactacagcaagaagctgctggacagctggttcaccagcacccaggagaagaagcacaagtag

SEQ ID NO: 18894 - DNA, 1881 bp, Artificial Sequence
  Description of Artificial Sequence: Synthetic coding sequence
atgagcaagaagggcagaagcaagggcgagaagcccgagatggagaccgacgccgtgcagatggccaacgaggagctgagagccaagctgaccagcatccagatcgagttccagcaggagaagagcaaggtgggcaagctgagagagagactgcaggaggccaagctggagagagagcaggagcagagaagacacaccgcctacatcagcgagctgaaggccaagctgcacgaggagaagaccaaggagctgcaggccctgagagagggcctgatcagacagcacgagcaggaggccgccagaaccgccaagatcaaggagggcgagctgcagagactgcaggccaccctgaacgtgctgagagacggcgccgccgacaaggtgaagaccgccctgctgaccgaggccagagaggaggccagaagagccttcgacggcgagagactgagactgcagcaggagatcctggagctgaaggccgccagaaagcaggccgaggaggccctgagcaactgcatgcaggccgacaagaccaaggccgccgacctgagagccgcctaccaggcccaccaggacgaggtgcacagaatcaagagagagtgcgagagagacatcagaagactgatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgaaggagaagctgagcgcccaggccagcctgaagagacacaccagcctgaacgacctgagcctgaccagagacgagcaggagatcgagttcctgagactgcaggtgctggagcagcagcacgtgatcgacgacctgagcctggagagagagagactgctgagaagcaagagacacagaggcaagagcctgaagccccccaagaagcacgtggtggagaccttcttcggcttcgacgaggagagcgtggacagcgagaccctgagcgagaccagctacaacaccgacagaaccgacagaacccccgccacccccgaggaggacctggacgacgccaccgccagagaggaggccgacctgagattctgccagctgaccagagagtaccaggccctgcagagagcctacgccctgctgcaggagcaggtgggcggcaccctggacgccgagagagaggccagaaccagagagcagctgcaggccgacctgctgagatgccaggccaagatcgaggacctggagaagctgctggtggagaagggccaggacagcaagtgggtggaggagaagcagctgctgatcagaaccaaccaggacctgctggagaagatctacagactggagatggaggagaaccagctgaagaacgagatgcaggacgccaaggaccagaacgagctgctggagttcagagtgctggagctggaggtgagagacagcatctgctgcaagctgagcaacggcgccgacatcctgttcgagcccaagctgaagttcatgtag

SEQ ID NO: 18895 - DNA, 2496 bp, Artificial Sequence
  Description of Artificial Sequence: Synthetic coding sequence
atgagcaagaagggcagaagcaagggcgagaagcccgagatggagaccgacgccgtgcagatggccaacgaggagctgagagccaagctgaccagcatccagatcgagttccagcaggagaagagcaaggtgggcaagctgagagagagactgcaggaggccaagctggagagagagcaggagcagagaagacacaccgcctacatcagcgagctgaaggccaagctgcacgaggagaagaccaaggagctgcaggccctgagagagggcctgatcagacagcacgagcaggaggccgccagaaccgccaagatcaaggagggcgagctgcagagactgcaggccaccctgaacgtgctgagagacggcgccgccgacaaggtgaagaccgccctgctgaccgaggccagagaggaggccagaagagccttcgacggcgagagactgagactgcagcaggagatcctggagctgaaggccgccagaaagcaggccgaggaggccctgagcaactgcatgcaggccgacaagaccaaggccgccgacctgagagccgcctaccaggcccaccaggacgaggtgcacagaatcaagagagagtgcgagagagacatcagaagactgatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgaaggagaagctgagcgcccaggccagcctgaagagacacaccagcctgaacgacctgagcctgaccagagacgagcaggagatcgagttcctgagactgcaggtgctggagcagcagcacgtgatcgacgacctgagcctggagagagagagactgctgagaagcaagagacacagaggcaagagcctgaagccccccaagaagcacgtggtggagaccttcttcggcttcgacgaggagagcgtggacagcgagaccctgagcgagaccagctacaacaccgacagaaccgacagaacccccgccacccccgaggaggacctggacgacgccaccgccagagaggaggccgacctgagattctgccagctgaccagagagtaccaggccctgcagagagcctacgccctgctgcaggagcaggtgggcggcaccctggacgccgagagagaggccagaaccagagagcagctgcaggccgacctgctgagatgccaggccaagatcgaggacctggagaagctgctggtggagaagggccaggacagcaagtgggtggaggagaagcagctgctgatcagaaccaaccaggacctgctggagaagatctacagactggagatggaggagaaccagctgaagaacgagatgcaggacgccaaggaccagaacgagctgctggagttcagagtgctggagctggaggagagagagagaagaagccccgccttcaacctgcagatcaccaccttccccgagaaccacagcagcgccctgcagctgttctgccaccaggagggcgtgaaggacgtgaacgtgagcgagctgatgaagaagctggacatcctgggcgacaacggcaacctgagaaacgaggagcaggtggccatcatccaggccggcaccgtgctggccctgtgcgagaagtggctgaagcagatcgagggcaccgaggccgccctgacccagaagatgctggacctggagaaggagaaggacctgttcagcagacagaagggctacctggaggaggagctggactacagaaagcaggccctggaccaggcctacctgaagatccaggacctggaggccaccctgtacaccgccctgcagcaggagcccggcagaagagccggcgaggccctgagcgagggccagagagaggacctgcaggccgccgtggagaaggtgagaagacagatcctgagacagagcagagagttcgacagccagatcctgagagagagaatggagctgctgcagcaggcccagcagagaatcagagagctggaggacaagctggagttccagaagagacacctgaaggagctggaggagaagttcctgttcctgttcctgttcttcagcctggccttcatcctgtggccctag

SEQ ID NO: 18896 - DNA, 1941 bp, Artificial Sequence
  Description of Artificial Sequence: Synthetic coding sequence
atgagcaagaagggcagaagcaagggcgagaagcccgagatggagaccgacgccgtgcagatggccaacgaggagctgagagccaagctgaccagcatccagatcgagttccagcaggagaagagcaagatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgaaggagaagctgagcgcccaggccagcctgaagagacacaccagcctgaacgacctgagcctgaccagagacgagcaggagatcgagttcctgagactgcaggtgctggagcagcagcacgtgatcgacgacctgagcctgaagcacgtggtggagaccttcttcggcttcgacgaggagagcgtggacagcgagaccctgagcgagaccagctacaacaccgacagaaccgacagaacccccgccacccccgaggaggacctggacgacgccaccgccagagaggaggccgacctgagattctgccagctgaccagagagtaccaggccctgcagagagcctacgccctgctgcaggagcaggtgggcggcaccctggacgccgagagagaggccagaaccagagagcagctgcaggccgacctgctgagatgccaggccaagatcgaggacctggagaagctgctggtggagaagggccaggacagcaagtgggtggaggagaagcagctgctgatcagaaccaaccaggacctgctggagaagatctacagactggagatggaggagaaccagctgaagaacgagatgcaggacgccaaggaccagaacgagctgctggagttcagagtgctggagctggaggagagagagagaagaagccccgccttcaacctgcagatcaccaccttccccgagaaccacagcagcgccctgcagctgttctgccaccaggagggcgtgaaggacgtgaacgtgagcgagctgatgaagaagctggacatcctgggcgacaacggcaacctgagaaacgaggagcaggtggccatcatccaggccggcaccgtgctggccctgtgcgagaagtggctgaagcagatcgagggcaccgaggccgccctgacccagaagatgctggacctggagaaggagaaggacctgttcagcagacagaagggctacctggaggaggagctggactacagaaagcaggccctggaccaggcctacctgaagatccaggacctggaggccaccctgtacaccgccctgcagcaggagcccggcagaagagccggcgaggccctgagcgagggccagagagaggacctgcaggccgccgtggagaaggtgagaagacagatcctgagacagagcagagagttcgacagccagatcctgagagagagaatggagctgctgcagcaggcccagcagagaatcagagagctggaggacaagctggagttccagaagagacacctgaaggagctggaggagaagttcctgttcctgttcctgttcttcagcctggccttcatcctgtggccctag

SEQ ID NO: 18897 - DNA, 1881 bp, Artificial Sequence; identical to SEQ ID NO: 18894
  Description of Artificial Sequence: Synthetic coding sequence

SEQ ID NO: 18898 - DNA, 1296 bp, Artificial Sequence
  Description of Artificial Sequence: Synthetic coding sequence
atgagcaagaagggcagaagcaagggcgagaagcccgagatggagaccgacgccgtgcagatggccaacgaggagctgagagccaagctgaccagcatccagatcgagttccagcaggagaagagcaaggtgggcaagctgagagagagactgcaggaggccaagctggagagagagcaggagcagagaagacacaccgcctacatcagcgagctgaaggccaagctgcacgaggagaagaccaaggagctgcaggccctgagagagggcctgatcagacagcacgagcaggaggccgccagaaccgccaagatcaaggagggcgagctgcagagactgcaggccaccctgaacgtgctgagagacggcgccgccgacaaggtgaagaccgccctgctgaccgaggccagagaggaggccagaagagccttcgacggcgagagactgagactgcagcaggagatcctggagctgaaggccgccagaaagcaggccgaggaggccctgagcaactgcatgcaggccgacaagaccaaggccgccgacctgagagccgcctaccaggcccaccaggacgaggtgcacagaatcaagagagagtgcgagagagacatcagaagactgatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgcccgaccccgccggcgcccacggcgccgccgccgccggccccgccgagaaccccagaaccggcggccagaccggcgtgagcgaggccgcccccgagagaaccggcggcaaggtgttcgtgcccttcttcgtgttcctgaccagcatccacagcgtggccctgatgaccagcgtgagccaggagctgggcctgtag

SEQ ID NO: 18899 - DNA, 1710 bp, Artificial Sequence
  Description of Artificial Sequence: Synthetic coding sequence
atgagcaagaagggcagaagcaagggcgagaagcccgagatggagaccgacgccgtgcagatggccaacgaggagctgagagccaagctgaccagcatccagatcgagttccagcaggagaagagcaaggtgggcaagctgagagagagactgcaggaggccaagctggagagagagcaggagcagagaagacacaccgcctacatcagcgagctgaaggccaagctgcacgaggagaagaccaaggagctgcaggccctgagagagggcctgatcagacagcacgagcaggaggccgccagaaccgccaagatcaaggagggcgagctgcagagactgcaggccaccctgaacgtgctgagagacggcgccgccgacaaggtgaagaccgccctgctgaccgaggccagagaggaggccagaagagccttcgacggcgagagactgagactgcagcaggagatcctggagctgaaggccgccagaaagcaggccgaggaggccctgagcaactgcatgcaggccgacaagaccaaggccgccgacctgagagccgcctaccaggcccaccaggacgaggtgcacagaatcaagagagagtgcgagagagacatcagaagactgatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgaaggagaagctgagcgcccaggccagcctgaagagacacaccagcctgaacgacctgagcctgaccagagacgagcaggagatcgagttcctgagactgcaggtgctggagcagcagcacgtgatcgacgacctgagcctggagagagagagactgctgagaagcaagagacacagaggcaagagcctgaagccccccaagaagcacgtggtggagaccttcttcggcttcgacgaggagagcgtggacagcgagaccctgagcgagaccagctacaacaccgacagaaccgacagaacccccgccacccccgaggaggacctggacgacgccaccgccagagaggaggccgacctgagattctgccagctgaccagagaggacctgcaggccgccgtggagaaggtgagaagacagatcctgagacagagcagagagttcgacagccagatcctgagagagagaatggagctgctgcagcaggcccagcagagaatcagagagctggaggacaagctggagttccagaagagacacctgaaggagctggaggagaagttcctgttcctgttcctgttcttcagcctggccttcatcctgtggccctag

SEQ ID NO: 18900 - DNA, 1557 bp, Artificial Sequence
  Description of Artificial Sequence: Synthetic coding sequence
atgagcaagaagggcagaagcaagggcgagaagcccgagatggagaccgacgccgtgcagatggccaacgaggccctgagagagggcctgatcagacagcacgagcaggaggccgccagaaccgccaagatcaaggagatcctggagctgaaggccgccagaaagcaggccgaggaggccctgagcaactgcatgcaggccgacaagaccaaggccgccgacctgagagccgcctaccaggcccaccaggacgaggtgcacagaatcaagagagagtgcgagagagacatcagaagactgatggacgagatcaagggcaaggacagagtgatcctggccctggagaaggagctgggcgtgcaggccggccagacccagaagctgctgctgcagaaggaggccctggacgagcagctggtgcaggtgaaggaggccgagagacaccacagcagccccaagagagagctgccccccggcatcggcgacatggtggagctgatgggcgtgcaggaccagcacatggacgagagagacgtgagaagattccagctgaagatcgccgagctgaacagcgtgatcagaaagctggaggacagaaacaccctgctggccgacgagagaaacgagctgctgaagagaagcagagagaccgaggtgcagctgaagcccctggtggagaagaacaagagaatgaacaagaagaacgaggacctgctgcagagcatccagagaatggaggagaagatcaagaacctgaccagagagaacgtggagatgaaggagaagctgagcgcccaggccagcctgaagagacacaccagcctgaacgacctgagcctgaccagagacgagcaggagatcgagttcctgagactgcaggtgctggagcagcagcacgtgatcgacgacctgagcctggagagagagagactgctgagaagcaagagacacagaggcaagagcctgaagccccccaagaagcacgtggtggagaccttcttcggcttcgacgaggagagcgtggacagcgagaccctgagcgagaccagctacaacaccgacagaaccgacagaacccccgccacccccgaggaggacctggacgacgccaccgccagagaggaggccgacctgagattctgccagctgaccagagagtaccaggccctgcagagagcctacgccctgctgcaggagcaggtgggcggcaccctggacgccgagagagaggccagaaccagagagcagctgcaggccgacctgctgagatgccaggccaagatcgaggacctggagaagctgctggtggagaagggccaggacagcaagtgggtggaggagaagcagctgctgatcagaaccaaccaggacctgctggagaagatctacagactggagatggaggagaaccagctgaagaacgagatgcaggacgccaaggaccagaacgagctgctggagttcagagtgctggagctggaggtgagagacagcatctgctgcaagctgagcaacggcgccgacatcctgttcgagcccaagctgaagttcatgtag

SEQ ID NO: 18901 - DNA, 2433 bp, Artificial Sequence
  Description of Artificial Sequence: Synthetic coding sequence
atgagcaagaagggcagaaacaagggcgagaagcccgaggccctgatcgtggccctgcaggccgccaacgaggacctgagaaccaagctgaccgacatccagatcgagctgcaccaggagaagagcaaggtgagcaagctggagagagagaagacccaggaggccaagagaatcagagagctggagcagagaaagcacaccgtgctggtgaccgagctgaaggccaagctgcacgaggagaagatgaaggagctgcaggccgtgagagagaacctgatcaagcagcacgagcaggagatgagcagaaccgtgaaggtgagagacggcgagatccagagactgaagagcgccctgtgcgccctgagagacggcagcagcgacaaggtgagaaccgccctgaccatcgaggccagagaggaggccagaaagctgttcgacaccgagagactgaagctgctgcaggagatcgccgacctgaagaccgccaagaagcaggtggacgaggccctgagcaacatgatccaggccgacaagatcaaggccggcgacctgagaagcgagcaccagagccaccaggaggccatcagcaagatcaagtgggagagcgagagagacatcagaagactgatggacgagatcaaggccaaggacagaatcatcttcagcctggagaaggagctggagacccagaccggctacgtgcagaagctgcagctgcagaaggaggccctggacgagcagctgttcctggtgaaggaggccgagtgcaacatgagcagccccaagagagagatccccggcagagccggcgacggcagcgagcactgcagcagccccgacctgagaagaaaccagaagagaatcgccgagctgaacgccaccatcagaaagctggaggacagaaacaccctgctgggcgacgagagaaacgagctgctgaagagagtgagagagaccgagaagcagtgcaagcccctgctggagagaaacaagtgcctggccaagagaaacgacgagctgatggtgagcctgcagagaatggaggagaagctgaaggccgtgaccaaggagaacagcgagatgagagagaagatcaccagccacccccccctgaagaagctgaagagcctgaacgacctggaccaggccaacgaggagcaggagaccgagttcctgaagctgcaggtgatcgagcagcagaacatcatcgacgagctgaccagagacagagagaagctgatcagaagaagaaagcacagaagaagcagcaagcccatcaagagacccgtgctggaccccttcatcggctacgacgaggacagcatggacagcgagaccagcagcatggccagcttcagaaccgacagaacccccgccacccccgacgacgacctggacgagagcctggccgccgaggagagcgagctgagattcagacagctgaccaaggagtaccaggccctgcagagagcctacgccctgctgcaggagcagaccggcggcatcatcgacgccgagagagaggccaaggcccaggagcagctgcaggccgaggtgctgagatacaaggccaagatcgaggacctggaggccaccctggcccagaagggccaggacagccactgggtggaggacaagcagctgttcatcaagagaaaccaggagctgctggagaagatcgagaagcaggaggccgagaaccacagactgcagcaggagctgcaggacgccagagaccagaacgagctgctggagttcagaaacctggagctggaggagagagagagaagaagcccccccttcaacctgcagatccaccccttcagcgacggcgtgagcgccctgcagatctactgcatgaaggagggcgtgaaggacgtgaacatccccgacctgatcaagcagctggacatcctgggcgacaacggcaacctgagaaacgaggagcaggtggccatcatccaggccagcaccgtgctgagcctggccgagaagtggatccagcagatcgagggcgccgaggccgccctgcaccagaagatgatggagctggagagcgacatggagcagttctgcaagatcaagggctacctggaggaggagctggactacagaaagcaggccctggaccaggcctacatgagaatccaggagctggaggccaccctgtacaacgccctgcagcaggagaccgtgatcaagttcggcgagctgctgagcgagaagcagcaggaggagctgagaaccgccgtggagaagctgagaagacagatgctgagaaagagcagagagtacgactgccagatcctgcaggagagaatggagctgctgcagcaggcccaccagagaatcagagacctggaggacaagaccgacatccagaagagacagatcaaggacctggaggagaagagcaacagaaagcacggctag

SEQ ID NO: 18902 - DNA, 2337 bp, Artificial Sequence
  Description of Artificial Sequence: Synthetic coding sequence
atggtgagcaagctggagagagagaagacccaggaggccaagagaatcagagagctggagcagagaaagcacaccgtgctggtgaccgagctgaaggccaagctgcacgaggagaagatgaaggagctgcaggccgtgagagagaacctgatcaagcagcacgagcaggagatgagcagaaccgtgaaggtgagagacggcgagatccagagactgaagagcgccctgtgcgccctgagagacggcagcagcgacaaggtgagaaccgccctgaccatcgaggccagagaggaggccagaaagctgttcgacaccgagagactgaagctgctgcaggagatcgccgacctgaagaccgccaagaagcaggtggacgaggccctgagcaacatgatccaggccgacaagatcaaggccggcgacctgagaagcgagcaccagagccaccaggaggccatcagcaagatcaagtgggagagcgagagagacatcagaagactgatggacgagatcaaggccaaggacagaatcatcttcagcctggagaaggagctggagacccagaccggctacgtgcagaagctgcagctgcagaaggaggccctggacgagcagctgttcctggtgaaggaggccgagtgcaacatgagcagccccaagagagagatccccggcagagccggcgacggcagcgagcactgcagcagccccgacctgagaagaaaccagaagagaatcgccgagctgaacgccaccatcagaaagctggaggacagaaacaccctgctgggcgacgagagaaacgagctgctgaagagagtgagagagaccgagaagcagtgcaagcccctgctggagagaaacaagtgcctggccaagagaaacgacgagctgatggtgagcctgcagagaatggaggagaagctgaaggccgtgaccaaggagaacagcgagatgagagagaagatcaccagccacccccccctgaagaagctgaagagcctgaacgacctggaccaggccaacgaggagcaggagaccgagttcctgaagctgcaggtgatcgagcagcagaacatcatcgacgagctgaccagagacagagagaagctgatcagaagaagaaagcacagaagaagcagcaagcccatcaagagacccgtgctggaccccttcatcggctacgacgaggacagcatggacagcgagaccagcagcatggccagcttcagaaccgacagaacccccgccacccccgacgacgacctggacgagagcctggccgccgaggagagcgagctgagattcagacagctgaccaaggagtaccaggccctgcagagagcctacgccctgctgcaggagcagaccggcggcatcatcgacgccgagagagaggccaaggcccaggagcagctgcaggccgaggtgctgagatacaaggccaagatcgaggacctggaggccaccctggcccagaagggccaggacagccactgggtggaggacaagcagctgttcatcaagagaaaccaggagctgctggagaagatcgagaagcaggaggccgagaaccacagactgcagcaggagctgcaggacgccagagaccagaacgagctgctggagttcagaaacctggagctggaggagagagagagaagaagcccccccttcaacctgcagatccaccccttcagcgacggcgtgagcgccctgcagatctactgcatgaaggagggcgtgaaggacgtgaacatccccgacctgatcaagcagctggacatcctgggcgacaacggcaacctgagaaacgaggagcaggtggccatcatccaggccagcaccgtgctgagcctggccgagaagtggatccagcagatcgagggcgccgaggccgccctgcaccagaagatgatggagctggagagcgacatggagcagttctgcaagatcaagggctacctggaggaggagctggactacagaaagcaggccctggaccaggcctacatgagaatccaggagctggaggccaccctgtacaacgccctgcagcaggagaccgtgatcaagttcggcgagctgctgagcgagaagcagcaggaggagctgagaaccgccgtggagaagctgagaagacagatgctgagaaagagcagagagtacgactgccagatcctgcaggagagaatggagctgctgcagcaggcccaccagagaatcagagacctggaggacaagaccgacatccagaagagacagatcaaggacctggaggagaagttcctgttcctgttcctgttcttcagcctggccttcatcctgtggccctag

SEQ ID NO: 18903 - DNA, 2400 bp, Artificial Sequence
  Description of Artificial Sequence: Synthetic coding sequence
atgagcaagaagggcagaaacaagggcgagaagcccgaggccctgatcgtggccctgcaggccgccaacgaggacctgagaaccaagctgaccgacatccagatcgagctgcaccaggagaagagcaaggtgagcaagctggagagagagaagacccaggaggccaagagaatcagagagctggagcagagaaagcacaccgtgctggtgaccgagctgaaggccaagctgcacgaggagaagatgaaggagctgcaggccgtgagagagaacctgatcaagcagcacgagcaggagatgagcagaaccgtgaaggtgagagacggcgagatccagagactgaagagcgccctgtgcgccctgagagacggcagcagcgacaaggtgagaaccgccctgaccatcgaggccagagaggaggccagaaagctgttcgacaccgagagactgaagctgctgcaggagatcgccgacctgaagaccgccaagaagcaggtggacgaggccctgagcaacatgatccaggccgacaagatcaaggccggcgacctgagaagcgagcaccagagccaccaggaggccatcagcaagatcaagtgggagagcgagagagacatcagaagactgatggacgagatcaaggccaaggacagaatcatcttcagcctggagaaggagctggagacccagaccggctacgtgcagaagctgcagctgcagaaggaggccctggacgagcagctgttcctggtgaaggaggccgagtgcaacatgagcagccccaagagagagatccccggcagagccggcgacggcagcgagcactgcagcagccccgacctgagaagaaaccagaagagaatcgccgagctgaacgccaccatcagaaagctggaggacagaaacaccctgctgggcgacgagagaaacgagctgctgaagagagtgagagagaccgagaagcagtgcaagcccctgctggagagaaacaagtgcctggccaagagaaacgacgagctgatggtgagcctgcagagaatggaggagaagctgaaggccgtgaccaaggagaacagcgagatgagagagaagatcaccagccacccccccctgaagaagctgaagagcctgaacgacctggaccaggccaacgaggagcaggagaccgagttcctgaagctgcaggtgatcgagcagcagaacatcatcgacgagctgaccagagacagagagaagctgatcagaagaagaaagcacagaagaagcagcaagcccatcaagagacccgtgctggaccccttcatcggctacgacgaggacagcatggacagcgagaccagcagcatggccagcttcagaaccgacagaacccccgccacccccgacgacgacctggacgagagcctggccgccgaggagagcgagctgagattcagacagctgaccaaggagtaccaggccctgcagagagcctacgccctgctgcaggagcagaccggcggcatcatcgacgccgagagagaggccaaggcccaggagcagctgcaggccgaggtgctgagatacaaggccaagatcgaggacctggaggccaccctggcccagaagggccagatcgagaagcaggaggccgagaaccacagactgcagcaggagctgcaggacgccagagaccagaacgagctgctggagttcagaaacctggagctggaggagagagagagaagaagcccccccttcaacctgcagatccaccccttcagcgacggcgtgagcgccctgcagatctactgcatgaaggagggcgtgaaggacgtgaacatccccgacctgatcaagcagctggacatcctgggcgacaacggcaacctgagaaacgaggagcaggtggccatcatccaggccagcaccgtgctgagcctggccgagaagtggatccagcagatcgagggcgccgaggccgccctgcaccagaagatgatggagctggagagcgacatggagcagttctgcaagatcaagggctacctggaggaggagctggactacagaaagcaggccctggaccaggcctacatgagaatccaggagctggaggccaccctgtacaacgccctgcagcaggagaccgtgatcaagttcggcgagctgctgagcgagaagcagcaggaggagctgagaaccgccgtggagaagctgagaagacagatgctgagaaagagcagagagtacgactgccagatcctgcaggagagaatggagctgctgcagcaggcccaccagagaatcagagacctggaggacaagaccgacatccagaagagacagatcaaggacctggaggagaagttcctgttcctgttcctgttcttcagcctggccttcatcctgtggccctag

SEQ ID NO: 18904 - DNA, 2370 bp, Artificial Sequence
  Description of Artificial Sequence: Synthetic coding sequence
atgagcaagaagggcagaaacaagggcgagaagcccgaggccctgatcgtggccctgcaggccgccaacgaggacctgagaaccaagctgaccgacatccagatcgagctgcaccaggagaagagcaaggtgagcaagctggagagagagaagacccaggaggccaagagaatcagagagctggagcagagaaagcacaccgtgctggtgaccgagctgaaggccaagctgcacgaggagaagatgaaggagctgcaggccgtgagagagaacctgatcaagcagcacgagcaggagatgagcagaaccgtgaaggtgagagacggcgagatccagagactgaagagcgccctgtgcgccctgagagacggcagcagcgacaaggtgagaaccgccctgaccatcgaggccagagaggaggccagaaagctgttcgacaccgagagactgaagctgctgcaggagatcgccgacctgaagaccgccaagaagcaggtggacgaggccctgagcaacatgatccaggccgacaagatcaaggccggcgacctgagaagcgagcaccagagccaccaggaggccatcagcaagatcaagtgggagagcgagagagacatcagaagactgatggacgagatcaaggccaaggacagaatcatcttcagcctggagaaggagctggagacccagaccggctacgtgcagaagctgcagctgcagaaggaggccctggacgagcagctgttcctggtgaaggaggccgagtgcaacatgagcagccccaagagagagatccccggcagagccggcgacggcagcgagcactgcagcagccccgacctgagaagaaaccagaagagaatcgccgagctgaacgccaccatcagaaagctggaggacagaaacaccctgctgggcgacgagagaaacgagctgctgaagagagtgagagagaccgagaagcagtgcaagcccctgctggagagaaacaagtgcctggccaagagaaacgacgagctgatggtgagcctgcagagaatggaggagaagctgaaggccgtgaccaaggagaacagcgagatgagagagaagatcaccagccacccccccctgaagaagctgaagagcctgaacgacctggaccaggccaacgaggagcaggagaccgagttcctgaagctgcaggtgatcgagcagcagaacatcatcgacgagctgaccagagacagagagaagctgatcagaagaagaaagcacagaagaagcagcaagcccatcaagagacccgtgctggaccccttcatcggctacgacgaggacagcatggacagcgagaccagcagcatggccagcttcagaaccgacagaacccccgccacccccgacgacgacctggacgagagcctggccgccgaggagagcgagctgagattcagacagctgaccaaggagtaccaggccctgcagagagcctacgccctgctgcaggagcagaccggcggcatcatcgacgccgagagagaggccaaggcccaggagcagctgcaggccgaggtgctgagatacaaggccaagatcgaggacctggaggccaccctggcccagaagggccagatcgagaagcaggaggccgagaaccacagactgcagcaggagctgcaggacgccagagaccagaacgagctgctggagttcagaaacctggagctggaggagagagagagaagaagcccccccttcaacctgcagatccaccccttcagcgacggcgtgagcgccctgcagatctactgcatgaaggagggcgtgaaggacgtgaacatccccgacctgatcaagcagctggacatcctgggcgacaacggcaacctgagaaacgaggagcaggtggccatcatccaggccagcaccgtgctgagcctggccgagaagtggatccagcagatcgagggcgccgaggccgccctgcaccagaagatgatggagctggagagcgacatggagcagttctgcaagatcaagggctacctggaggaggagctggactacagaaagcaggccctggaccaggcctacatgagaatccaggagctggaggccaccctgtacaacgccctgcagcaggagaccgtgatcaagttcggcgagctgctgagcgagaagcagcaggaggagctgagaaccgccgtggagaagctgagaagacagatgctgagaaagagcagagagtacgactgccagatcctgcaggagagaatggagctgctgcagcaggcccaccagagaatcagagacctggaggacaagaccgacatccagaagagacagatcaaggacctggaggagaagagcaacagaatgcccgcctag

SEQ ID NO: 18905 - DNA, 2535 bp, Artificial Sequence
  Description of Artificial Sequence: Synthetic coding sequence
atgagcaagagaggcatgagcagcagagccaagggcgacaaggccgaggccctggccgccctgcaggccgccaacgaggacctgagagccaagctgaccgacatccagatcgagctgcagcaggagaagagcaaggtgagcaaggtggagagagagaagaaccaggagctgagacaggtgagagagcacgagcagcacaagaccgccgtgctgctgaccgagctgaagaccaagctgcacgaggagaagatgaaggagctgcaggccgtgagagagaccctgctgagacagcacgaggccgagctgctgagagtgatcaagatcaaggacaacgagaaccagagactgcaggccctgctgagcgccctgagagacggcggccccgagaaggtgaagaccgtgctgctgagcgaggccaaggaggaggccaagaagggcttcgaggtggagaaggtgaagatgcagcaggagatcagcgagctgaagggcgccaagagacaggtggaggaggccctgaccctggtgatccaggccgacaagatcaaggccgccgagatcagaagcgtgtaccacctgcaccaggaggagatcaccagaatcaagaaggagtgcgagagagagatcagaagactgatggaggagatcaagttcaaggacagagccgtgttcgtgctggagagagagctgggcgtgcaggccggccacgcccagagactgcagctgcagaaggaggccctggacgagcagctgagccaggtgagagaggccgacagacaccccggcagccccagaagagagctgccccacgccgccggcgccggcgacgccagcgaccacagcggcagccccgagcagcagctggacgagaaggacgccagaagattccagctgaagatcgccgagctgagcgccatcatcagaaagctggaggacagaaacgccctgctgagcgaggagagaaacgagctgctgaagagagtgagagaggccgagagccagtacaagcccctgctggacaagaacaagagactgagcagaaagaacgaggacctgagccacgccctgagaagaatggagaacaagctgaagttcgtgacccaggagaacatcgagatgagacagagagccggcatcatcagaagacccagcagcctgaacgacctggaccagagccaggacgagagagaggtggacttcctgaagctgcagatcgtggagcagcagaacctgatcgacgagctgagcaagaccctggagaccgccggctacgtgaagagcgtgctggagagagacaagctgctgagattcagaaagcagagaaagaagatggccaagctgcccaagcccgtggtggtggagaccttcttcggctacgacgaggaggccagcctggagagcgacggcagcagcgtgagctaccagaccgacagaaccgaccagaccccctgcacccccgacgacgacctggaggagggcatggccaaggaggagaccgagctgagattcagacagctgaccatggagtaccaggccctgcagagagcctacgccctgctgcaggagcaggtgggcggcaccctggacgccgagagagaggtgaagaccagagagcagctgcaggccgaggtgcagagagcccaggccagaatcgaggacctggagaaggccctggccgagcagggccaggacatgaagtggatcgaggagaagcaggccctgtacagaagaaaccaggagctggtggagaagatcaagcagatggagaccgaggaggccagactgagacacgaggtgcaggacgccagagaccagaacgagctgctggagttcagaatcctggagctggaggagagagagagaaagagccccgccatcagcttccaccacacccccttcgtggacggcaagagccccctgcaggtgtactgcgaggccgagggcgtgaccgacatcgtggtggccgagctgatgaagaagctggacatcctgggcgacaacgccaacctgaccaacgaggagcaggtggtggtgatccaggccagaaccgtgctgaccctggccgagaagtggctgcagcagatcgaggagaccgaggccgccctgcagagaaagatggtggacctggagagcgagaaggagctgttcagcaagcagaagggctacctggacgaggagctggactacagaaagcaggccctggaccaggccaacaagcacatcctggagctggaggccatgctgtacgacgccctgcagcaggaggccggcgccaaggtggccgagctgctgagcgaggaggagagagagaagctgaaggtggccgtggagcagtggaagagacaggtgatgagcgagctgagagagagagacgcccagatcctgagagagagaatggagctgctgcagctggcccagcagagaatcaaggagctggaggagagaatcgaggcccagaagagacagatcaaggagctggaggagaagttcctgttcctgttcctgttcttcagcctggccttcatcctgtggagctag

SEQ ID NO: 18906 - DNA, 996 bp, Artificial Sequence
  Description of Artificial Sequence: Synthetic coding sequence
atgagcatgaccaccagagcctgggaggagctggacggcggcctgggcagctgccaggccctggaggaccacagcgccctggccgagacccaggaggacagagccagcgccacccccagactggccgacagcggcagcgtgccccacgacagccaggtggccgagggccccagcgtggacaccagacccaagaagatggagaaggagcccgccgccagaggcacccccggcaccggcaaggagagactgaaggccggcgccagccccagaagcgtgcccgccagaaagaaggcccagaccgccccccccctgcagccccccccccccccccccgccctgagcgaggagctgccctggggcgacctgagcctgaacaagtgcctggtgctggccagcctggtggccctgctgggcagcgccttccagctgtgcagagacgccgtgcccggcgaggccgccctgcaggccagagtgcccgagccctgggtgccccccagcagcgcccccagagagcccagcagccccctgcccaagttcgaggcccaggccccccccagcgccccccccgcccccagagccgaggccgaggtgagacccaagatccccggcagcagagaggccgccgagaacgacgaggaggagcccggcgaggccaccggcgaggccgtgagagaggacagagtgaccctggccgacagaggccccaaggagagacccagaagagagggcaagcccagaaaggagaagcccagaaaggaggagagacccaagaaggagagacccagaaaggaggagagacccagagccgccagagagcccagagaggccctgccccagagatgggagagcagagagggcggccacagaccctgggccagagacagcagagacgccgagcccagaaagaagcaggcctgggtgagccccagaagacccgacgaggagcagagacccggcagcagacagaagctgagagccggcaagggcagagactag

SEQ ID NO: 18907 - DNA, 1887 bp, Artificial Sequence
  Description of Artificial Sequence: Synthetic coding sequence
atgagccccggcggcaagttcgacttcgacgacggcggctgctacgtgggcggctgggaggccggcagagcccacggctacggcgtgtgcaccggccccggcgcccagggcgagtacagcggctgctgggcccacggcttcgagagcctgggcgtgttcaccggccccggcggccacagctaccagggccactggcagcagggcaagagagagggcctgggcgtggagagaaagagcagatggacctacagaggcgagtggctgggcggcctgaagggcagaagcggcgtgtgggagagcgtgagcggcctgagatacgccggcctgtggaaggacggcttccaggacggctacggcaccgagacctacagcgacggcggcacctaccagggccagtggcaggccggcaagagacacggctacggcgtgagacagagcgtgccctaccaccaggccgccctgctgagaagccccagaagaaccagcctggacagcggccacagcgacccccccaccccccccccccccctgcccctgcccggcgacgagggcggcagccccgccagcggcagcagaggcggcttcgtgctggccggccccggcgacgccgacggcgccagcagcagaaagagaacccccgccgccggcggcttcttcagaagaagcctgctgctgagcggcctgagagccggcggcagaagaagcagcctgggcagcaagagaggcagcctgagaagcgaggtgagcagcgaggtgggcagcaccggcccccccggcagcgaggccagcggcccccccgccgccgccccccccgccctgatcgagggcagcgccaccgaggtgtacgccggcgagtggagagccgacagaagaagcggcttcggcgtgagccagagaagcaacggcctgagatacgagggcgagtggctgggcaacagaagacacggctacggcagaaccaccagacccgacggcagcagagaggagggcaagtacaagagaaacagactggtgcacggcggcagagtgagaagcctgctgcccctggccctgagaagaggcaaggtgaaggagaaggtggacagagccgtggagggcgccagaagagccgtgagcgccgccagacagagacaggagatcgccgccgccagagccgccgacgccctgctgaaggccgtggccgccagcagcgtggccgagaaggccgtggaggccgccagaatggccaagctgatcgcccaggacctgcagcccatgctggaggcccccggcagaagacccagacaggacagcgagggcagcgacaccgagcccctggacgaggacagccccggcgtgtacgagaacggcctgacccccagcgagggcagccccgagctgcccagcagccccgccagcagcagacagccctggagaccccccgcctgcagaagccccctgccccccggcggcgaccagggccccttcagcagccccaaggcctggcccgaggagtggggcggcgccggcgcccaggccgaggagctggccggctacgaggccgaggacgaggccggcatgcagggccccggccccagagacggcagccccctgctgggcggctgcagcgacagcagcggcagcctgagagaggaggagggcgaggacgaggagcccctgccccccctgagagcccccgccggcaccgagcccgagcccatcgccatgctggtgctgagaggcagcagcagcagaggccccgacgccggctgcctgaccgaggagctgggcgagcccgccgccaccgagagacccgcccagcccggcgccgccaaccccctggtggtgggcgccgtggccctgctggacctgagcctggccttcctgttcagccagctgctgacctag

SEQ ID NO: 18908 - DNA, 1887 bp, Artificial Sequence; identical to SEQ ID NO: 18907
  Description of Artificial Sequence: Synthetic coding sequence

SEQ ID NO: 18909 - DNA, 1887 bp, Artificial Sequence; identical to SEQ ID NO: 18907
  Description of Artificial Sequence: Synthetic coding sequence

SEQ ID NO: 18910 - DNA, 1524 bp, Artificial Sequence
  Description of Artificial Sequence: Synthetic coding sequence
atgagaagactgcccagagccctgctgctgcagctgagactggccctgctggtggccgccggcgcccccgaggtgctggtgagcgcccccagaagcctggtgtggggccccggcctgcaggccgccgtggtgctgcccgtgagatacttctacctgcaggccgtgaacagcgagggccagaacctgaccagaagccccgccggcgagacccccttcaaggtggtggtgaagagcctgagccccaaggagctggtgagaatccacgtgcccaagcccctggacagaaacgacggcaccttcctgatgagatacagaatgtacgagaccgtggacgagggcctgaagatcgaggtgctgtacggcgacgagcacgtggcccagagcccctacatcctgaagggccccgtgtaccacgagtactgcgagtgccccgaggacccccaggcctggcagaagaccctgagctgccccaccaaggagccccagatcgccaaggacttcgccagcttccccagcatcaacctgcagcagatgctgaaggaggtgcccaagagattcggcgacgagagaggcgccatcgtgcactacaccatcctgaacaaccacgtgtacagaagaagcctgggcaagtacaccgacttcaagatgttcagcgacgagatcctgctgagcctgaccagaaaggtgctgctgcccgacctggagttctacgtgaacctgggcgactggcccctggagcacagaaaggtgaacggcacccccagccccatccccatcatcagctggtgcggcagcctggacagcagagacgtggtgctgcccacctacgacatcacccacagcatgctggaggccatgagaggcgtgaccaacgacctgctgagcatccagggcaacaccggccccagctggatcaacaagaccgagagagccttcttcagaggcagagacagcagagaggagagactgcagctggtgcagctgagcaaggagaacccccagctgctggacgccggcatcaccggctacttcttcttccaggagaaggagaaggagctgggcaaggccaagctgatgggcttcttcgacttcttcaagtacaagtaccaggtgaacgtggacggcaccgtggccgcctacagatacccctacctgatgctgggcgacagcctggtgctgaagcaggacagcccctactacgagcacttctacatggccctggagccctggaagcactacgtgcccatcaagagaaacctgagcgacctgctggagaaggtgaagtgggccaaggagaacgacgaggaggccaagaagatcgccaaggagggccagctgatggccagagacctgctgcagccccacagactgtactgctactactaccaggtgctgcagaagtacgccgagagacagagcagcaagcccgaggtgagagacggcatggagctggtgccccagcccgaggacagcaccgccatctgccagtgccacagaaagaagcccagcagagaggagctgtag

SEQ ID NO: 18911 - DNA, 1230 bp, Artificial Sequence
  Description of Artificial Sequence: Synthetic coding sequence
atggtggagctgttcatcttcctgttcctgctgggcgagacccccttcaaggtggtggtgaagagcctgagccccaaggagctggtgagaatccacgtgcccaagcccctggacagaaacgacggcaccttcctgatgagatacagaatgtacgagaccgtggacgagggcctgaagatcgaggtgctgtacggcgacgagcacgtggcccagagcccctacatcctgaagggccccgtgtaccacgagtactgcgagtgccccgaggacccccaggcctggcagaagaccctgagctgccccaccaaggagccccagatcgccaaggacttcgccagcttccccagcatcaacctgcagcagatgctgaaggaggtgcccaagagattcggcgacgagagaggcgccatcgtgcactacaccatcctgaacaaccacgtgtacagaagaagcctgggcaagtacaccgacttcaagatgttcagcgacgagatcctgctgagcctgaccagaaaggtgctgctgcccgacctggagttctacgtgaacctgggcgactggcccctggagcacagaaaggtgaacggcacccccagccccatccccatcatcagctggtgcggcagcctggacagcagagacgtggtgctgcccacctacgacatcacccacagcatgctggaggccatgagaggcgtgaccaacgacctgctgagcatccagggcaacaccggccccagctggatcaacaagaccgagagagccttcttcagaggcagagacagcagagaggagagactgcagctggtgcagctgagcaaggagaacccccagctgctggacgccggcatcaccggctacttcttcttccaggagaaggagaaggagctgggcaaggccaagctgatgggcttcttcgacttcttcaagtacaagtaccaggtgaacgtggacggcaccgtggccgcctacagatacccctacctgatgctgggcgacagcctggtgctgaagcaggacagcccctactacgagcacttctacatggccctggagccctggaagcactacgtgcccatcaagagaaacctgagcgacctgctggagaaggtgaagtgggccaagagcttcaccctgagccccagactggagtgcagcggcaccatcagcacccactgcaacctgtgcctgcccggcagcagaaacttcgtgccccagccccccgagtag

SEQ ID NO: 18912 - DNA, 1356 bp, Artificial Sequence
  Description of Artificial Sequence: Synthetic coding sequence
atggtggagctgttcatcttcctgttcctgctgggcgagacccccttcaaggtggtggtgaagagcctgagccccaaggagctggtgagaatccacgtgcccaagcccctggacagaaacgacggcaccttcctgatgagatacagaatgtacgagaccgtggacgagggcctgaagatcgaggtgctgtacggcgacgagcacgtggcccagagcccctacatcctgaagggccccgtgtaccacgagtactgcgagtgccccgaggacccccaggcctggcagaagaccctgagctgccccaccaaggagccccagatcgccaaggacttcgccagcttccccagcatcaacctgcagcagatgctgaaggaggtgcccaagagattcggcgacgagagaggcgccatcgtgcactacaccatcctgaacaaccacgtgtacagaagaagcctgggcaagtacaccgacttcaagatgttcagcgacgagatcctgctgagcctgaccagaaaggtgctgctgcccgacctggagttctacgtgaacctgggcgactggcccctggagcacagaaaggtgaacggcacccccagccccatccccatcatcagctggtgcggcagcctggacagcagagacgtggtgctgcccacctacgacatcacccacagcatgctggaggccatgagaggcgtgaccaacgacctgctgagcatccagggcaacaccggccccagctggatcaacaagaccgagagagccttcttcagaggcagagacagcagagaggagagactgcagctggtgcagctgagcaaggagaacccccagctgctggacgccggcatcaccggctacttcttcttccaggagaaggagaaggagctgggcaaggccaagctgatgggcttcttcgacttcttcaagtacaagtaccaggtgaacgtggacggcaccgtggccgcctacagatacccctacctgatgctgggcgacagcctggtgctgaagcaggacagcccctactacgagcacttctacatggccctggagccctggaagcactacgtgcccatcaagagaaacctgagcgacctgctggagaaggtgaagtgggccaaggagaacgacgaggaggccaagaagatcgccaaggagggccagctgatggccagagacctgctgcagccccacagactgtactgctactactaccaggtgctgcagaagtacgccgagagacagagcagcaagcccgaggtgagagacggcatggagctggtgccccagcccgaggacagcaccgccatctgccagtgccacagaaagaagcccagcagagaggagctgtag

SEQ ID NO: 18913 - DNA, 639 bp, Artificial Sequence
  Description of Artificial Sequence: Synthetic coding sequence
atgaacctgttcagattcctgggcgacctgagccacctgctggccatcatcctgctgctgctgaagatctggaagagcagaagctgcgccggcatcagcggcaagagccaggtgctgttcgccgtggtgttcaccgccagatacctggacctgttcaccaactacatcagcctgtacaacacctgcatgaaggtggtgtacatcgcctgcagcttcaccaccgtgtggctgatctacagcaagttcaaggccacctacgacggcaaccacgacaccttcagagtggagttcctggtggtgcccaccgccatcctggccttcctggtgaaccacgacttcacccccctggagatcctgtggaccttcagcatctacctggagagcgtggccatcctgccccagctgttcatggtgagcaagaccggcgaggccgagaccatcaccagccactacctgttcgccctgggcgtgtacagaaccctgtacctgttcaactggatctggagataccacttcgagggcttcttcgacctgatcgccatcgtggccggcctggtgcagaccgtgctgtactgcgacttcttctacctgtacatcaccaaggtgctgaagggcaagaagctgagcctgcccgcctag

SEQ ID NO: 18914 - DNA, 639 bp, Artificial Sequence
  Description of Artificial Sequence: Synthetic coding sequence
atgaacatcttcagactgaccggcgacctgagccacctggccgccatcgtgatcctgctgctgaagatctggaagaccagaagctgcgccggcatcagcggcaagagccagctgctgttcgccctggtgttcaccaccagatacctggacctgttcaccagcttcatcagcctgtacaacaccagcatgaaggtgatctacctggcctgcagctacgccaccgtgtacctgatctacctgaagttcaaggccacctacgacggcaaccacgacaccttcagagtggagttcctggtggtgcccgtgggcggcctgagcttcctggtgaaccacgacttcagccccctggagatcctgtggaccttcagcatctacctggagagcgtggccatcctgccccagctgttcatgatcagcaagaccggcgaggccgagaccatcaccacccactacctgttcttcctgggcctgtacagagccctgtacctggtgaactggatctggagattctacttcgagggcttcttcgacctgatcgccgtggtggccggcgtggtgcagaccatcctgtactgcgacttcttctacctgtacatcaccaaggtgctgaagggcaagaagctgagcctgcccgcctag

SEQ ID NO: 18915 - DNA, 561 bp, Artificial Sequence
  Description of Artificial Sequence: Synthetic coding sequence
atgaacatcttcagactgaccggcgacctgagccacctggccgccatcgtgatcctgctgctgaagatctggaagaccagaagctgcgccggcatcagcggcaagagccagctgctgttcgccctggtgttcaccaccagatacctggacctgttcaccagcttcatcagcctgtacaacaccagcatgaaggtgatctacctggcctgcagctacgccaccgtgtacctgatctacctgaagttcaaggccacctacgacggcaaccacgacaccttcagagtggagttcctggtggtgcccgtgggcggcctgagcttcctggtgaaccacgacttcagccccctggagtacagcagagagagaagcagcgtgtgccagcacaagtgccagagacccagccccgccagcgtgctgcagggcgccagaaccgagttcctgccccagcagagacacaagatgctggacaccgagaaccagaagctgaacagcttcgtggccgacagccaccagtggctgtgcaagaacgccgaggagaagagccagaaggtgagcgtgtag

SEQ ID NO: 18916 - DNA, 543 bp, Artificial Sequence
  Description of Artificial Sequence: Synthetic coding sequence
atgagcgtgctgagacccctggacaagctgcccggcctgaacaccgccaccatcctgctggtgggcaccgaggacgccctgctgcagcagctggccgacagcatgctgaaggaggactgcgccagcgagctgaaggtgcacctggccaagagcctgcccctgcccagcagcgtgaacagacccagaatcgacctgatcgtgttcgtggtgaacctgcacagcaagtacagcctgcagaacaccgaggagagcctgagacacgtggacgccagcttcttcctgggcaaggtgtgcttcctggccaccggcgccggcagagagagccactgcagcatccacagacacaccgtggtgaagctggcccacacctaccagagccccctgctgtactgcgacctggaggtggagggcttcagagccaccatggcccagagactggtgagagtgctgcagatctgcgccggccacgtgcccggcgtgagcgccctgaacctgctgagcctgctgagaagcagcgagggccccagcctggaggacctgtag

SEQ ID NO: 18917 - DNA, 663 bp, Artificial Sequence
  Description of Artificial Sequence: Synthetic coding sequence
atgaacgtgttcagaatcctgggcgacctgagccacctgctggccatgatcctgctgctgggcaagatctggagaagcaagtgctgcaagggcatcagcggcaagagccagatcctgttcgccctggtgttcaccaccagatacctggacctgttcaccaacttcatcagcatctacaacaccgtgatgaaggtggtgttcctgctgtgcgcctacgtgaccgtgtacatgatctacggcaagttcagaaagaccttcgacagcgagaacgacaccttcagactggagttcctgctggtgcccgtgatcggcctgagcttcctggagaactacagcttcaccctgctggagatcctgtggaccttcagcatctacctggagagcgtggccatcctgccccagctgttcatgatcagcaagaccggcgaggccgagaccatcaccacccactacctgttcttcctgggcctgtacagagccctgtacctggccaactggatcagaagataccagaccgagaacttctacgaccagatcgccgtggtgagcggcgtggtgcagaccatcttctactgcgacttcttctacctgtacgtgaccaagggcagaagctgggacgacagcaacgccgacaccggcctgagaagctacagcagcatctag

SEQ ID NO: 18918 - DNA, 2334 bp, Artificial Sequence
  Description of Artificial Sequence: Synthetic coding sequence
atgttccccagaggcgccgaggcccaggactggcacctggacatgcagctgaccggcaaggtggtgctgagcgccgccgccctgctgctggtgaccgtggcctacagactgtacaagagcagacccgcccccgcccagagatggggcggcaacggccaggccgaggccaaggaggaggccgagggcagcggccagcccgccgtgcaggaggccagccccggcgtgctgctgagaggccccagaagaagaagaagcagcaagagagccgaggccccccagggctgcagctgcgagaaccccagaggcccctacgtgctggtgaccggcgccaccagcaccgacagaaagccccagagaaagggcagcggcgaggagagaggcggccagggcagcgacagcgagcaggtgcccccctgctgccccagccaggagaccagaaccgccgtgggcagcaaccccgaccccccccacttccccagactgggcagcgagcccaagagcagccccgccggcctgatcgccgccgccgacggcagctgcgccggcggcgagcccagcccctggcaggacagcaagcccagagagcaccccggcctgggccagctggagcccccccactgccactacgtggcccccctgcagggcagcagcgacatgaaccagagctgggtgttcaccagagtgatcggcgtgagcagagaggaggccggcgccctggaggccgccagcgacgtggacctgaccctgcaccagcaggagggcgcccccaacagcagctacaccttcagcagcatcgccagagtgagaatggaggagcacttcatccagaaggccgagggcgtggagcccagactgaagggcaaggtgtacgactactacgtggagagcaccagccaggccatcttccagggcagactggcccccagaaccgccgccctgaccgaggtgcccagccccagacccccccccggcagcctgggcaccggcgccgccagcggcggccaggccggcgacaccaagggcgccgccgagagagccgccagcccccagaccggcccctggcccagcaccagaggcttcagcagaaaggagagcctgctgcagatcgccgagaaccccgagctgcagctgcagcccgacggcttcagactgcccgcccccccctgccccgaccccggcgccctgcccggcctgggcagaagcagcagagagccccacgtgcagcccgtggccggcaccaacttcttccacatccccctgacccccgccagcgccccccaggtgagactggacctgggcaactgctacgaggtgctgaccctggccaagagacagaacctggaggccctgaaggaggccgcctacaaggtgatgagcgagaactacctgcaggtgctgagaagccccgacatctacggctgcctgagcggcgccgagagagagctgatcctgcagagaagactgagaggcagacagtacctggtggtggccgacgtgtgccccaaggaggacagcggcggcctgtgctgctacgacgacgagcaggacgtgtggagacccctggccagaatgccccccgaggccgtgagcagaggctgcgccatctgcagcctgttcaactacctgttcgtggtgagcggctgccagggccccggccaccagcccagcagcagagtgttctgctacaaccccctgaccggcatctggagcgaggtgtgccccctgaaccaggccagaccccactgcagactggtggccctggacggccacctgtacgccatcggcggcgagtgcctgaacagcgtggagagatacgaccccagactggacagatgggacttcgccccccccctgcccagcgacaccttcgccctggcccacaccgccaccgtgagagccaaggagatcttcgtgaccggcggcagcctgagattcctgctgttcagattcagcgcccaggagcagagatggtgggccggccccaccggcggcagcaaggacagaaccgccgagatggtggccgtgaacggcttcctgtacagattcgacctgaacagaagcctgggcatcgccgtgtacagatgcagcgccagcaccagactgtggtacgagtgcgccacctacagaaccccctaccccgacgccttccagtgcgccgtggtggacaacctgatctactgcgtgggcagaagaagcaccctgtgcttcctggccgacagcgtgagccccagattcgtgcccaaggagctgagaagcttccccgccccccagggcaccctgctgcccaccgtgctgaccctgcccacccccgacctgccccagaccagagtgtag

SEQ ID NO: 18919 - DNA, 2088 bp, Artificial Sequence
  Description of Artificial Sequence: Synthetic coding sequence
ggccagcccgccgtgcaggaggccagccccggcgtgctgctgagaggccccagaagaagaagaagcagcaagagagccgaggccccccagggctgcagctgcgagaaccccagaggcccctacgtgctggtgaccggcgccaccagcaccgacagaaagccccagagaaagggcagcggcgaggagagaggcggccagggcagcgacagcgagcaggtgcccccctgctgccccagccaggagaccagaaccgccgtgggcagcaaccccgaccccccccacttccccagactgggcagcgagcccaagagcagccccgccggcctgatcgccgccgccgacggcagctgcgccggcggcgagcccagcccctggcaggacagcaagcccagagagcaccccggcctgggccagctggagcccccccactgccactacgtggcccccctgcagggcagcagcgacatgaaccagagctgggtgttcaccagagtgatcggcgtgagcagagaggaggccggcgccctggaggccgccagcgacgtggacctgaccctgcaccagcaggagggcgcccccaacagcagctacaccttcagcagcatcgccagagtgagaatggaggagcacttcatccagaaggccgagggcgtggagcccagactgaagggcaaggtgtacgactactacgtggagagcaccagccaggccatcttccagggcagactggcccccagaaccgccgccctgaccgaggtgcccagccccagacccccccccggcagcctgggcaccggcgccgccagcggcggccaggccggcgacaccaagggcgccgccgagagagccgccagcccccagaccggcccctggcccagcaccagaggcttcagcagaaaggagagcctgctgcagatcgccgagaaccccgagctgcagctgcagcccgacggcttcagactgcccgcccccccctgccccgaccccggcgccctgcccggcctgggcagaagcagcagagagccccacgtgcagcccgtggccggcaccaacttcttccacatccccctgacccccgccagcgccccccaggtgagactggacctgggcaactgctacgaggtgctgaccctggccaagagacagaacctggaggccctgaaggaggccgcctacaaggtgatgagcgagaactacctgcaggtgctgagaagccccgacatctacggctgcctgagcggcgccgagagagagctgatcctgcagagaagactgagaggcagacagtacctggtggtggccgacgtgtgccccaaggaggacagcggcggcctgtgctgctacgacgacgagcaggacgtgtggagacccctggccagaatgccccccgaggccgtgagcagaggctgcgccatctgcagcctgttcaactacctgttcgtggtgagcggctgccagggccccggccaccagcccagcagcagagtgttctgctacaaccccctgaccggcatctggagcgaggtgtgccccctgaaccaggccagaccccactgcagactggtggccctggacggccacctgtacgccatcggcggcgagtgcctgaacagcgtggagagatacgaccccagactggacagatgggacttcgccccccccctgcccagcgacaccttcgccctggcccacaccgccaccgtgagagccaaggagatcttcgtgaccggcggcagcctgagattcctgctgttcagattcagcgcccaggagcagagatggtgggccggccccaccggcggcagcaaggacagaaccgccgagatggtggccgtgaacggcttcctgtacagattcgacctgaacagaagcctgggcatcgccgtgtacagatgcagcgccagcaccagactgtggtacgagtgcgccacctacagaaccccctaccccgacgccttccagtgcgccgtggtggacaacctgatctactgcgtgggcagaagaagcaccctgtgcttcctggccgacagcgtgagccccagagaggccgccatcgtgcccagctacctgctggtggaggtgtgctag

SEQ ID NO: 18920 - DNA, 1929 bp, Artificial Sequence
  Description of Artificial Sequence: Synthetic coding sequence
atgcagcccagaagcgagagacccgccggcagaacccagagccccgagcacggcagccccggccccggccccgaggcccccccccccccccccccccagccccccgcccccgaggccgagagaaccagacccagacaggccagacccgccgcccccatggagggcgccgtgcagctgctgagcagagagggccacagcgtggcccacaacagcaagagacactaccacgacgccttcgtggccatgagcagaatgagacagagaggcctgctgtgcgacatcgtgctgcacgtggccgccaaggagatcagagcccacaaggtggtgctggccagctgcagcccctacttccacgccatgttcaccaacgagatgagcgagagcagacagacccacgtgaccctgcacgacatcgacccccaggccctggaccagctggtgcagttcgcctacaccgccgagatcgtggtgggcgagggcaacgtgcagaccctgctgcccgccgccagcctgctgcagctgaacggcgtgagagacgcctgctgcaagttcctgctgagccagctggaccccagcaactgcctgggcatcagaggcttcgccgacgcccacagctgcagcgacctgctgaaggccgcccacagatacgtgctgcagcacttcgtggacgtggccaagaccgaggagttcatgctgctgcccctgaagcaggtgctggagctggtgagcagcgacagcctgaacgtgcccagcgaggaggaggtgtacagagccgtgctgagctgggtgaagcacgacgtggacgccagaagacagcacgtgcccagactgatgaagtgcgtgagactgcccctgctgagcagagacttcctgctgggccacgtggacgccgagagcctggtgagacaccaccccgactgcaaggacctgctgatcgaggccctgaagttccacctgctgcccgagcagagaggcgtgctgggcaccagcagaaccagacccagaagatgcgagggcgccggccccgtgctgttcgccgtgggcggcggcagcctgttcgccatccacggcgactgcgaggcctacgacaccagaaccgacagatggcacgtggtggccagcatgagcaccagaagagccagagtgggcgtggccgccgtgggcaacagactgtacgccgtgggcggctacgacggcaccagcgacctggccaccgtggagagctacgaccccgtgaccaacacctggcagcccgaggtgagcatgggcaccagaagaagctgcctgggcgtggccgccctgcacggcctgctgtacagcgccggcggctacgacggcgccagctgcctgaacagcgccgagagatacgaccccctgaccggcacctggaccagcgtggccgccatgagcaccagaagaagatacgtgagagtggccaccctggacggcaacctgtacgccgtgggcggctacgacagcagcagccacctggccaccgtggagaagtacgagccccaggtgaacgtgtggagccccgtggccagcatgctgagcagaagaagcagcgccggcgtggccgtgctggagggcgccctgtacgtggccggcggcaacgacggcaccagctgcctgaacagcgtggagagatacagccccaaggccggcgcctgggagagcgtggcccccatgaacatcagaagaagcacccacgacctggtggccatggacggctggctgtacgccgtgggcggcaacgacggcagcagcagcctgaacagcatcgagaagtacaaccccagaaccaacaagtgggtggccgccagctgcatgttcaccagaagaagcagcgtgggcgtggccgtgctggagctgctgaacttccccccccccagcagccccaccctgagcgtgagcagcaccagcctgtag

SEQ ID NO: 18921 - DNA, 1557 bp, Artificial Sequence
  Description of Artificial Sequence: Synthetic coding sequence
atgagcgagagcagacagacccacgtgaccctgcacgacatcgacccccaggccctggaccagctggtgcagttcgcctacaccgccgagatcgtggtgggcgagggcaacgtgcagaccctgctgcccgccgccagcctgctgcagctgaacggcgtgagagacgcctgctgcaagttcctgctgagccagctggaccccagcaactgcctgggcatcagaggcttcgccgacgcccacagctgcagcgacctgctgaaggccgcccacagatacgtgctgcagcacttcgtggacgtggccaagaccgaggagttcatgctgctgcccctgaagcaggtgctggagctggtgagcagcgacagcctgaacgtgcccagcgaggaggaggtgtacagagccgtgctgagctgggtgaagcacgacgtggacgccagaagacagcacgtgcccagactgatgaagtgcgtgagactgcccctgctgagcagagacttcctgctgggccacgtggacgccgagagcctggtgagacaccaccccgactgcaaggacctgctgatcgaggccctgaagttccacctgctgcccgagcagagaggcgtgctgggcaccagcagaaccagacccagaagatgcgagggcgccggccccgtgctgttcgccgtgggcggcggcagcctgttcgccatccacggcgactgcgaggcctacgacaccagaaccgacagatggcacgtggtggccagcatgagcaccagaagagccagagtgggcgtggccgccgtgggcaacagactgtacgccgtgggcggctacgacggcaccagcgacctggccaccgtggagagctacgaccccgtgaccaacacctggcagcccgaggtgagcatgggcaccagaagaagctgcctgggcgtggccgccctgcacggcctgctgtacagcgccggcggctacgacggcgccagctgcctgaacagcgccgagagatacgaccccctgaccggcacctggaccagcgtggccgccatgagcaccagaagaagatacgtgagagtggccaccctggacggcaacctgtacgccgtgggcggctacgacagcagcagccacctggccaccgtggagaagtacgagccccaggtgaacgtgtggagccccgtggccagcatgctgagcagaagaagcagcgccggcgtggccgtgctggagggcgccctgtacgtggccggcggcaacgacggcaccagctgcctgaacagcgtggagagatacagccccaaggccggcgcctgggagagcgtggcccccatgaacatcagaagaagcacccacgacctggtggccatggacggctggctgtacgccgtgggcggcaacgacggcagcagcagcctgaacagcatcgagaagtacaaccccagaaccaacaagtgggtggccgccagctgcatgttcaccagaagaagcagcgtgggcgtggccgtgctggagctgctgaacttccccccccccagcagccccaccctgagcgtgagcagcaccagcctgtag

SEQ ID NO: 18922 - DNA, 678 bp, Artificial Sequence
  Description of Artificial Sequence: Synthetic coding sequence
atgaagtgcgtgagactgcccctgctgagcagagacttcctgctgggccacgtggacgccgagagcctggtgagacaccaccccgactgcaaggacctgctgatcgaggccctgaagttccacctgctgcccgagcagagaggcgtgctgggcaccagcagaaccagacccagaagatgcgagggcgccggccccgtgctgttcgccgtgggcggcggcagcctgttcgccatccacggcgactgcgaggcctacgacaccagaaccgacagatggcacgtggtggccagcatgagcaccagaagagccagagtgggcgtggccgccgtgggcaacagactgtacgccgtgggcggctacgacggcaccagcgacctggccaccgtggagagctacgaccccgtgaccaacacctggcagcccgaggtgagcatgggcaccagaagaagctgcctgggcgtggccgccctgcacggcctgctgtacagcgccggcggctacgacggcgccagctgcctgaacagcgccgagagatacgaccccctgaccggcacctggaccagcgtggccgccatgagcaccagaagaagatacgtgagagtggccaccctggacggcaacctgtacgccgtgggcggctacgacagcagcagccacctggccaccgtggagaagtag

SEQ ID NO: 18923 - DNA, 489 bp, Artificial Sequence
  Description of Artificial Sequence: Synthetic coding sequence
atgagaatcgccaacagaaccagattcagcagccccttcctggccagaggcgccggctggacccacggcagaggcatgatggtggtgggcaccggcaccagcctggccctgagcagcctgctgagcctgctgctgttcgccggcatgcagatgtacagcagacagctggccagcaccgagtggctgaccatccagggcggcctgctgggcagcggcctgttcgtgttcagcctgaccgccttcaacaacctggagaacctggtgttcggcaagggcttccaggccaagatcttccccgagatcctgctgtgcctgctgctggccctgttcgccagcggcctgatccacagagtgtgcgtgaccacctgcttcatcttcagcatggtgggcctgtactacatcaacaagatcagcagcaccctgtaccaggccgccgcccccgtgctgacccccgccaaggtgaccggcaagagcaagaagagaaactag

SEQ ID NO: 18924 - DNA, 723 bp, Artificial Sequence
  Description of Artificial Sequence: Synthetic coding sequence
atgagaagatgcagcctgtgcgccttcgacgccgccagaggccccagaagactgatgagagtgggcctggccctgatcctggtgggccacgtgaacctgctgctgggcgccgtgctgcacggcaccgtgctgagacacgtggccaaccccagaggcgccgtgacccccgagtacaccgtggccaacgtgatcagcgtgggcagcggcctgctgagcgtgagcgtgggcctggtggccctgctggccagcagaaacctgctgagaccccccctgcactgggtgctgctggccctggccctggtgaacctgctgctgagcgtggcctgcagcctgggcctgctgctggccgtgagcctgaccgtggccaacggcggcagaagactgatcgccgactgccaccccggcctgctggaccccctggtgcccctggacgagggccccggccacaccgactgccccttcgaccccaccagaatctacgacaccgccctggccctgtggatccccagcctgctgatgagcgccggcgaggccgccctgagcggctactgctgcgtggccgccctgaccctgagaggcgtgggcccctgcagaaaggacggcctgcagggccagctggaggagatgaccgagctggagagccccaagtgcaagagacaggagaacgagcagctgctggaccagaaccaggagatcagagccagccagagaagctgggtgtag

SEQ ID NO: 18925 - DNA, 669 bp, Artificial Sequence
  Description of Artificial Sequence: Synthetic coding sequence
atgagagtgggcctggccctgatcctggtgggccacgtgaacctgctgctgggcgccgtgctgcacggcaccgtgctgagacacgtggccaaccccagaggcgccgtgacccccgagtacaccgtggccaacgtgatcagcgtgggcagcggcctgctgagcgtgagcgtgggcctggtggccctgctggccagcagaaacctgctgagaccccccctgcactgggtgctgctggccctggccctggtgaacctgctgctgagcgtggcctgcagcctgggcctgctgctggccgtgagcctgaccgtggccaacggcggcagaagactgatcgccgactgccaccccggcctgctggaccccctggtgcccctggacgagggccccggccacaccgactgccccttcgaccccaccagaatctacgacaccgccctggccctgtggatccccagcctgctgatgagcgccggcgaggccgccctgagcggctactgctgcgtggccgccctgaccctgagaggcgtgggcccctgcagaaaggacggcctgcagggccagctggaggagatgaccgagctggagagccccaagtgcaagagacaggagaacgagcagctgctggaccagaaccaggagatcagagccagccagagaagctgggtgtag

SEQ ID NO: 18926 - DNA, 189 bp, Artificial Sequence
  Description of Artificial Sequence: Synthetic coding sequence
gccctgagcggctactgctgcgtggccgccctgaccctgagaggcgtgggcccctgcagaaaggacggcctgcagggccagctggaggagatgaccgagctggagagccccaagtgcaagagacaggagaacgagcagctgctggaccagaaccaggagatcagagccagccagagaagctgggtgtag

SEQ ID NO: 18927 - DNA, 723 bp, Artificial Sequence; identical to SEQ ID NO: 18924
  Description of Artificial Sequence: Synthetic coding sequence

SEQ ID NO: 18928 - DNA, 2982 bp, Artificial Sequence
  Description of Artificial Sequence: Synthetic coding sequence
atggccgccgagtgggccagcagattctggctgtgggccaccctgctgatccccgccgccgccgtgtacgaggaccaggtgggcaagttcgactggagacagcagtacgtgggcaaggtgaagttcgccagcctggagttcagccccggcagcaagaagctggtggtggccaccgagaagaacgtgatcgccgccctgaacagcagaaccggcgagatcctgtggagacacgtggacaagggcaccgccgagggcgccgtggacgccatgctgctgcacggccaggacgtgatcaccgtgagcaacggcggcagaatcatgagaagctgggagaccaacatcggcggcctgaactgggagatcaccctggacagcggcagcttccaggccctgggcctggtgggcctgcaggagagcgtgagatacatcgccgtgctgaagaagaccaccctggccctgcaccacctgagcagcggccacctgaagtgggtggagcacctgcccgagagcgacagcatccactaccagatggtgtacagctacggcagcggcgtggtgtgggccctgggcgtggtgcccttcagccacgtgaacatcgtgaagttcaacgtggaggacggcgagatcgtgcagcaggtgagagtgagcaccccctggctgcagcacctgagcggcgcctgcggcgtggtggacgaggccgtgctggtgtgccccgaccccagcagcagaagcctgcagaccctggccctggagaccgagtgggagctgagacagatccccctgcagagcctggacctggagttcggcagcggcttccagcccagagtgctgcccacccagcccaaccccgtggacgccagcagagcccagttcttcctgcacctgagccccagccactacgccctgctgcagtaccactacggcaccctgagcctgctgaagaacttcccccagaccgccctggtgagcttcgccaccaccggcgagaagaccgtggccgccgtgatggcctgcagaaacgaggtgcagaagagcagcagcagcgaggacggcagcatgggcagcttcagcgagaagagcagcagcaaggacagcctggcctgcttcaaccagacctacaccatcaacctgtacctggtggagaccggcagaagactgctggacaccaccatcaccttcagcctggagcagagcggcaccagacccgagagactgtacatccaggtgttcctgaagaaggacgacagcgtgggctacagagccctggtgcagaccgaggaccacctgctgctgttcctgcagcagctggccggcaaggtggtgctgtggagcagagaggagagcctggccgaggtggtgtgcctggagatggtggacctgcccctgaccggcgcccaggccgagctggagggcgagttcggcaagaaggccgacggcctgctgggcatgttcctgaagagactgagcagccagctgatcctgctgcaggcctggaccagccacctgtggaagatgttctacgacgccagaaagcccagaagccagatcaagaacgagatcaacatcgacaccctggccagagacgagttcaacctgcagaagatgatggtgatggtgaccgccagcggcaagctgttcggcatcgagagcagcagcggcaccatcctgtggaagcagtacctgcccaacgtgaagcccgacagcagcttcaagctgatggtgcagagaaccaccgcccacttcccccaccccccccagtgcaccctgctggtgaaggacaaggagagcggcatgagcagcctgtacgtgttcaaccccatcttcggcaagtggagccaggtggccccccccgtgctgaagagacccatcctgcagagcctgctgctgcccgtgatggaccaggactacgccaaggtgctgctgctgatcgacgacgagtacaaggtgaccgccttccccgccaccagaaacgtgctgagacagctgcacgagctggcccccagcatcttcttctacctggtggacgccgagcagggcagactgtgcggctacagactgagaaaggacctgaccaccgagctgagctgggagctgaccatcccccccgaggtgcagagaatcgtgaaggtgaagggcaagagaagcagcgagcacgtgcacagccagggcagagtgatgggcgacagaagcgtgctgtacaagagcctgaaccccaacctgctggccgtggtgaccgagagcaccgacgcccaccacgagagaaccttcatcggcatcttcctgatcgacggcgtgaccggcagaatcatccacagcagcgtgcagaagaaggccaagggccccgtgcacatcgtgcacagcgagaactgggtggtgtaccagtactggaacaccaaggccagaagaaacgagttcaccgtgctggagctgtacgagggcaccgagcagtacaacgccaccgccttcagcagcctggacagaccccagctgccccaggtgctgcagcagagctacatcttccccagcagcatcagcgccatggaggccaccatcaccgagagaggcatcaccagcagacacctgctgatcggcctgcccagcggcgccatcctgagcctgcccaaggccctgctggaccccagaagacccgagatccccaccgagcagagcagagaggagaacctgatcccctacagccccgacgtgcagatccacgccgagagattcatcaactacaaccagaccgtgagcagaatgagaggcatctacaccgcccccagcggcctggagagcacctgcctggtggtggcctacggcctggacatctaccagaccagagtgtaccccagcaagcagttcgacgtgctgaaggacgactacgactacgtgctgatcagcagcgtgctgttcggcctggtgttcgccaccatgatcaccaagagactggcccaggtgaagctgctgaacagagcctggagatag

SEQ ID NO: 18929 - DNA, 4071 bp, Artificial Sequence
  Description of Artificial Sequence: Synthetic coding sequence
atggacctgaaggagaagcacctgggcgagccccccagcgccctgggcctgagcaccagaaaggccctgagcgtgctgaaggagcagctggaggccgtgctggagggccacctgagagagagaaagaagtgcctgacctggaaggaggtgtggagaagcagcttcctgcaccacagcaacagatgcagctgcttccactggcccggcgccagcctgatgctgctggccgtgctgctgctgctgggctgctgcggcggccagcccgccggcagcagaggcgtgggcctggtgaacgccagcgccctgttcctgctgctgctgctgaacctggtgctgatcggcagacaggacagactgaagagaagagaggtggagagaagactgagaggcatcatcgaccagatccaggacgccctgagagacggcagagagatccagtggcccagcgccatgtaccccgacctgcacatgcccttcgcccccagctggagcctgcactgggcctacagagacggccacctggtgaacctgcccgtgagcctgctggtggagggcgacatcatcgccctgagacccggccaggagagcttcgccagcctgagaggcatcaaggacgacgagcacatcgtgctggagcccggcgacctgttcccccccttcagccccccccccagccccagaggcgaggtggagagaggcccccagagcccccagcagcacagactgttcagagtgctggagacccccgtgatcgacaacatcagatggtgcctggacatggccctgagcagacccgtgaccgccctggacaacgagagattcaccgtgcagagcgtgatgctgcactacgccgtgcccgtggtgctggccggcttcctgatcaccaacgccctgagattcatcttcagcgcccccggcgtgaccagctggcagtacaccctgctgcagctgcaggtgaacggcgtgctgcccatcctgcccctgctgttccccgtgctgtgggtgctggccaccgcctgcggcgaggccagagtgctggcccagatgagcaaggccagccccagcagcctgctggccaagttcagcgaggacaccctgagcagctacaccgaggccgtgagcagccaggagatgctgagatgcatctggggccacttcctgagagtgctgggcggcaccagccccaccctgagccacagcagcagcctgctgcacagcctgggcagcgtgaccgtgctgtgctgcgtggacaagcagggcatcctgagctggcccaaccccagccccgagaccgtgctgttcttcagcggcaaggtggagcccccccacagcagccacgaggacctgaccgacggcctgagcaccagaagcttctgccaccccgagccccacgagagagacgccctgctggccggcagcctgaacaacaccctgcacctgagcaacgagcaggagagaggcgactggcccggcgaggcccccaagccccccgagccctacagccaccacaaggcccacggcagaagcaagcaccccagcggcagcaacgtgagcttcagcagagacaccgagggcggcgaggaggagcccagcaagacccagcccggcatggagagcgacccctacgaggccgaggacttcgtgtgcgactaccacctggagatgctgagcctgagccaggaccagcagaaccccagctgcatccagttcgacgacagcaactggcagctgcacctgaccagcctgaagcccctgggcctgaacgtgctgctgaacctgtgcgacgccagcgtgaccgagagactgtgcagattcagcgaccacctgtgcaacatcgccctgcaggagagccacagcgccgtgctgcccgtgcacgtgccctggggcctgtgcgagctggccagactgatcggcttcacccccggcgccaaggagctgttcaagcaggagaaccacctggccctgtacagactgcccagcgccgagaccatgaaggagaccagcctgggcagactgagctgcgtgaccaagagaagaccccccctgagccacatgatcagcctgttcatcaaggacaccaccaccagcaccgagcagatgctgagccacggcaccgccgacgtggtgctggaggcctgcaccgacttctgggacggcgccgacatctaccccctgagcggcagcgacagaaagaaggtgctggacttctaccagagagcctgcctgagcggctactgcagcgccttcgcctacaagcccatgaactgcgccctgagcagccagctgaacggcaagtgcatcgagctggtgcaggtgcccggccagagcagcatcttcaccatgtgcgagctgcccagcaccatccccatcaagcagaacgccagaagaagcagctggagcagcgacgagggcatcggcgaggtgctggagaaggaggactgcatgcaggccctgagcggccagatcttcatgggcatggtgagcagccagtaccaggccagactggacatcgtgagactgatcgacggcctggtgaacgcctgcatcagattcgtgtacttcagcctggaggacgagctgaagagcaaggtgttcgccgagaagatgggcctggagaccggctggaactgccacatcagcctgacccccaacggcgacatgcccggcagcgagatcccccccagcagccccagccacgccggcagcctgcacgacgacctgaaccaggtgagcagagacgacgccgagggcctgctgctgatggaggaggagggccacagcgacctgatcagcttccagcccaccgacagcgacatccccagcttcctggaggacagcaacagagccaagctgcccagaggcatccaccaggtgagaccccacctgcagaacatcgacaacgtgcccctgctggtgcccctgttcaccgactgcacccccgagaccatgtgcgagatgatcaagatcatgcaggagtacggcgaggtgacctgctgcctgggcagcagcgccaacctgagaaacagctgcctgttcctgcagagcgacatcagcatcgccctggaccccctgtaccccagcagatgcagctgggagaccttcggctacgccaccagcatcagcatggcccaggccagcgacggcctgagccccctgcagctgagcggccagctgaacagcctgccctgcagcctgaccttcagacaggaggagaccatcagcatcatcagactgatcgagcaggccagacacgccacctacggcatcagaaagtgcttcctgttcctgctgcagtgccagctgaccctggtggtgatccagttcctgagctgcctggtgcagctgccccccctgctgagcaccaccgacatcctgtggctgagctgcttctgctaccccctgctgagcatcagcctgctgggcaagcccccccacagcagcatcatgagcatggccaccggcaagaacctgcagagcatccccaagaagacccagcactacttcctgctgtgcttcctgctgaagttcagcctgaccatcagcagctgcctgatctgcttcggcttcaccctgcagagcttctgcgacagcagcagagacagaaacctgaccaactgcagcagcgtgatgctgcccagcaacgacgacagagcccccgcctggttcgaggacttcgccaacggcctgctgagcgcccagaagctgaccgccgccctgatcgtgctgcacaccgtgttcatcagcatcacccacgtgcacagaaccaagcccctgtggagaaagagccccctgaccaacctgtggtgggccgtgaccgtgcccgtggtgctgctgggccaggtggtgcagaccgccgtggacctgcagctgtggacccacagagacagccacgtgcacttcggcctggaggacgtgcccctgctgacctggctgctgggctgcctgagcctggtgctggtggtggtgaccaacgagatcgtgaagctgcacgagatcagagtgagagtgagataccagaagagacagaagctgcagttcgagaccaagctgggcatgaacagccccttctag

SEQ ID NO: 18930 - DNA, 912 bp, Artificial Sequence
  Description of Artificial Sequence: Synthetic coding sequence
atgtgccacggcagaatcgcccccaagagcaccagcgtgttcgccgtggccagcgtgggccacggcgtgttcctgcccctggtgatcctgtgcaccctgctgggcgacggcctggccagcgtgtgccccctgccccccgagcccgagaacggcggctacatctgccaccccagaccctgcagagaccccctgaccgccggcagcgtgatcgagtacctgtgcgccgagggctacatgctgaagggcgactacaagtacctgacctgcaagaacggcgagtggaagcccgccatggagatcagctgcagactgaacgaggacaaggacacccacaccagcctgggcgtgcccaccctgagcatcgtggccagcaccgccagcagcgtggccctgatcctgctgctggtggtgctgttcgtgctgctgcagcccaagctgaagagcttccaccacagcagaagagaccagggcgtgagcggcgaccaggtgagcatcatggtggacggcgtgcaggtggccctgcccagctacgaggaggccgtgtacggcagcagcggccactgcgtgccccccgccgaccccagagtgcagatcgtgctgagcgagggcagcggccccagcggcagaagcgtgcccagagagcagcagctgcccgaccagggcgcctgcagcagcgccggcggcgaggacgaggcccccggccagagcggcctgtgcgaggcctggggcagcagagccagcgagaccgtgatggtgcaccaggccaccaccagcagctgggtggccggcagcggcaacagacagctggcccacaaggagaccgccgacagcgagaacagcgacatccagagcctgctgagcctgaccagcgaggagtacaccgacgacatccccctgctgaaggaggcctag

SEQ ID NO: 18931 - DNA, 2472 bp, Artificial Sequence
  Description of Artificial Sequence: Synthetic coding sequence
atgttctacgtgatcggcggcatcaccgtgagcgtggtggccttcttcttcaccatcaagttcctgttcgagctggccgccagagtggtgagcttcctgcagaacgaggacagagagagaagaggcgacagaaccatctacgactacgtgagaggcaactacctggaccccagaagctgcaaggtgagctgggactggaaggacccctacgaggtgggccacagcatggccttcagagtgcacctgttctacaagaacggccagcccttccccgcccacagacccgtgggcctgagagtgcacatcagccacgtggagctggccgtggagatccccgtgacccaggaggtgctgcaggagcccaacagcaacgtggtgaaggtggccttcaccgtgagaaaggccggcagatacgagatcaccgtgaagctgggcggcctgaacgtggcctacagcccctactacaagatcttccagcccggcatggtggtgcccagcaagaccaagatcgtgtgccacttcagcaccctggtgctgacctgcggccagccccacaccctgcagatcgtgcccagagacgagtacgacaaccccaccaacaacagcatgagcctgagagacgagcacaactacaccctgagcatccacgagctgggcccccaggaggaggagagcaccggcgtgagcttcgagaagagcgtgaccagcaacagacagaccttccaggtgttcctgagactgaccctgcacagcagaggctgcttccacgcctgcatcagctaccagaaccagcccatcaacaacggcgagttcgacatcatcgtgctgagcgaggacgagaagaacatcgtggagagaaacgtgagcaccagcggcgtgagcatctacttcgaggcctacctgtacaacgccaccaactgcagcagcaccccctggcacctgccccccatgcacatgaccagcagccagagaagacccagcaccgccgtggacgaggaggacgaggacagccccagcgagtgccacacccccgagaaggtgaagaagcccaagaaggtgtactgctacgtgagccccaagcagttcagcgtgaaggagttctacctgaagatcatcccctggagactgtacaccttcagagtgtgccccggcaccaagttcagctacctgggccccgaccccgtgcacaagctgctgaccctggtggtggacgacggcatccagccccccgtggagctgagctgcaaggagagaaacatcctggccgccaccttcatcagaagcctgcacaagaacatcggcggcagcgagaccttccaggacaaggtgaacttcttccagagagagctgagacaggtgcacatgaagagaccccacagcaaggtgaccctgaaggtgagcagacacgccctgctggagagcagcctgaaggccaccagaaacttcagcatcagcgactggagcaagaacttcgaggtggtgttccaggacgaggaggccctggactggggcggccccagaagagagtggttcgagctgatctgcaaggccctgttcgacaccaccaaccagctgttcaccagattcagcgacaacaaccaggccctggtgcaccccaaccccaacagacccgcccacctgagactgaagatgtacgagttcgccggcagactggtgggcaagtgcctgtacgagagcagcctgggcggcgcctacaagcagctggtgagagccagattcaccagaagcttcctggcccagatcatcggcctgagaatgcactacaagtacttcgagaccgacgaccccgagttctacaagagcaaggtgtgcttcatcctgaacaacgacatgagcgagatggagctggtgttcgccgaggagaagtacaacaagagcggccagctggacaaggtggtggagctgatgaccggcggcgcccagacccccgtgaccaacgccaacaagatcttctacctgaacctgctggcccagtacagactggccagccaggtgaaggaggaggtggagcacttcctgaagggcctgaacgagctggtgcccgagaacctgctggccatcttcgacgagaacgagctggagctgctgatgtgcggcaccggcgacatcagcgtgagcgacttcaaggcccacgccgtggtggtgggcggcagctggcacttcagagagaaggtgatgagatggttctggaccgtggtgagcagcctgacccaggaggagctggccagactgctgcagttcaccaccggcagcagccagctgccccccggcggcttcgccgccctgtgccccagcttccagatcatcgccgcccccacccacagcaccctgcccaccgcccacacctgcttcaaccagctgtgcctgcccacctacgacagctacgaggaggtgcacagaatgctgcagctggccatcagcgagggctgcgagggcttcggcatgctgtag

SEQ ID NO: 18932 - DNA, 3150 bp, Artificial Sequence
  Description of Artificial Sequence: Synthetic coding sequence
atggagaagagactgggcgtgaagcccaaccccgccagctggatcctgagcggctactactggcagaccagcgccaagtggctgagaagcctgtacctgttctacacctgcttctgcttcagcgtgctgtggctgagcaccgacgccagcgagagcagatgccagcagggcaagacccagttcggcgtgggcctgagaagcggcggcgagaaccacctgtggctgctggagggcacccccagcctgcagagctgctgggccgcctgctgccaggacagcgcctgccacgtgttctggtggctggagggcatgtgcatccaggccgactgcagcagaccccagagctgcagagccttcagaacccacagcagcaacagcatgctggtgttcctgaagaagttccagaccgccgacgacctgggcttcctgcccgaggacgacgtgccccacctgctgggcctgggctggaactgggccagctggagacagagcccccccagagccgccctgagacccgccgtgagcagcagcgaccagcagagcctgatcagaaagctgcagaagagaggcagccccagcgacgtggtgacccccatcgtgacccagcacagcaaggtgaacgacagcaacgagctgggcggcctgaccaccagcggcagcgccgaggtgcacaaggccatcaccatcagcagccccctgaccaccgacctgaccgccgagctgagcggcggccccaagaacgtgagcgtgcagcccgagatcagcgagggcctggccaccacccccagcacccagcaggtgaagagcagcgagaagacccagatcgccgtgccccagcccgtggcccccagctacagctacgccacccccaccccccaggccagcttccagagcaccagcgccccctaccccgtgatcaaggagctggtggtgagcgccggcgagagcgtgcagatcaccctgcccaagaacgaggtgcagctgaacgcctacgtgctgcaggagccccccaagggcgagacctacacctacgactggcagctgatcacccaccccagagactacagcggcgagatggagggcaagcacagccagatcctgaagctgagcaagctgacccccggcctgtacgagttcaaggtgatcgtggagggccagaacgcccacggcgagggctacgtgaacgtgaccgtgaagcccgagcccagaaagaacagaccccccatcgccatcgtgagcccccagttccaggagatcagcctgcccaccaccagcaccgtgatcgacggcagccagagcaccgacgacgacaagatcgtgcagtaccactgggaggagctgaagggccccctgagagaggagaagatcagcgaggacaccgccatcctgaagctgagcaagctggtgcccggcaactacaccttcagcctgaccgtggtggacagcgacggcgccaccaacagcaccaccgccaacctgaccgtgaacaaggccgtggactacccccccgtggccaacgccggccccaaccaggtgatcaccctgccccagaacagcatcaccctgttcggcaaccagagcaccgacgaccacggcatcaccagctacgagtggagcctgagccccagcagcaagggcaaggtggtggagatgcagggcgtgagaacccccaccctgcagctgagcgccatgcaggagggcgactacacctaccagctgaccgtgaccgacaccatcggccagcaggccaccgcccaggtgaccgtgatcgtgcagcccgagaacaacaagcccccccaggccgacgccggccccgacaaggagctgaccctgcccgtggacagcaccaccctggacggcagcaagagcagcgacgaccagaagatcatcagctacctgtgggagaagacccagggccccgacggcgtgcagctggagaacgccaacagcagcgtggccaccgtgaccggcctgcaggtgggcacctacgtgttcaccctgaccgtgaaggacgagagaaacctgcagagccagagcagcgtgaacgtgatcgtgaaggaggagatcaacaagccccccatcgccaagatcaccggcaacgtggtgatcaccctgcccaccagcaccgccgagctggacggcagcaagagcagcgacgacaagggcatcgtgagctacctgtggaccagagacgagggcagccccgccgccggcgaggtgctgaaccacagcgaccaccaccccatcctgttcctgagcaacctggtggagggcacctacaccttccacctgaaggtgaccgacgccaagggcgagagcgacaccgacagaaccaccgtggaggtgaagcccgaccccagaaagaacaacctggtggagatcatcctggacatcaacgtgagccagctgaccgagagactgaagggcatgttcatcagacagatcggcgtgctgctgggcgtgctggacagcgacatcatcgtgcagaagatccagccctacaccgagcagagcaccaagatggtgttcttcgtgcagaacgagcccccccaccagatcttcaagggccacgaggtggccgccatgctgaagagcgagctgagaaagcagaaggccgacttcctgatcttcagagccctggaggtgaacaccgtgacctgccagctgaactgcagcgaccacggccactgcgacagcttcaccaagagatgcatctgcgaccccttctggatggagaacttcatcaaggtgcagctgagagacggcgacagcaactgcgagtggagcgtgctgtacgtgatcatcgccaccttcgtgatcgtggtggccctgggcatcctgagctggaccgtgatctgctgctgcaagagacagaagggcaagcccaagagaaagagcaagtacaagatcctggacgccaccgaccaggagagcctggagctgaagcccaccagcagagccggcatcaagcagaagggcctgctgctgagcagcagcctgatgcacagcgagagcgagctggacagcgacgacgccatcttcacctggcccgacagagagaagggcaagctgctgcacggccagaacggcagcgtgcccaacggccagacccccctgaaggccagaagccccagagaggagatcctgtag

SEQ ID NO: 18933 - DNA, 4830 bp, Artificial Sequence
  Description of Artificial Sequence: Synthetic coding sequence
atggccggcctgagaagaccccagcccggctgctactgcagaaccgccgccgccgtgaacctgctgctgggcgtgttccaggtgctgctgccctgctgcagacccggcggcgcccagggccaggccatcgagcccctgcccaacgtggtggagctgtggcaggccgaggagggcgagctgctgctgcccacccagggcgacagcgaggagggcctggaggagcccagccaggagcagagcttcagcgacaagctgttcagcggcaagggcctgcacttccagcccagcgtgctggacttcggcatccagttcctgggccaccccgtggccaagatcctgcacgcctacaaccccagcagagacagcgaggtggtggtgaacagcgtgttcgccgccgccggccacttccacgtgccccccgtgccctgcagagtgatccccgccatgggcaagaccagcttcagaatcatcttcctgcccaccgaggagggcagcatcgagagcagcctgttcatcaacaccagcagctacggcgtgctgagctaccacgtgagcggcatcggcaccagaagaatcagcaccgagggcagcgccaagcagctgcccaacgcctacttcctgctgcccaaggtgcagagcatccagctgagccagatgcaggccgagaccaccaacaccagcctgctgcaggtgcagctggagtgcagcctgcacaacaaggtgtgccagcagctgaagggctgctacctggagagcgacgacgtgctgagactgcagatgagcatcatggtgaccatggagaacttcagcaaggagttcgaggagaacacccagcacctgctggaccacctgagcatcgtgtacgtggccaccgacgagagcgagaccagcgacgacagcgccgtgaacatgtacatcctgcacagcggcaacagcctgatctggatccaggacatcagacacttcagccagagagacgccctgagcctgcagttcgagcccgtgctgctgcccaccagcaccaccaacttcaccaagatcgccagcttcacctgcaaggccaccagctgcgacagcggcatcatcgaggacgtgaagaagaccacccacacccccaccctgaaggcctgcctgttcagcagcgtggcccagggctacttcagaatggacagcagcgccacccagttccacatcgagacccacgagaacaccagcggcctgtggagcatctggtacagaaaccacttcgacagaagcgtggtgctgaacgacgtgttcctgagcaaggagaccaagcacatgctgaagatcctgaacttcaccggccccctgttcctgccccccggctgctggaacatcttcagcctgaagctggccgtgaaggacatcgccatcaacctgttcaccaacgtgttcctgaccaccaacatcggcgccatcttcgccatccccctgcagatctacagcgcccccaccaaggagggcagcctgggcttcgaggtgatcgcccactgcggcatgcactacttcatgggcaagagcaaggccggcaaccccaactggaacggcagcctgagcctggaccagagcacctggaacgtggacagcgagctggccaacaagctgtacgagagatggaagaagtacaagaacggcgacgtgtgcaagagaaacgtgctgggcaccaccagattcgcccacctgaagaagagcaaggagagcgagagcttcgtgttcttcctgcccagactgatcgccgagcccggcctgatgctgaacttcagcgccaccgccctgagaagcagaatgatcaagtacttcgtggtgcagaaccccagcagctggcccgtgagcctgcagctgctgcccctgagcctgtaccccaagcccgaggccctggtgcacctgctgcacagatggttcggcaccgacatgcagatgatcaacttcaccaccggcgagttccagctgaccgaggcctgcccctacctgggcacccacagcgaggagagcagattcggcatcctgcacctgcacctgcagcccctggagatgaagagagtgggcgtggtgttcacccccgccgactacggcaaggtgaccagcctgatcctgatcagaaacaacctgaccgtgatcgacatgatcggcgtggagggcttcggcgccagagagctgctgaaggtgggcggcagactgcccggcgccggcggcagcctgagattcaaggtgcccgagagcaccctgatggactgcagaagacagctgaaggacagcaagcagatcctgagcatcaccaagaacttcaaggtggagaacatcggccccctgcccatcaccgtgagcagcctgaagatcaacggctacaactgccagggctacggcttcgaggtgctggactgccaccagttcagcctggaccccaacaccagcagagacatcagcatcgtgttcacccccgacttcaccagcagctgggtgatcagagacctgagcctggtgaccgccgccgacctggagttcagattcaccctgaacgtgaccctgccccaccacctgctgcccctgtgcgccgacgtggtgcccggccccagctgggaggagagcttctggagactgaccgtgttcttcgtgagcctgagcctgctgggcgtgatcctgatcgccttccagcaggcccagtacatcctgatggagttcatgaagaccagacagagacagaacgccagcagcagcagccagcagaacaacggccccatggacgtgatcagcccccacagctacaagagcaactgcaagaacttcctggacacctacggccccagcgacaagggcagaggcaagaactgcctgcccgtgaacaccccccagagcagaatccagaacgccgccaagagaagccccgccacctacggccacagccagaagaagcacaagtgcagcgtgtactacagcaagcacaagaccagcaccgccgccgccagcagcaccagcaccaccaccgaggagaagcagaccagccccctgggcagcagcctgcccgccgccaaggaggacatctgcaccgacgccatgagagagaactggatcagcctgagatacgccagcggcatcaacgtgaacctgcagaagaacctgaccctgcccaagaacctgctgaacaaggaggagaacaccctgaagaacaccatcgtgttcagcaaccccagcagcgagtgcagcatgaaggagggcatccagacctgcatgttccccaaggagaccgacatcaagaccagcgagaacaccgccgagttcaaggagagagagctgtgccccctgaagaccagcaagaagctgcccgagaaccacctgcccagaaacagcccccagtaccaccagcccgacctgcccgagatcagcagaaagaacaacggcaacaaccagcaggtgcccgtgaagaacgaggtggaccactgcgagaacctgaagaaggtggacaccaagcccagcagcgagaagaagatccacaagaccagcagagaggacatgttcagcgagaagcaggacatccccttcgtggagcaggaggacccctacagaaagaagaagctgcaggagaagagagagggcaacctgcagaacctgaactggagcaagagcagaacctgcagaaagaacaagaagagaggcgtggcccccgtgagcagaccccccgagcagagcgacctgaagctggtgtgcagcgacttcgagagaagcgagctgagcagcgacatcaacgtgagaagctggtgcatccaggagagcaccagagaggtgtgcaaggccgacgccgagatcgccagcagcctgcccgccgcccagagagaggccgagggctactaccagaagcccgagaagaagtgcgtggacaagttctgcagcgacagcagcagcgactgcggcagcagcagcggcagcgtgagagccagcagaggcagctggggcagctggagcagcaccagcagcagcgacggcgacaagaagcccatggtggacgcccagcacttcctgcccgccggcgacagcgtgagccagaacgacttccccagcgaggcccccatcagcctgaacctgagccacaacatctgcaaccccatgaccgtgaacagcctgccccagtacgccgagcccagctgccccagcctgcccgccggccccaccggcgtggaggaggacaagggcctgtacagccccggcgacctgtggcccaccccccccgtgtgcgtgaccagcagcctgaactgcaccctggagaacggcgtgccctgcgtgatccaggagagcgcccccgtgcacaacagcttcatcgactggagcgccacctgcgagggccagttcagcagcgcctactgccccctggagctgaacgactacaacgccttccccgaggagaacatgaactacgccaacggcttcccctgccccgccgacgtgcagaccgacttcatcgaccacaacagccagagcacctggaacaccccccccaacatgcccgccgcctggggccacgccagcttcatcagcagccccccctacctgaccagcaccagaagcctgagccccatgagcggcctgttcggcagcatctgggccccccagagcgacgtgtacgagaactgctgccccatcaaccccaccaccgagcacagcacccacatggagaaccaggccgtggtgtgcaaggagtactaccccggcttcaaccccttcagagcctacatgaacctggacatctggaccaccaccgccaacagaaacgccaacttccccctgagcagagacagcagctactgcggcaacgtgtag

SEQ ID NO: 18934 - DNA, 4212 bp, Artificial Sequence
  Description of Artificial Sequence: Synthetic coding sequence
atggccaactgcagccaggaggagctggacgaggagttcgagcagttcatgaaggagctgagcgacgacagcttcgagaacagcgacaagaccgccagacagagcaagaaggagatgaagaagaaggacaccgtgccctggtggatcaccgaggacgacttcaaggacgacggcctgctgggcaccaacgtgagctacctgaagaccaagaagaccagccagcccgtgatggagatcgaggaggagagcgccgagaagatccagttcctgaagagcagcggcaccagcctgctgagcaccgacagcctggagaccaacgagctggtggtgagcgagctgaaccacagcagcctgggcgtgggcctggacaccctggaggagcaggaggagaaggagcagttcttcgccagactggagaagggcctgaccagcagcatcgactacagcagactgaacaaggagctggacagcaacgacagcacccacttcaaggccctgcacagcaaccaggccaacgccgagctgaccgacgacgagcacgagaacgagagcaagcacgaggagctggccgagaactacagcgacgacttcgaggacgagtacgtgggcgcccccctgaccaccaaggacgaggagatgcccagcaaggagaacagcaagagcgagaagatcagcgtgcccaagcaggaggaggagaagaccggcatgctggccaacgtggtgctgctggacagcctggacagcgtggccgaggtgaacctggacgagcaggacaagatcacccccaagcccagatgcctgcccgagatgaccgagaacgagatgaccggcaccggcgtgagctacggccagagcagcagcgacgtggaggccctgcaccaggcctactgccacatcgcccacagcctgggcgacgaggacaagcagaagatcgagagcaacaccgtggaggacatcaagagcagcgtgaagggccacccccaggagaacgaggagaacagcaagaacatcagcaccatggagagcgacctgcccaccgtggaggagctgatgaagcccatcagaatcgacagcttcggcatcagcggcttcgacctgcagcccgtgagcagcgagaaggtggccgagagaaaggagaccgagttcttcagcagcctgcccctgaagatgaaccccaacatcctgagccaggacagccagcacgtgaacctgttcttcgacaagaacgacgagaacgtgatcctgcagaagaccaccaacgagagcatggagaacagctgcccccaggtgaccgaggtgaccgccaccgaggagcacgtggacaagatgtacctgaacatcctgagaaagaagatcaccgtgaacagcagcagcctgagccaggacgacaagatcaacaagacctacagaagccagctgagcagcgaggaggagggcgccgtgatgggcaagcaggtgccctacaagaaggccagaagcgccccccccctgctgaagagaaagccccagagcggcctgtacgccagcgtgagaagcagcggctacggcaagcccagcagccccctgaagatgttcagcaccctggagaagaagaccagcgaggacatcatcaagagcaagaacctgagaagcatcagcaccagcaaccagcccagaaagaaggagatcctgagcggcaccaagctgatcaagcccgccgccctggacaagcccgcccacaagaccgagagctgcctgagcaccagaaagaagagcgagaaccccaccgagaccgacagctgcatccagttccagaccgacagcctgggctactgcggcgagaacaaggagaagaagctgctgatgttcaagagagtgcaggaggccgaggacaagtggagaggcgcccaggccctgatcgagcagatcaaggccaccttcagcgagaaggagaaggagctggagaacaagctggaggagctgaagaagcagcaggagaaggagctgttcaagctgaaccaggacaactacatcctgcaggccaagctgagcagcttcgaggagaccaacaagaagcagagatggctgcacttcggcgaggccgccgaccccgtgaccggcgagaagctgaagcagatccagaaggagatccaggagcaggagaccctgctgcagggctaccagcaggagaacgagagactgtacaaccaggtgaaggacctgcaggagcagaacaagaagaacgaggagagaatgttcaaggagaaccagagcctgttcagcgaggtggccagcctgaaggagcagatgcacaagagcagattcctgagccaggtggtggaggacagcgagcccaccagaaaccagaacttcaccgacctgctggccgagctgagaatggcccagaaggagaaggacagcctgctggaggacatcaagagactgaagcaggacaagcaggccctggaggtggacttcgagaagatgaagaaggagagagaccaggccaaggaccagatcgcctacgtgaccggcgagaagctgtacgagatcaagatcctggaggagacccacaagcaggagatcagcagactgcagaagagactgcagtggtacgccgagaaccaggagctgctggacaaggacgccctgagactgagagaggccaacgaggagatcgagaagctgaagctggagatcgagaagctgaaggccgagagcggcaaccccagcatcagacagaagatcagactgaaggacaaggccgccgacgccaagaagatccaggacctggagagacaggtgaaggagatggagggcatcctgaagagaagataccccaacagcctgcccgccctgatcctggccgccagcgccgccggcgacaccgtggacaagaacaccgtggagttcatggagaagagaatcaagaagctggaggccgacctggagggcaaggacgaggacgccaagaagagcctgagaaccatggagcagcagttccagaagatgaagatccagtacgagcagagactggagcagcaggagcagctgctggcctgcaagctgaaccagcacgacagccccagaatcaaggccctggagaaggagctggacgacatcaaggaggcccaccagatcaccgtgagaaacctggaggccgagatcgacgtgctgaagcaccagaacgccgagctggacgtgaagaagaacgacaaggacgacgaggacttccagagcatcgagttccaggtggagcaggcccacgccaaggccaagctggtgagactgaacgaggagctggccgccaagaagagagagatccaggacctgagcaagaccgtggagagactgcagaaggacagaagaatgatgctgagcaaccagaacagcaagggcagagaggagatgagcgccaagagagccaagaaggacgtgctgcacagcagcaagggcaacgccaacagcttccccggcaccctggacagcaagctgtaccagccccacaccttcaccgacagccacgtgagcgaggtgctgcaggagaactacagactgaagaacgagctggagggcctgatcagcgagaagaacgagctgaagatgaagagcgaggccgtgatgaaccagttcgagaacagcatgagaagagtgaaggaggacaccgccgcccacatcgccagcctgaaggccagccaccagagagagatcgagaagctgctgtgccagaacgccgtggagaacagcagcagcaaggtggccgagctgaacagaaagatcgccacccaggaggtgctgatcagacacttccagagccaggtgaacgagctgcagagcaagcaggagagcctggtggtgagcgaggtgagagaggagatcctgcagaaggagatcaccaagctgctggaggagctgagagaggccaaggagaaccacacccccgagatgaagcacttcgtgggcctggagaagaagatcaagcagatggagatgagacacgcccagagagagcaggagctgcagcagatcatccagcagacccaccaggtggtggagaccgagcagaacaaggaggtggagaagtggaagagactggcccagctgaagaacagagagctggagaagttcagaaccgagctggacagcatcctggacgtgctgagagagctgcacagacagggcgtggtggtgcccgtggccttcgccgacgagatgaacgcccccgagtactag

SEQ ID NO: 18935 - DNA, 2751 bp, Artificial Sequence
  Description of Artificial Sequence: Synthetic coding sequence
atggagaccagccaggagaccagcctgttcctggtgaagatcctggaggagctggacagcaagcagaacaccgtgagctaccaggacctgtgcaagagcctgtgcgccagattcgacctgagccagctggccaagctgagaagcgtgctgttctacaccgcctgcctggaccccaacttccccgccaccctgttcaaggacaagatgaagtgcaccgtgaacaaccagcagagcaagaagatcatggtggccgccgacatcgtgaccatcttcaacctgatccagatgaacggcggcgccgccaaggagaagctgcccaccggcagacagaaggtgagaaagaaggaggccagcttcgagagctgcagaagcgacaccgagatctgcaacgccgccgagtgcgagcccctgaactgcgagctgagcgagagaagcttcagcagaggctaccccatcagacagagcagcaagtgcagaaagatggactgcaaggactgcccccagttcgtgcccgccagcgagcccaacttcctgctgggcgtgagcaaggaggtgaagaacagagccgccagcctggacagactgcaggccctggccccctacagcgtgaccagcccccagccctgcgagatgcagagaacctacttccccatgaacatcgagaacgagagcatcagcgaccaggacagcctgcccatcaaccagagcatcaaggagaccttcatcagcaacgaggagcccttcgtggtgcagagctgcgtgcagaagagaaacatcttcaaggaggacttccacaacctgatggccgtgagccccagcctggtgggccccatcagcaaggccgagaacgagcacagagagccccagagcagaaaggagccccacaagccccccttcttcaaccacagcttcgagatgccctacaacagccagtacctgaaccccgtgtacagccccgtgcccgacaagagaagagccaagcacgagagcctggacgacctgcaggccagcacctacttcggccccacccccgtgatgggcacccaggaggccagaagatgcctgggcaagcccaacaagcagaccccctggcccgccaagagctggagcctgaacaccgaggaggtgcccgacttcgagagaagcttcttcaacagaaaccccagcgaggagaagctgcactaccccaacgccagcagccagacccccaacttccccgcccccgagagaagacccacctacctggtgcccaaggaccagcagcccatcctgcccatcgcctacgccgccaagcagaacggcctgaagagcaaggagatcagcagccccgtggacctggagaagcacgagcccgtgaagaagttcaaggacaagagcatcaactgcaccagcggccagctgagcagcgacaccagcagcgtgggcacccagaccgagcacgtgctggagcccaagaagtgcagagacctgtgcaccagcggccagggcaagtacagcgacagacacaccatgaagcacagcgacgacgacagcgagatcgtgagcgacgacatcagcgacatcttcagattcctggacgacatgagcatcagcggcagcaccggcgtgatccagagcagctgctacaacagcaccggcagcctgagccagctgcacaagagcgactgcgacagcagccccgagcacaacctgaccaagatcgccaacggcgtgcccaacagcaagggcgacaagggcaacagacccgagaacacccaccacagcgaggaggagctgaagaccagcgtgtgcaagctggtgctgagaatcggcgagatcgagagaaagctggagagcctgagcggcgtgagagacgagatcagccaggtgctgggcaagctgaacaagctggaccagaagatgcagcagcccgagaaggtgagcgtgcagatcgacctgaacagcctgaccagcgagggccccagcgacgacagcgccagccccagaatgttccacgcccacagcggcagccacggccccaagctggagaacaaccccgactggtgctgcagcgacgccagcggcagcaacagcgagagcctgagagtgaaggccctgaagaagagcctgttcaccagacccagcagcagaagcctgaccgaggagaacagcgccaccgagagcaagatcgccagcatcagcaacagccccagagactggagaaccatcacctacaccaacagagtgggcctgaacgaggaggagatcaaggacaccggccccggcgacaacaaggactggcacagaaagagcaaggaggccgacagacagtacgacatccccccccagcacagactgcccaagcagcccaaggacggcttcctggtggagcaggtgttcagcccccacccctaccccgccagcctgaaggcccacatgaagagcaaccccctgtacaccgacatgagactgaccgagctggccgaggtgaagagaggccagcccagctggaccatcgaggagtacgccagaaacgccggcgacaagggcaagctgaccgccctggacctgcagacccaggagagcctgaaccccaacaacctggagtactggatggaggacatctacacccccggctacgacagcctgctgaagagaaaggaggccgagttcagaagagccaaggtgtgcaagatcgccgccctgatcgccgccgccgcctgcaccgtgatcctggtgatcgtggtgcccatctgcaccatgaagagctag

SEQ ID NO: 18936 - DNA, 6534 bp, Artificial Sequence
  Description of Artificial Sequence: Synthetic coding sequence
atggaggagatcctgagaaagctgcagaaggaggccagcggcagcaagtacaaggccatcaaggagagctgcacctgggccctggagaccctgggcggcctggacaccatcgtgaagatccccccccacgtgctgagagagaagtgcctgctgcccctgcagctggccctggagagcaagaacgtgaagctggcccagcacgccctggccggcatgcagaagctgctgagcgaggagagattcgtgagcatggagaccgacagcgacgagaagcagctgctgaaccagatcctgaacgccgtgaaggtgacccccagcctgaacgaggacctgcaggtggaggtgatgaaggtgctgctgtgcatcacctacacccccaccttcgacctgaacggcagcgccgtgctgaagatcgccgaggtgtgcatcgagacctacatcagcagctgccaccagagaagcatcaacaccgccgtgagagccaccctgagccagatgctgagcgacctgaccctgcagctgagacagagacaggagaacaccatcatcgagaaccccgacgtgccccaggacttcggcaaccagggcagcaccgtggagagcctgtgcgacgacgtggtgagcgtgctgaccgtgctgtgcgagaagctgcaggccgccatcaacgacagccagcagctgcagctgctgtacctggagtgcatcctgagcgtgctgagcagcagcagcagcagcatgcacctgcacagaagattcaccgacctgatctggaagaacctgtgccccgccctgatcgtgatcctgggcaaccccatccacgacaagaccatcaccagcgcccacaccagcagcaccagcaccagcctggagagcgacagcgccagccccggcgtgagcgaccacggcagaggcagcggctgcagctgcaccgcccccgccctgagcggccccgtggccagaaccatctactacatcgccgccgagctggtgagactggtgggcagcgtggacagcatgaagcccgtgctgcagagcctgtaccacagagtgctgctgtacccccccccccagcacagagtggaggccatcaagatcatgaaggagatcctgggcagcccccagagactgtgcgacctggccggccccagcagcaccgagagcgagagcagaaagagaagcatcagcaagagaaagagccacctggacctgctgaagctgatcatggacggcatgaccgaggcctgcatcaagggcggcatcgaggcctgctacgccgccgtgagctgcgtgtgcaccctgctgggcgccctggacgagctgagccagggcaagggcctgagcgagggccaggtgcagctgctgctgctgagactggaggagctgaaggacggcgccgagtggagcagagacagcatggagatcaacgaggccgacttcagatggcagagaagagtgctgagcagcgagcacaccccctgggagagcggcaacgagagaagcctggacatcagcatcagcgtgaccaccgacaccggccagaccaccctggagggcgagctgggccagaccacccccgaggaccacagcggcaaccacaagaacagcctgaagagccccgccatccccgagggcaaggagaccctgagcaaggtgctggagaccgaggccgtggaccagcccgacgtggtgcagagaagccacaccgtgccctaccccgacatcaccaacttcctgagcgtggactgcagaaccagaagctacggcagcagatacagcgagagcaacttcagcgtggacgaccaggacctgagcagaaccgagttcgacagctgcgaccagtacagcatggccgccgagaaggacagcggcagaagcgacgtgagcgacatcggcagcgacaactgcagcctggccgacgaggagcagacccccagagactgcctgggccacagaagcctgagaaccgccgccctgagcctgaagctgctgaagaaccaggaggccgaccagcacagcgccagactgttcatccagagcctggagggcctgctgcccagactgctgagcctgagcaacgtggaggaggtggacaccgccctgcagaacttcgccagcaccttctgcagcggcatgatgcacagccccggcttcgacggcaacagcagcctgagcttccagatgctgatgaacgccgacagcctgtacaccgccgcccactgcgccctgctgctgaacctgaagctgagccacggcgactactacagaaagagacccaccctggcccccggcgtgatgaaggacttcatgaagcaggtgcagaccagcggcgtgctgatggtgttcagccaggcctggatcgaggagctgtaccaccaggtgctggacagaaacatgctgggcgaggccggctactggggcagccccgaggacaacagcctgcccctgatcaccatgctgaccgacatcgacggcctggagagcagcgccatcggcggccagctgatggccagcgccgccaccgagagccccttcgcccagagcagaagaatcgacgacagcaccgtggccggcgtggccttcgccagatacatcctggtgggctgctggaagaacctgatcgacaccctgagcacccccctgaccggcagaatggccggcagcagcaagggcctggccttcatcctgggcgccgagggcatcaaggagcagaaccagaaggagagagacgccatctgcatgagcctggacggcctgagaaaggccgccagactgagctgcgccctgggcgtggccgccaactgcgccagcgccctggcccagatggccgccgccagctgcgtgcaggaggagaaggaggagagagaggcccaggagcccagcgacgccatcacccaggtgaagctgaaggtggagcagaagctggagcagatcggcaaggtgcagggcgtgtggctgcacaccgcccacgtgctgtgcatggaggccatcctgagcgtgggcctggagatgggcagccacaaccccgactgctggccccacgtgttcagagtgtgcgagtacgtgggcaccctggagcacaaccacttcagcgacggcgccagccagccccccctgaccatcagccagccccagaaggccaccggcagcgccggcctgctgggcgaccccgagtgcgagggcagcccccccgagcacagccccgagcagggcagaagcctgagcaccgcccccgtggtgcagcccctgagcatccaggacctggtgagagagggcagcagaggcagagccagcgacttcagaggcggcagcctgatgagcggcagcagcgccgccaaggtggtgctgaccctgagcacccaggccgacagactgttcgaggacgccaccgacaagctgaacctgatggccctgggcggcttcctgtaccagctgaagaaggccagccagagccagctgttccacagcgtgaccgacaccgtggactacagcctggccatgcccggcgaggtgaagagcacccaggacagaaagagcgccctgcacctgttcagactgggcaacgccatgctgagaatcgtgagaagcaaggccagacccctgctgcacgtgatgagatgctggagcctggtggccccccacctggtggaggccgcctgccacaaggagagacacgtgagccagaaggccgtgagcttcatccacgacatcctgaccgaggtgctgaccgactggaacgagcccccccacttccacttcaacgaggccctgttcagacccttcgagagaatcatgcagctggagctgtgcgacgaggacgtgcaggaccaggtggtgaccagcatcggcgagctggtggaggtgtgcagcacccagatccagagcggctggagacccctgttcagcgccctggagaccgtgcacggcggcaacaagagcgagatgaaggagtacctggtgggcgactacagcatgggcaagggccaggcccccgtgttcgacgtgttcgaggccttcctgaacaccgacaacatccaggtgttcgccaacgccgccaccagctacatcatgtgcctgatgaagttcgtgaagggcctgggcgaggtggactgcaaggagatcggcgactgcgcccccgcccccggcgcccccagcaccgacctgtgcctgcccgccctggactacctgagaagatgcagccagctgctggccaagatctacaagatgcccctgaagcccatcttcctgagcggcagactggccggcctgcccagaagactgcaggagcagagcgccagcagcgaggacggcatcgagagcgtgctgagcgacttcgacgacgacaccggcctgatcgaggtgtggatcatcctgctggagcagctgaccgccgccgtgagcaactgccccagacagcaccagccccccaccctggacctgctgttcgagctgctgagagacgtgaccaagacccccggccccggcttcggcatctacgccgtggtgcacctgctgctgcccgtgatgagcgtgtggctgagaagaagccacaaggaccacagctactgggacatggccagcgccaacttcaagcacgccatcggcctgagctgcgagctggtggtggagcacatccagagcttcctgcacagcgacatcagatacgagagcatgatcaacaccatgctgaaggacctgttcgagctgctggtggcctgcgtggccaagcccaccgagaccatcagcagagtgggctgcagctgcatcagatacgtgctggtgaccgccggccccgtgttcaccgaggagatgtggagactggcctgctgcgccctgcaggacgccttcagcgccaccctgaagcccgtgaaggacctgctgggctgcttccacagcggcaccgagagcttcagcggcgagggctgccaggtgagagtggccgcccccagcagcagccccagcgccgaggccgagtactggagaatcagagccatggcccagcaggtgttcatgctggacacccagtgcagccccaagacccccaacaacttcgaccacgcccagagctgccagctgatcatcgagctgccccccgacgagaagcccaacggccacaccaagaagagcgtgagcttcagagagatcgtggtgagcctgctgagccaccaggtgctgctgcagaacctgtacgacatcctgctggaggagttcgtgaagggccccagccccggcgaggagaagaccatccaggtgcccgaggccaagctggccggcttcctgagatacatcagcatgcagaacctggccgtgatcttcgacctgctgctggacagctacagaaccgccagagagttcgacaccagccccggcctgaagtgcctgctgaagaaggtgagcggcatcggcggcgccgccaacctgtacagacagagcgccatgagcttcaacatctacttccacgccctggtgtgcgccgtgctgaccaaccaggagaccatcaccgccgagcaggtgaagaaggtgctgttcgaggacgacgagagaagcaccgacagcagccagcagtgcagcagcgaggacgaggacatcttcgaggagaccgcccaggtgagcccccccagaggcaaggagaagagacagtggagagccagaatgcccctgctgagcgtgcagcccgtgagcaacgccgactgggtgtggctggtgaagagactgcacaagctgtgcatggagctgtgcaacaactacatccagatgcacctggacctggagaactgcatggaggagccccccatcttcaagggcgaccccttcttcatcctgcccagcttccagagcgagagcagcacccccagcaccggcggcttcagcggcaaggagacccccagcgaggacgacagaagccagagcagagagcacatgggcgagagcctgagcctgaaggccggcggcggcgacctgctgctgccccccagccccaaggtggagaagaaggaccccagcagaaagaaggagtggtgggagaacgccggcaacaagatctacaccatggccgccgacaagaccatcagcaagctgatgaccgagtacaagaagagaaagcagcagcacaacctgagcgccttccccaaggaggtgaaggtggagaagaagggcgagcccctgggccccagaggccaggacagccccctgctgcagagaccccagcacctgatggaccagggccagatgagacacagcttcagcgccggccccgagctgctgagacaggacaagagacccagaagcggcagcaccggcagcagcctgagcgtgagcgtgagagacgccgaggcccagatccaggcctggaccaacatggtgctgaccgtgctgaaccagatccagatcctgcccgaccagaccttcaccgccctgcagcccgccgtgttcccctgcatcagccagctgacctgccacgtgaccgacatcagagtgagacaggccgtgagagagtggctgggcagagtgggcagagtgtacgacatcatcgtgtag

SEQ ID NO: 18937 - DNA, 3042 bp, Artificial Sequence
  Description of Artificial Sequence: Synthetic coding sequence
atggccgagcccggccacagccaccacctgagcgccagagtgagaggcagaaccgagagaagaatccccagactgtggagactgctgctgtgggccggcaccgccttccaggtgacccagggcaccggccccgagctgcacgcctgcaaggagagcgagtaccactacgagtacaccgcctgcgacagcaccggcagcagatggagagtggccgtgccccacacccccggcctgtgcaccagcctgcccgaccccatcaagggcaccgagtgcagcttcagctgcaacgccggcgagttcctggacatgaaggaccagagctgcaagccctgcgccgagggcagatacagcctgggcaccggcatcagattcgacgagtgggacgagctgccccacggcttcgccagcctgagcgccaacatggagctggacgacagcgccgccgagagcaccggcaactgcaccagcagcaagtgggtgcccagaggcgactacatcgccagcaacaccgacgagtgcaccgccaccctgatgtacgccgtgaacctgaagcagagcggcaccgtgaacttcgagtactactaccccgacagcagcatcatcttcgagttcttcgtgcagaacgaccagtgccagcccaacgccgacgacagcagatggatgaagaccaccgagaagggctgggagttccacagcgtggagctgaacagaggcaacaacgtgctgtactggagaaccaccgccttcagcgtgtggaccaaggtgcccaagcccgtgctggtgagaaacatcgccatcaccggcgtggcctacaccagcgagtgcttcccctgcaagcccggcacctacgccgacaagcagggcagcagcttctgcaagctgtgccccgccaacagctacagcaacaagggcgagaccagctgccaccagtgcgaccccgacaagtacagcgagaagggcagcagcagctgcaacgtgagacccgcctgcaccgacaaggactacttctacacccacaccgcctgcgacgccaacggcgagacccagctgatgtacaagtgggccaagcccaagatctgcagcgaggacctggagggcgccgtgaagctgcccgccagcggcgtgaagacccactgccccccctgcaaccccggcttcttcaagaccaacaacagcacctgccagccctgcccctacggcagctacagcaacggcagcgactgcaccagatgccccgccggcaccgagcccgccgtgggcttcgagtacaagtggtggaacaccctgcccaccaacatggagaccaccgtgctgagcggcatcaacttcgagtacaagggcatgaccggctgggaggtggccggcgaccacatctacaccgccgccggcgccagcgacaacgacttcatgatcctgaccctggtggtgcccggcttcagacccccccagagcgtgatggccgacaccgagaacaaggaggtggccagaatcaccttcgtgttcgagaccctgtgcagcgtgaactgcgagctgtacttcatggtgggcgtgaacagcagaaccaacacccccgtggagacctggaagggcagcaagggcaagcagagctacacctacatcatcgaggagaacaccaccaccagcttcacctgggccttccagagaaccaccttccacgaggccagcagaaagtacaccaacgacgtggccaagatctacagcatcaacgtgaccaacgtgatgaacggcgtggccagctactgcagaccctgcgccctggaggccagcgacgtgggcagcagctgcaccagctgccccgccggctactacatcgacagagacagcggcacctgccacagctgccccaccaacaccatcctgaaggcccaccagccctacggcgtgcaggcctgcgtgccctgcggccccggcaccaagaacaacaagatccacagcctgtgctacaacgactgcaccttcagcagaaacacccccaccagaaccttcaactacaacttcagcgccctggccaacaccgtgaccctggccggcggccccagcttcaccagcaagggcctgaagtacttccaccacttcaccctgagcctgtgcggcaaccagggcagaaagatgagcgtgtgcaccgacaacgtgaccgacctgagaatccccgagggcgagagcggcttcagcaagagcatcaccgcctacgtgtgccaggccgtgatcatcccccccgaggtgaccggctacaaggccggcgtgagcagccagcccgtgagcctggccgacagactgatcggcgtgaccaccgacatgaccctggacggcatcaccagccccgccgagctgttccacctggagagcctgggcatccccgacgtgatcttcttctacagaagcaacgacgtgacccagagctgcagcagcggcagaagcaccaccatcagagtgagatgcagcccccagaagaccgtgcccggcagcctgctgctgcccggcacctgcagcgacggcacctgcgacggctgcaacttccacttcctgtgggagagcgccgccgcctgccccctgtgcagcgtggccgactaccacgccatcgtgagcagctgcgtggccggcatccagaagaccacctacgtgtggagagagcccaagctgtgcagcggcggcatcagcctgcccgagcagagagtgaccatctgcaagaccatcgacttctggctgaaggtgggcatcagcgccggcacctgcaccgccatcctgctgaccgtgctgacctgctacttctggaagaagaaccagaagctggagtacaagtacagcaagctggtgatgaacgccaccctgaaggactgcgacctgcccgccgccgacagctgcgccatcatggagggcgaggacgtggaggacgacctgatcttcaccagcaagaagagcctgttcggcaagatcaagagcttcaccagcaagagaacccccgacggcttcgacagcgtgcccctgaagaccagcagcggcggcctggacatggacctgtag

SEQ ID NO: 18938 - DNA, 1869 bp, Artificial Sequence
  Description of Artificial Sequence: Synthetic coding sequence
atggccaccgtgctgagcagagccctgaagctgcccggcaagaagagccccgacctgggcgagtacgaccccctgacccaggccgacagcgacgagagcgaggacgacctggtgctgaacctgcagaagaacggcggcgtgaagaacggcaagagccccctgggcgaggcccccgagcccgacagcgacgccgaggtggccgaggccgccaagccccacctgagcgaggtgaccaccgagggctaccccagcgagcccctgggcggcctggagcagaaggccgccagcagcctggtgagctacgtgagaaccagcgtgttcctgctgaccctgggcatcagcatgatcctggtgctgctgtgcgccttcctgatcccctgcccccccagagacctgcacagcacctggagcagacacctgggcagccagggcggcggcgacctgagccccctggagctggccgacgtgaacggcgacggcctgagagacgtgctgctgagcttcgtgatgagcagaaacggcagcgccgtgggcgtgagcagacccgccgccaacctggtgtgcctgagcggcatgaacggcagcaccctgtggagcagcctgctgcccgaggaggccagagacatcacctgcctggagctgatgcccggcagcctggccgagaccatctgcctggtgaccggcacccacaagatgctgagcgccttcaacgccaccagcggcaaggccatctggaccctgaaccccaactacctgagcaacggcaccctggccgcccccgtggtggtgctgcccgacctggacgaggacggcgtgagagacctggtggtgctggccatcggcgagctgcagcccgacctgtgcttcctgctggtgagcggcagaaccggcaaccccgtgggcagacccgtgaagtacaacatcgtgggcgtgggcaacctgatcggcccccaggtgtacatcaccaccaacggcgccgtgtacatcctgttcggcttcggcaacatccaggccgtggccctgagagacatcttcgtgcaggcccagaacagagacagcagcccccccagcctgcagatcgaggagcccgagtgggagaagagaagaagcatcaacctgagcgagctgatcgacgtgtacagcgacggcgtggagctgctgcagatggtgaaggcccccgacagcaactgcagcaacctgctgatcaccaccagacagagcctggtgctgctgagaggccagaacctgaccccctactgggccctgagactgcagggcctgagaagccagcccacccccggctacttcaccgacgaccagaccctggacttcctgctgcagatccaggacggcgtgggcatgaagaagatgatggtggtggacggcgacagcggcagcatcgtgtggagctacagagccccctgccacatgaaggagacccccgccaccagcgccgtgaccagcgaccagaagagcgtgttcctgttctgggccgagggcctgagcgccgccagccccaacagcgacatcatcctgggcaccgagccccccagcctgcaccacctgtacctgctgcaccccgccttccccagcatcctgctggacctggccaacaccaccggcaccgtgaccgccagcgaggtgggcatcaacgacctgtggaaggacgccttctacgtgaccagaaccaccggccccagcagcgagggccaccccgccgccctggtggtgagcaagctgagcctgagatgggccctgatggagggccagatggcccagctgcaggagagcacccccaagatcggcagaggcgagctgagaagattcctgagcagaatcaagttcgtggaggccccctacgagatctag

SEQ ID NO: 18939 - DNA, 1869 bp, Artificial Sequence; identical to SEQ ID NO: 18938
  Description of Artificial Sequence: Synthetic coding sequence

SEQ ID NO: 18940 - DNA, 600 bp, Artificial Sequence
  Description of Artificial Sequence: Synthetic coding sequence
atgaccagctgcggccagcagagcctgaacgtgctggccgtgctgttcagcctgctgttcagcgccgtgctgagcgcccacttcagagtgtgcgagccctacaccgaccacaagggcagataccacttcggcttccactgccccagactgagcgacaacaagaccttcatcctgtgctgccaccacaacaacaccgtgttcaagtactgctgcaacgagaccgagttccaggccgtgatgcaggccaacctgaccgccagcagcgagggctacatgcacaacaactacaccgccctgctgggcgtgtggatctacggcttcttcgtgctgatgctgctggtgctggacctgctgtactacagcgccatgaactacgacatctgcaaggtgtacctggccagatggggcatccagggcagatggatgaagcaggaccccagaagatggggcaaccccgccagagcccccagacccggccagagagccccccagccccagcccccccccggccccctgccccaggccccccaggccgtgcacaccctgagaggcgacgcccacagcccccccctgatgaccttccagagcagcagcgcctag

SEQ ID NO: 18941 - DNA, 3543 bp, Artificial Sequence
  Description of Artificial Sequence: Synthetic coding sequence
atgaccctgcagggcagagccgacctgagcggcaaccagggcaacgccgccggcagactggccaccgtgcacgagcccgtggtgacccagtgggccgtgcacccccccgcccccgcccaccccagcctgctggacaagatggagaaggcccccccccagccccagcacgagggcctgaagagcaaggagcacctgccccagcagcccgccgagggcaagaccgccagcagaagagtgcccagactgagagccgtggtggagagccaggccttcaagaacatcctggtggacgagatggacatgatgcacgccagagccgccaccctgatccaggccaactggagaggctactggctgagacagaagctgatcagccagatgatggccgccaaggccatccaggaggcctggagaagattcaacaagagacacatcctgcacagcagcaagagcctggtgaagaagaccagagccgaggagggcgacatcccctaccacgccccccagcaggtgagattccagcaccccgaggagaacagactgctgagcccccccatcatggtgaacaaggagacccagttccccagctgcgacaacctggtgctgtgcagaccccagagcagccccctgctgcagccccccgccgcccagggcacccccgagccctgcgtgcagggcccccacgccgccagagtgagaggcctggccttcctgccccaccagaccgtgaccatcagattcccctgccccgtgagcctggacgccaagtgccagccctgcctgctgaccagaaccatcagaagcacctgcctggtgcacatcgagggcgacagcgtgaagaccaagagagtgagcgccagaaccaacaaggccagagcccccgagacccccctgagcagaagatacgaccaggccgtgaccagacccagcagagcccagacccagggccccgtgaaggccgagacccccaaggcccccttccagatctgccccggccccatgatcaccaagaccctgctgcagacctaccccgtggtgagcgtgaccctgccccagacctaccccgccagcaccatgaccaccaccccccccaagaccagccccgtgcccaaggtgaccatcatcaagacccccgcccagatgtaccccggccccaccgtgaccaagaccgccccccacacctgccccatgcccaccatgaccaagatccaggtgcaccccaccgccagcagaaccggcacccccagacagacctgccccgccaccatcaccgccaagaacagaccccaggtgagcctgctggccagcatcatgaagagcctgccccaggtgtgccccggccccgccatggccaagacccccccccagatgcaccccgtgaccacccccgccaagaaccccctgcagacctgcctgagcgccaccatgagcaagaccagcagccagagaagccccgtgggcgtgaccaagcccagcccccagaccagactgcccgccatgatcaccaagacccccgcccagctgagaagcgtggccaccatcctgaagaccctgtgcctggccagccccaccgtggccaacgtgaaggcccccccccaggtggccgtggccgccggcacccccaacaccagcggcagcatccacgagaacccccccaaggccaaggccaccgtgaacgtgaagcaggccgccaaggtggtgaaggccagcagccccagctacctggccgagggcaagatcagatgcctggcccagccccaccccggcaccggcgtgcccagagccgccgccgagctgcccctggaggccgagaagatcaagaccggcacccagaagcaggccaagaccgacatggccttcaagaccagcgtggccgtggagatggccggcgcccccagctggaccaaggtggccgaggagggcgacaagcccccccacgtgtacgtgcccgtggacatggccgtgaccctgcccagaggccagctggccgcccccctgaccaacgccagcagccagagacaccccccctgcctgagccagagacccctggccgcccccctgaccaaggccagcagccagggccacctgcccaccgagctgaccaagacccccagcctggcccacctggacacctgcctgagcaagatgcacagccagacccacctggccaccggcgccgtgaaggtgcagagccaggcccccctggccacctgcctgaccaagacccagagcagaggccagcccatcaccgacatcaccacctgcctgatccccgcccaccaggccgccgacctgagcagcaacacccacagccaggtgctgctgaccggcagcaaggtgagcaaccacgcctgccagagactgggcggcctgagcgcccccccctgggccaagcccgaggacagacagacccagccccagccccacggccacgtgcccggcaagaccacccagggcggcccctgccccgccgcctgcgaggtgcagggcatgctggtgccccccatggcccccaccggccacagcacctgcaacgtggagagctggggcgacaacggcgccaccagagcccagcccagcatgcccggccaggccgtgccctgccaggaggacaccggccccgccgacgccggcgtggtgggcggccagagctggaacagagcctgggagcccgccagaggcgccgccagctgggacacctggagaaacaaggccgtggtgccccccagaagaagcggcgagcccatggtgagcatgcaggccgccgaggagatcagaatcctggccgtgatcaccatccaggccggcgtgagaggctacctggccagaagaagaatcagactgtggcacagaggcgccatggtgatccaggccacctggagaggctacagagtgagaagaaacctggcccacctgtgcagagccaccaccaccatccagagcgcctggagaggctacagcaccagaagagaccaggccagacactggcagatgctgcaccccgtgacctgggtggagctgggcagcagagccggcgtgatgagcgacagaagctggttccaggacggcagagccagaaccgtgagcgaccacagatgcttccagagctgccaggcccacgcctgcagcgtgtgccacagcctgagcagcagaatcggcagcccccccagcgtggtgatgctggtgggcagcagccccagaacctgccacacctgcggcagaacccagcccaccagagtggtgcagggcatgggccagggcaccgagggccccggcgccgtgagctgggccagcgcctaccagctggccgccctgagccccagacagccccacagacaggacaaggccgccaccgccatccagagcgcctggagaggcttcaagatcagacagcagatgagacagcagcagatggccgccaagatcgtgcaggccacctggagaggccaccacaccagaagctgcctgaagaacaccgaggccctgctgggccccgccgaccccagcgccagcagcagacacatgcactggcccggcatctag

SEQ ID NO: 18942 - DNA, 5406 bp, Artificial Sequence
  Description of Artificial Sequence: Synthetic coding sequence
atgagcgacgacatcagaaagagattcgagttccccaacagcctgatccagagccaggccgtgggccacctgatcgccgccgtgctgaaggagaacggcttcagcgagaagatccaccagagcaccaaccagacccccgccctgaacctgctgtgggagaagtgctgcagcgacaacgtggtggtgagaaccgcctgctgcgagggcctggtggccctggtggcccaggaccacgccgagttcagctacgtgctgaacggcatcctgaacctgatccccagcaccagaaacacccacggcctgatcaaggccatcatgcacctgctgcagatgcaggccctgaaggagggccagggcggcgagaagaacatccagagcatctacaccatcagaaaccacccccaccccctgatcaccgtgctggagcacagacccgactgctggcccgtgttcctgcagcagctgaccgccttcttccagcagtgccccgagagactggaggtgagctgcatccagatcatggcccccttcctgtggtacctgtactgcgagcccagccagctgcaggagtacgccaagctgagactggccctgctgaaggtgctgctgcagccccaggtgctgtgcgacaaggaccagcccagcatcctggagcagcagatcctgcagctgtgctgcgacatcgtgccctgcctgcaggtgaaggacctgatccagaccaccgaggccatgatgttcatcgaggaggtgtgcctgagcctgctgagacaccccgtgttctggaagatccagctgacccagatgagcctgcagctgctgtgcgtgagcgaggtgagcctgaagatcaccggcgagtgcagcagcagcatccacctgctggagcacagcgtggagctgctgaaggaggacttccccgtggagctggtgatcatcggcatcgccctgctgctgctgcagacccccgccagccagcagaagcccatcctgaacctggccctgaagctgctgagcgtgaccgaggaccagaagatccccaagagcagcctgctgctggtgatgcccatcctgcagatcctgagcagcaccgccctggaggactgcatcagcgtggacgaggagggccccagcagacagcagctggccctgaacctgctggagatgatccagcaggagtgctacagagacgaccaccagaagctgagctacaagctggtgtgccccgtgaccagcatgtacggcaccatcttcaccgcctggagaatcctggaggtgatgaccgacagcagcgccgccagcgactggctggccagcgtggagagcctgctgcccatcaccgccgtgatccccgcccccgccttcctgctgctggcccacctgctggtggaggacaagggccagaacctgcaccagatcctgaaggtgaccaccgagctggcccaggccgacagcagccaggtgcccaacctgatccccgtgctgatgttcaagctgggcagacccctggagcccatcctgtacaacgacatcctgtacaccctgcccaagctgggcgtgcacaaggtgtgcatcggccagatcctgagaatcatccagctgctgggcaccacccccagactgagagccgtgaccctgagactgctgaccagcctgtgggagaagcaggacagagtgtaccccgagctgcagagattcatggccgtgagcgacgtgcccagcctgagcgtgggcaaggaggtgcagtgggagaagctgatcgccaaggccgccagcatcagagacatctgcaagcagagaccctaccagcacggcgccgacatgctggccgccatcagccaggtgctgaacgagtgcaccaagcccgaccaggccacccccgccgccctggtgctgcagggcctgcacgccctgtgccaggccgaggtggtgtgcatcagaagcacctggaacgccctgagccccaagctgagctgcgacaccagacccctgatcctgaagaccctgagcgagctgttcagcctggtgcccagcctgaccgtgaacaccaccgagtacgagaacttcaaggtgcaggtgctgagcttcctgtggacccacacccagaacaaggaccccatcgtggccaacgccgcctacagaagcctggccaacttcaccgccggcgagcacaccatcctgcacctgcccgagaagatcagacccgagatccccatccccgaggagctggacgacgacgaggacgtggaggacgtggacctgagcgtgcccggcagctgctacctgaagctgctgagcctgaccccccccctggtgctgcccgccctggaggagttcttcaccagcctggtgaagcaggagatggtgaacatgcccagaggcatctaccacagcgccctgaagggcggcgccagaagcgaccagggcaagaccgtggccggcatccccaacttcatcctgaagatgtacgagaccaacaagcagcccggcctgaagcccggcctggccggcggcatgctgttctgctacgacgtgagcatgtaccagagcaaggacggcaagcccctgaacagactgatggccagcagaggcagaagcttcaagcagaccagcctggccctggtgcacgaggtgcacatccagctgagcgagtggcacagagccatcttcctgccccaggcctggctggcctacatgaacagagcctaccacgccatcctgcagggcagactgggcgagctggagctgcagctgaagcacggcaaggaggagcccgaggaggtgcagtacaagaagagcaccgcctggctgtgggtgagagacatgctgaccgacgagatcaccaaggccgccgccaaggagagccccgtggtgaagggcaacgccctgctggccctgagcagcctggccgtggtggtgagcagacacgaggccagcctgagcagcgacagcgacggcctgctggaggtgcagcccaacttcctgagcatgaaggagtgggtgagcatggtgctggacaccctgctggtgatcgtggacagccactaccagcccagaggccagctgctgagctggttctactacaagagctacagcggcgagaacaccgccagcgccatcgccagaagcgccgccgccaccgccctgagcctgctggtgcccgtgttcatcatcagctgcaaggagaaggtggaggagatcctgaacatgctgaccgccagactgcccggcaagcccagcgccgacgagagccaggccgtgcagatccacatgggcctggccctgggcatgttcctgagcagactgtgcgaggagaagctgagcgacatcagcggccaggagatgaacctgctgctgatgaagagcctggacgccctggagaactgctgcttcgacaccagcctggagtacaacaccggctgcatcctgggcgtgggcctggtgctgagcctgatgagccacagcagccagatgcagagcagagtgcacgtggccgccctgctgagaaagctgagcgcccacgtggacgacagcggcagccagagcagaaccttccaggaggtgctggcctacaccctgagctgcgtgtgcaccagcgccttcagcgccggcatcatcgaggccaccgaggccgaggacgtgatgaacaagctgagactgctggtggagaacagccagcagaccagcggcttcgccctggccctgggcaacatcgtgcacggcctgagcgtgtgcggccacggcaaggccgaggacctgggcagcaagctgctgcccgcctggatcagaatcgtgctgaccgagggcacccccaccatgctgtgcctggccgccctgcacggcatggtggccctggtgggcagcgagggcgacgtgatgcagctgaagagcgaggccatccagaccagccacttccagggcagactgaacgaggtgatcagaaccctgacccaggtgatcagcgtgagcggcgtgatcggcctgcagagcaacgccgtgtggctgctgggccacctgcacctgagcaccctgagcagcagccagagcagagccagcgtgcccaccgactacagctacctgcccgagagcagcttcatcggcgccgccatcggcttcttcatcaccggcggcaagaagggccccgagagcgtgccccccagcctgctgaaggtggtgatgaagcccatcgccaccgtgggcgagagctaccagtacccccccgtgaactgggccgccctgctgagccccctgatgagactgaacttcggcgaggagatccagcagctgtgcctggagatcatggtgacccaggcccagagcagccagaacgccgccgccctgctgggcctgtgggtgaccccccccctgatccacagcctgagcctgaacaccaagagatacctgctgatcagcgcccccctgtggatcaagcacatcagcgacgagcagatcctgggcttcgtggagaacctgatggtggccgtgttcaaggccgccagccccctgggcagccccgagctgtgccccagcgccctgcacggcctgagccaggccatgaagctgcccagccccgcccaccacctgtggagcctgctgagcgaggccaccggcaagatcttcgacctgctgcccaacaagatcagaagaaaggacctggagctgtacatcagcatcgccaagtgcctgctggagatgaccgacgacgacgccaacagaatcgcccaggtgaccaagagcaacatcgagaaggccgccttcgtgaagctgtacctggtgagccagggcagattccccctggtgaacctgaccgacatgctgagcgtggccgtgcagcacagagagaaggaggtgctggcctggatgatcctgcacagcctgtaccaggccagaatcgtgagccacgccaacaccggcgtgctgaagagaatggagtggctgctggagctgatgggctacatcagaaacgtggcctaccagagcaccagcttccacaacaccgccctggacaaggccctggacttcttcctgctgatcttcgccaccgccgtggtggcctgggccgaccacaccgcccccctgctgctgggcctgagcgccagctggctgccctggcaccaggagaacggccccgccggccccgtgcccagcttcctgggcagaagccccatgcacagagtgaccctgcaggaggtgctgaccctgctgcccaacagcatggccctgctgctgcagaaggagccctggaaggagcagacccagaagttcatcgactggctgttcagcatcatggagagccccaaggaggccctgagcgcccagagcagagacctgctgaaggccaccctgctgagcctgagagtgctgcccgagttcaagaagaaggccgtgtggaccagagcctacggctggtag

SEQ ID NO: 18943 - DNA, 5406 bp, Artificial Sequence; identical to SEQ ID NO: 18942
  Description of Artificial Sequence: Synthetic coding sequence

SEQ ID NO: 18944 - DNA, 1557 bp, Artificial Sequence
  Description of Artificial Sequence: Synthetic coding sequence
atgctgtgcgccagcttcctgggcctgggcctgagcgtggccatcgtgggccccaccttccaggacctggccaccaacgtgaacagaaacatcagcagcctgagcttcatcttcgtgggcagagccctgggctacctgagcggcagcgtgatcggcggcttcctggtggacgtgatgaactacttcctgctgctgggcatcagcatgagcgccaccaccgtgggcctgtacctggtgcccttctgcaagaccgccatcctgctgaccgtgatgatgagcatcttcggcgtgagcatcggcatcctggacaccggcggcaacgtgctgatcctggccatctggggcgacaagggcgccccccacatgcaggccctgcacttcagcttcgccctgggcgccttcctggcccccctgctggccaagctggccctgggccccaccgccagcgccgagaaccacaccgagagcgacttccaccccgccctgaaccagagcagcgacgccgacagcgaggccctgttcggcgtgcccaacgacaagaacctgctgtgggcctacgccgtgatcggcacctacatgttcctggtgagcgtgatcttcttctgcctgttcctgaagaacagcagcaagcaggagaaggccagagccagcgccgagaccttcagaagagccaagtaccacaacgccctgctgtgcctgctgttcctgttcttcttcttctacgtgggcgccgaggtgacctacggcagctacgtgttcagcttcgccaccacccacgccggcatgaaggagagcgaggccgccggcctgaacagcatcttctggggcaccttcgccgcctgcagaggcctggccatcttcttcgccacctgcctgcagcccggcaccatgatcgtgctgagcaacatcggcagcctgaccagcagcctgttcctggtgctgttcgacaagaaccccatctgcctgtggatcgccaccagcgtgtacggcgccagcatggccaccaccttccccagcggcgtgagctggatcgagcagtacaccaccatccacggcaagagcgccgccttcttcgtgatcggcgccagcctgggcgagatggccatccccgccgtgatcggcatcctgcagggcaagtaccccgacctgcccgtggtgctgtacaccagcctgggcgccagcatcgccaccggcatcctgttccccgtgctgtacaagctggccaccagccccctggacagacagagaaaggaggacagaaagagcgaggaccagaaggccctgctgagcagcagcggcctgaacgagtacgaggaggagaacgaggaggaggacgccgagaagtggaacgagatggacttcgagatgatcgagaccaacgacaccatgagacacagcatcatcgagaccagcagaagcagcctgaccgagcccaccgccgaggtgtacaaccagtaccccagcaacgccctggtgttcgagagcagccccttcaacaccggcagcgcccacgtgaagcacctgcccgagaccagaaccaagggcaccaacgtgtag

SEQ ID NO: 18945 - DNA, 1905 bp, Artificial Sequence
  Description of Artificial Sequence: Synthetic coding sequence
atgtggctgcagcagagactgaagggcctgcccggcctgctgagcagcagctgggccagaagactgctgtgcctgctgggcctgctgctgctgctgctgtggttcggcggcagcggcgccagaagagccgccggcggcctgcacctgctgccctggagcagaggcgagcccggcgccgccgagcccagcgcctgcctggaggccgccaccagagcctggagaggcctgagagagagaggcgaggtggtgcccctgggccccggcgtgcccgccctggtggccaacggcttcctggccctggacgtggccgccaacagactgtgggtgacccccggcgagagagagcccgccgtggcccccgacttcgtgcccttcgtgcagctgagacccctgagcgccctggccgaggccggcgaggccgtgctgctgctgagagagggcctgctgagaagagtgagatgcctgcagctgggcagccccggccccggccccgtggccgccggccccggccccgccagcgtgagcggcctggccgccggcagcggcagagactgcgtgctgctgcaggaggacttcctggcccacagaggcagaccccacgtgtacctgcagagaatccagctgaacaaccccaccgagagagtggccgccctgcagaccgtgggccccaccgccggccccgcccccaaggccttcaccagcaccctggagaaggtgggcgaccaccagttcctgctgtacagcggcagaagcccccccacccccaccggcctggtgcacctggtggtggtggccgccaagaagctggtgaacagactgcaggtggcccccaagacccagctggacgagaccgtgctgtgggtggtgcacgtgagcggccccatcaacccccaggtgctgaagagcaaggccgccaaggagctgaaggccctgcaggacctggccagaaaggagatgctggagctgctggacatgcccgccgccgagctgctgcaggaccaccagctgctgtgggcccagctgttcagccccggcgtggagatgaagaagatcaccgacacccacacccccagcggcctgaccgtgaacctgaccctgtactacatgctgagctgcagccccgcccccctgctgagccccagcctgagccacagagagagagaccagatggagagcaccctgaactacgaggaccactgcttcagcggccacgccaccatgcacgccgagaacctgtggcccggcagactgagcagcgtgcagcagatcctgcagctgagcgacctgtggagactgaccctgcagaagagaggctgcaagggcctggtgaaggtgggcgcccccggcatcctgcagggcatggtgctgagcttcggcggcctgcagttcaccgagaaccacctgcagttccaggccgaccccgacgtgctgcacaacagctacgccctgcacggcatcagatacaagaacgaccacatcaacctggccgtgctggccgacgccgagggcaagccctacctgcacgtgagcgtggagagcagaggccagcccgtgaagatctacgcctgcaaggccggctgcctggacgagcccgtggagctgaccagcgcccccaccggccacaccttcagcgtgatggtgacccagcccatcacccccctgctgtacatcagcaccgacctgacccacctgcaggacctgagacacaccctgcacctgaaggccatcctggcccacgacgagcacatggcccagcaggaccccggcctgcccttcctgttctggttcagcgtggccagcctgatcaccctgttccacctgttcctgttcaagctgatctacaacgagtactgcggccccggcgccaagcccctgttcagaagcaaggaggaccccagcgtgtag

SEQ ID NO: 18946 - DNA, 1233 bp, Artificial Sequence
  Description of Artificial Sequence: Synthetic coding sequence
atgagcctgatggtggtgagcatggcctgcgtgggcttcttcctgctggagggcccctggccccacgtgggcggccaggacaagcccttcctgagcgcctggcccggcaccgtggtgagcgagggccagcacgtgaccctgcagtgcagaagcagactgggcttcaacgagttcagcctgagcaaggaggacggcatgcccgtgcccgagctgtacaacagaatcttcagaaacagcttcctgatgggccccgtgacccccgcccacgccggcacctacagatgctgcagcagccacccccacagccccaccggctggagcgcccccagcaaccccgtggtgatcatggtgaccggcgtgcacagaaagcccagcctgctggcccaccccggccccctggtgaagagcggcgagaccgtgatcctgcagtgctggagcgacgtgagattcgagagattcctgctgcacagagagggcatcaccgaggaccccctgagactggtgggccagctgcacgacgccggcagccaggtgaactacagcatgggccccatgacccccgccctggccggcacctacagatgcttcggcagcgtgacccacctgccctacgagctgagcgcccccagcgaccccctggacatcgtggtggtgggcctgtacggcaagcccagcctgagcgcccagcccggccccaccgtgcaggccggcgagaacgtgaccctgagctgcagcagcagaagcctgttcgacatctaccacctgagcagagaggccgaggccggcgagctgagactgaccgccgtgctgagagtgaacggcaccttccaggccaacttccccctgggccccgtgacccacggcggcaactacagatgcttcggcagcttcagagccctgccccacgcctggagcgaccccagcgaccccctgcccgtgagcgtgaccggcaacagcagacacctgcacgtgctgatcggcaccagcgtggtgatcatccccttcgccatcctgctgttcttcctgctgcacagatggtgcgccaacaagaagaacgccgtggtgatggaccaggagcccgccggcaacagaaccgtgaacagagaggacagcgacgagcaggacccccaggaggtgacctacgcccagctgaaccactgcgtgttcacccagagaaagatcaccagacccagccagagacccaagaccccccccaccgacaccagcgtgtag

SEQ ID NO: 18947 - DNA, 624 bp, Artificial Sequence
  Description of Artificial Sequence: Synthetic coding sequence
atggagaacgaggacggctacatgaccctgagcttcaagaacagatgcaagagcaagcagaagagcaaggacttcagcctgtacccccagtactactgcctgctgctgatcttcggctgcatcgtgatcctgatcttcatcatgaccggcatcgacctgaagttctggcacaagaagatggacttcagccagaacgtgaacgtgagcagcctgagcggccacaactacctgtgccccaacgactggctgctgaacgagggcaagtgctactggttcagcaccagcttcaagacctggaaggagagccagagagactgcacccagctgcaggcccacctgctggtgatccagaacctggacgagctggagttcatccagaacagcctgaagcccggccacttcggctggatcggcctgtacgtgaccttccagggcaacctgtggatgtggatcgacgagcacttcctggtgcccgagctgttcagcgtgatcggccccaccgacgacagaagctgcgccgtgatcaccggcaactgggtgtacagcgaggactgcagcagcaccttcaagggcatctgccagagagacgccatcctgacccacaacggcaccagcggcgtgtag

SEQ ID NO: 18948 - DNA, 1230 bp, Artificial Sequence
  Description of Artificial Sequence: Synthetic coding sequence
atggaggagagctgggaggccgcccccggcggccaggccggcgccgagctgcccatggagcccgtgggcagcctggtgcccaccctggagcagccccaggtgcccgccaaggtgagacagcccgagggccccgagagcagccccagccccgccggcgccgtggagaaggccgccggcgccggcctggagcccagcagcaagaagaagccccccagccccagacccggcagccccagagtgccccccctgagcctgggctacggcgtgtgccccgagccccccagccccggccccgccctggtgaagctgcccagaaacggcgaggcccccggcgccgagcccgcccccagcgcctgggcccccatggagctgcaggtggacgtgagagtgaagcccgtgggcgccgccggcggcagcagcacccccagccccagacccagcaccagattcctgaaggtgcccgtgcccgagagccccgccttcagcagacacgccgaccccgcccaccagctgctgctgagagcccccagccagggcggcacctggggcagaagaagccccctggccgccgccagaaccgagagcggctgcgacgccgagggcagagccagccccgccgagggcagcgccggcagccccggcagccccacctgctgcagatgcaaggagctgggcctggagaaggaggacgccgccctgctgcccagagccggcctggacggcgacgagaagctgcccagagccgtgaccctgaccggcctgcccatgtacgtgaagagcctgtactgggccctggccttcatggccgtgctgctggccgtgagcggcgtggtgatcgtggtgctggccagcagagccggcgccagatgccagcagtgcccccccggctgggtgctgagcgaggagcactgctactacttcagcgccgaggcccaggcctgggaggccagccaggccttctgcagcgcctaccacgccaccctgcccctgctgagccacacccaggacttcctgggcagataccccgtgagcagacacagctgggtgggcgcctggagaggcccccagggctggcactggatcgacgaggcccccctgcccccccagctgctgcccgaggacggcgaggacaacctggacatcaactgcggcgccctggaggagggcaccctggtggccgccaactgcagcacccccagaccctgggtgtgcgccaagggcacccagtag

SEQ ID NO: 18949 - DNA, 945 bp, Artificial Sequence
  Description of Artificial Sequence: Synthetic coding sequence
atggaggagagctgggaggccgcccccggcggccaggccggcgccgagctgcccatggagcccgtgggcagcctggtgcccaccctggagcagccccaggtgcccgccaaggtgagacagcccgagggccccgagagcagccccagccccgccggcgccgtggagaaggccgccggcgccggcctggagcccagcagcaagaagaagccccccagccccagacccggcagccccagagtgccccccctgagcctgggctacggcgtgtgccccgagccccccagccccggccccgccctggtgaagctgcccagaaacggcgaggcccccggcgccgagcccgcccccagcgcctgggcccccatggagctgcaggtggacgtgagagtgaagcccgtgggcgccgccggcggcagcagcacccccagccccagacccagcaccagattcctgaaggtgcccgtgcccgagagccccgccttcagcagacacgccgaccccgcccaccagctgctgctgagagcccccagccagggcggcacctggggcagaagaagccccctggccgccgccagaaccgagagcggctgcgacgccgagggcagagccagccccgccgagggcagcgccggcagccccggcagccccacctgctgcagatgcaaggagctgggcctggagaaggaggacgccgccctgctgcccagagccggcctggacggcgacgagaagctgcccagagccgtgaccctgaccgacagcctgagaaccgccagaaccatctggatcagcaccgtgggcccctggagaaaggccagatggtggctgcagaccgccgccctgcaggaccccggcagcgtgcccagaggccccagcgacctgggcagcgcctggagcagcgcctgccaggccgacgccgccccccccaccggcgaggccagctag

SEQ ID NO: 18950 - DNA, 2274 bp, Artificial Sequence
  Description of Artificial Sequence: Synthetic coding sequence
atgctgagcctgctggtgtggatcctgaccctgagcgacaccttcagccagggcacccagaccagattcagccaggagcccgccgaccagaccgtggtggccggccagagagccgtgctgccctgcgtgctgctgaactacagcggcatcgtgcagtggaccaaggacggcctggccctgggcatgggccagggcctgaaggcctggcccagatacagagtggtgggcagcgccgacgccggccagtacaacctggagatcaccgacgccgagctgagcgacgacgccagctacgagtgccaggccaccgaggccgccctgagaagcagaagagccaagctgaccgtgctgatcccccccgaggacaccagaatcgacggcggccccgtgatcctgctgcaggccggcaccccccacaacctgacctgcagagccttcaacgccaagcccgccgccaccatcatctggttcagagacggcacccagcaggagggcgccgtggccagcaccgagctgctgaaggacggcaagagagagaccaccgtgagccagctgctgatcaaccccaccgacctggacatcggcagagtgttcacctgcagaagcatgaacgaggccatccccagcggcaaggagaccagcatcgagctggacgtgcaccacccccccaccgtgaccctgagcatcgagccccagaccgtgcaggagggcgagagagtggtgttcacctgccaggccaccgccaaccccgagatcctgggctacagatgggccaagggcggcttcctgatcgaggacgcccacgagagcagatacgagaccaacgtggactacagcttcttcaccgagcccgtgagctgcgaggtgcacaacaaggtgggcagcaccaacgtgagcaccctggtgaacgtgcacttcgcccccagaatcgtggtggaccccaagcccaccaccaccgacatcggcagcgacgtgaccctgacctgcgtgtgggtgggcaacccccccctgaccctgacctggaccaagaaggacagcaacatggtgctgagcaacagcaaccagctgctgctgaagagcgtgacccaggccgacgccggcacctacacctgcagagccatcgtgcccagaatcggcgtggccgagagagaggtgcccctgtacgtgaacggcccccccatcatcagcagcgaggccgtgcagtacgccgtgagaggcgacggcggcaaggtggagtgcttcatcggcagcacccccccccccgacagaatcgcctgggcctggaaggagaacttcctggaggtgggcaccctggagagatacaccgtggagagaaccaacagcggcagcggcgtgctgagcaccctgaccatcaacaacgtgatggaggccgacttccagacccactacaactgcaccgcctggaacagcttcggccccggcaccgccatcatccagctggaggagagagaggtgctgcccgtgggcatcatcgccggcgccaccatcggcgccagcatcctgctgatcttcttcttcatcgccctggtgttcttcctgtacagaagaagaaagggcagcagaaaggacgtgaccctgagaaagctggacatcaaggtggagaccgtgaacagagagcccctgaccatgcacagcgacagagaggacgacaccgccagcgtgagcaccgccaccagagtgatgaaggccatctacagcagcttcaaggacgacgtggacctgaagcaggacctgagatgcgacaccatcgacaccagagaggagtacgagatgaaggaccccaccaacggctactacaacgtgagagcccacgaggacagacccagcagcagagccgtgctgtacgccgactacagagcccccggccccgccagattcgacggcagacccagcagcagactgagccacagcagcggctacgcccagctgaacacctacagcagaggccccgccagcgactacggccccgagcccaccccccccggccccgccgcccccgccggcaccgacaccaccagccagctgagctacgagaactacgagaagttcaacagccaccccttccccggcgccgccggctaccccacctacagactgggctacccccaggccccccccagcggcctggagagaaccccctacgaggcctacgaccccatcggcaagtacgccaccgccaccagattcagctacaccagccagcacagcgactacggccagagattccagcagagaatgcagacccacgtgtag

SEQ ID NO: 18951 - DNA, 1782 bp, Artificial Sequence
  Description of Artificial Sequence: Synthetic coding sequence
atgggccagggcctgaaggcctggcccagatacagagtggtgggcagcgccgacgccggccagtacaacctggagatcaccgacgccgagctgagcgacgacgccagctacgagtgccaggccaccgaggccgccctgagaagcagaagagccaagctgaccgtgctgaacccccccaccgtgaccctgagcatcgagccccagaccgtgcaggagggcgagagagtggtgttcacctgccaggccaccgccaaccccgagatcctgggctacagatgggccaagggcggcttcctgatcgaggacgcccacgagagcagatacgagaccaacgtggactacagcttcttcaccgagcccgtgagctgcgaggtgcacaacaaggtgggcagcaccaacgtgagcaccctggtgaacgtgcacttcgcccccagaatcgtggtggaccccaagcccaccaccaccgacatcggcagcgacgtgaccctgacctgcgtgtgggtgggcaacccccccctgaccctgacctggaccaagaaggacagcaacatggtgctgagcaacagcaaccagctgctgctgaagagcgtgacccaggccgacgccggcacctacacctgcagagccatcgtgcccagaatcggcgtggccgagagagaggtgcccctgtacgtgaacggcccccccatcatcagcagcgaggccgtgcagtacgccgtgagaggcgacggcggcaaggtggagtgcttcatcggcagcacccccccccccgacagaatcgcctgggcctggaaggagaacttcctggaggtgggcaccctggagagatacaccgtggagagaaccaacagcggcagcggcgtgctgagcaccctgaccatcaacaacgtgatggaggccgacttccagacccactacaactgcaccgcctggaacagcttcggccccggcaccgccatcatccagctggaggagagagaggtgctgcccgtgggcatcatcgccggcgccaccatcggcgccagcatcctgctgatcttcttcttcatcgccctggtgttcttcctgtacagaagaagaaagggcagcagaaaggacgtgaccctgagaaagctggacatcaaggtggagaccgtgaacagagagcccctgaccatgcacagcgacagagaggacgacaccgccagcgtgagcaccgccaccagagtgatgaaggccatctacagcagcttcaaggacgacgtggacctgaagcaggacctgagatgcgacaccatcgacaccagagaggagtacgagatgaaggaccccaccaacggctactacaacgtgagagcccacgaggacagacccagcagcagagccgtgctgtacgccgactacagagcccccggccccgccagattcgacggcagacccagcagcagactgagccacagcagcggctacgcccagctgaacacctacagcagaggccccgccagcgactacggccccgagcccaccccccccggccccgccgcccccgccggcaccgacaccaccagccagctgagctacgagaactacgagaagttcaacagccaccccttccccggcgccgccggctaccccacctacagactgggctacccccaggccccccccagcggcctggagagaaccccctacgaggcctacgaccccatcggcaagtacgccaccgccaccagattcagctacaccagccagcacagcgactacggccagagattccagcagagaatgcagacccacgtgtag

SEQ ID NO: 18952 - DNA, 2322 bp, Artificial Sequence
  Description of Artificial Sequence: Synthetic coding sequence
atgctgagcctgctggtgtggatcctgaccctgagcgacaccttcagccagggcacccagaccagattcagccaggagcccgccgaccagaccgtggtggccggccagagagccgtgctgccctgcgtgctgctgaactacagcggcatcgtgcagtggaccaaggacggcctggccctgggcatgggccagggcctgaaggcctggcccagatacagagtggtgggcagcgccgacgccggccagtacaacctggagatcaccgacgccgagctgagcgacgacgccagctacgagtgccaggccaccgaggccgccctgagaagcagaagagccaagctgaccgtgctgatcccccccgaggacaccagaatcgacggcggccccgtgatcctgctgcaggccggcaccccccacaacctgacctgcagagccttcaacgccaagcccgccgccaccatcatctggttcagagacggcacccagcaggagggcgccgtggccagcaccgagctgctgaaggacggcaagagagagaccaccgtgagccagctgctgatcaaccccaccgacctggacatcggcagagtgttcacctgcagaagcatgaacgaggccatccccagcggcaaggagaccagcatcgagctggacgtgcaccacccccccaccgtgaccctgagcatcgagccccagaccgtgcaggagggcgagagagtggtgttcacctgccaggccaccgccaaccccgagatcctgggctacagatgggccaagggcggcttcctgatcgaggacgcccacgagagcagatacgagaccaacgtggactacagcttcttcaccgagcccgtgagctgcgaggtgcacaacaaggtgggcagcaccaacgtgagcaccctggtgaacgtgcacttcgcccccagaatcgtggtggaccccaagcccaccaccaccgacatcggcagcgacgtgaccctgacctgcgtgtgggtgggcaacccccccctgaccctgacctggaccaagaaggacagcaacatgggccccagaccccccggcagcccccccgaggccgccctgagcgcccaggtgctgagcaacagcaaccagctgctgctgaagagcgtgacccaggccgacgccggcacctacacctgcagagccatcgtgcccagaatcggcgtggccgagagagaggtgcccctgtacgtgaacggcccccccatcatcagcagcgaggccgtgcagtacgccgtgagaggcgacggcggcaaggtggagtgcttcatcggcagcacccccccccccgacagaatcgcctgggcctggaaggagaacttcctggaggtgggcaccctggagagatacaccgtggagagaaccaacagcggcagcggcgtgctgagcaccctgaccatcaacaacgtgatggaggccgacttccagacccactacaactgcaccgcctggaacagcttcggccccggcaccgccatcatccagctggaggagagagaggtgctgcccgtgggcatcatcgccggcgccaccatcggcgccagcatcctgctgatcttcttcttcatcgccctggtgttcttcctgtacagaagaagaaagggcagcagaaaggacgtgaccctgagaaagctggacatcaaggtggagaccgtgaacagagagcccctgaccatgcacagcgacagagaggacgacaccgccagcgtgagcaccgccaccagagtgatgaaggccatctacagcagcttcaaggacgacgtggacctgaagcaggacctgagatgcgacaccatcgacaccagagaggagtacgagatgaaggaccccaccaacggctactacaacgtgagagcccacgaggacagacccagcagcagagccgtgctgtacgccgactacagagcccccggccccgccagattcgacggcagacccagcagcagactgagccacagcagcggctacgcccagctgaacacctacagcagaggccccgccagcgactacggccccgagcccaccccccccggccccgccgcccccgccggcaccgacaccaccagccagctgagctacgagaactacgagaagttcaacagccaccccttccccggcgccgccggctaccccacctacagactgggctacccccaggccccccccagcggcctggagagaaccccctacgaggcctacgaccccatcggcaagtacgccaccgccaccagattcagctacaccagccagcacagcgactacggccagagattccagcagagaatgcagacccacgtgtag

SEQ ID NO: 18953 - DNA, 1965 bp, Artificial Sequence
  Description of Artificial Sequence: Synthetic coding sequence
atgctgagcctgctggtgtggatcctgaccctgagcgacaccttcagccagggcacccagaccagattcagccaggagcccgccgaccagaccgtggtggccggccagagagccgtgctgccctgcgtgctgctgaactacagcggcatcgtgcagtggaccaaggacggcctggccctgggcatgggccagggcctgaaggcctggcccagatacagagtggtgggcagcgccgacgccggccagtacaacctggagatcaccgacgccgagctgagcgacgacgccagctacgagtgccaggccaccgaggccgccctgagaagcagaagagccaagctgaccgtgctgaacccccccaccgtgaccctgagcatcgagccccagaccgtgcaggagggcgagagagtggtgttcacctgccaggccaccgccaaccccgagatcctgggctacagatgggccaagggcggcttcctgatcgaggacgcccacgagagcagatacgagaccaacgtggactacagcttcttcaccgagcccgtgagctgcgaggtgcacaacaaggtgggcagcaccaacgtgagcaccctggtgaacgtgcacttcgcccccagaatcgtggtggaccccaagcccaccaccaccgacatcggcagcgacgtgaccctgacctgcgtgtgggtgggcaacccccccctgaccctgacctggaccaagaaggacagcaacatggtgctgagcaacagcaaccagctgctgctgaagagcgtgacccaggccgacgccggcacctacacctgcagagccatcgtgcccagaatcggcgtggccgagagagaggtgcccctgtacgtgaacggcccccccatcatcagcagcgaggccgtgcagtacgccgtgagaggcgacggcggcaaggtggagtgcttcatcggcagcacccccccccccgacagaatcgcctgggcctggaaggagaacttcctggaggtgggcaccctggagagatacaccgtggagagaaccaacagcggcagcggcgtgctgagcaccctgaccatcaacaacgtgatggaggccgacttccagacccactacaactgcaccgcctggaacagcttcggccccggcaccgccatcatccagctggaggagagagaggtgctgcccgtgggcatcatcgccggcgccaccatcggcgccagcatcctgctgatcttcttcttcatcgccctggtgttcttcctgtacagaagaagaaagggcagcagaaaggacgtgaccctgagaaagctggacatcaaggtggagaccgtgaacagagagcccctgaccatgcacagcgacagagaggacgacaccgccagcgtgagcaccgccaccagagtgatgaaggccatctacagcagcttcaaggacgacgtggacctgaagcaggacctgagatgcgacaccatcgacaccagagaggagtacgagatgaaggaccccaccaacggctactacaacgtgagagcccacgaggacagacccagcagcagagccgtgctgtacgccgactacagagcccccggccccgccagattcgacggcagacccagcagcagactgagccacagcagcggctacgcccagctgaacacctacagcagaggccccgccagcgactacggccccgagcccaccccccccggccccgccgcccccgccggcaccgacaccaccagccagctgagctacgagaactacgagaagttcaacagccaccccttccccggcgccgccggctaccccacctacagactgggctacccccaggccccccccagcggcctggagagaaccccctacgaggcctacgaccccatcggcaagtacgccaccgccaccagattcagctacaccagccagcacagcgactacggccagagattccagcagagaatgcagacccacgtgtag

SEQ ID NO: 18954 - DNA, 1974 bp, Artificial Sequence
  Description of Artificial Sequence: Synthetic coding sequence
atgctgagcctgctggtgtggatcctgaccctgagcgacaccttcagccaggtgccccccgaggacaccagaatcgacggcggccccgtgatcctgctgcaggccggcaccccccacaacctgacctgcagagccttcaacgccaagcccgccgccaccatcatctggttcagagacggcacccagcaggagggcgccgtggccagcaccgagctgctgaaggacggcaagagagagaccaccgtgagccagctgctgatcaaccccaccgacctggacatcggcagagtgttcacctgcagaagcatgaacgaggccatccccagcggcaaggagaccagcatcgagctggacgtgcaccacccccccaccgtgaccctgagcatcgagccccagaccgtgcaggagggcgagagagtggtgttcacctgccaggccaccgccaaccccgagatcctgggctacagatgggccaagggcggcttcctgatcgaggacgcccacgagagcagatacgagaccaacgtggactacagcttcttcaccgagcccgtgagctgcgaggtgcacaacaaggtgggcagcaccaacgtgagcaccctggtgaacgtgcacttcgcccccagaatcgtggtggaccccaagcccaccaccaccgacatcggcagcgacgtgaccctgacctgcgtgtgggtgggcaacccccccctgaccctgacctggaccaagaaggacagcaacatggtgctgagcaacagcaaccagctgctgctgaagagcgtgacccaggccgacgccggcacctacacctgcagagccatcgtgcccagaatcggcgtggccgagagagaggtgcccctgtacgtgaacggcccccccatcatcagcagcgaggccgtgcagtacgccgtgagaggcgacggcggcaaggtggagtgcttcatcggcagcacccccccccccgacagaatcgcctgggcctggaaggagaacttcctggaggtgggcaccctggagagatacaccgtggagagaaccaacagcggcagcggcgtgctgagcaccctgaccatcaacaacgtgatggaggccgacttccagacccactacaactgcaccgcctggaacagcttcggccccggcaccgccatcatccagctggaggagagagaggtgctgcccgtgggcatcatcgccggcgccaccatcggcgccagcatcctgctgatcttcttcttcatcgccctggtgttcttcctgtacagaagaagaaagggcagcagaaaggacgtgaccctgagaaagctggacatcaaggtggagaccgtgaacagagagcccctgaccatgcacagcgacagagaggacgacaccgccagcgtgagcaccgccaccagagtgatgaaggccatctacagcagcttcaaggacgacgtggacctgaagcaggacctgagatgcgacaccatcgacaccagagaggagtacgagatgaaggaccccaccaacggctactacaacgtgagagcccacgaggacagacccagcagcagagccgtgctgtacgccgactacagagcccccggccccgccagattcgacggcagacccagcagcagactgagccacagcagcggctacgcccagctgaacacctacagcagaggccccgccagcgactacggccccgagcccaccccccccggccccgccgcccccgccggcaccgacaccaccagccagctgagctacgagaactacgagaagttcaacagccaccccttccccggcgccgccggctaccccacctacagactgggctacccccaggccccccccagcggcctggagagaaccccctacgaggcctacgaccccatcggcaagtacgccaccgccaccagattcagctacaccagccagcacagcgactacggccagagattccagcagagaatgcagacccacgtgtag

SEQ ID NO: 18955 - DNA, 5316 bp, Artificial Sequence
  Description of Artificial Sequence: Synthetic coding sequence
atgagcgtgctgatcagccagagcgtgatcaactacgtggaggaggagaacatccccgccctgaaggccctgctggagaagtgcaaggacgtggacgagagaaacgagtgcggccagacccccctgatgatcgccgccgagcagggcaacctggagatcgtgaaggagctgatcaagaacggcgccaactgcaacctggaggacctggacaactggaccgccctgatcagcgccagcaaggagggccacgtgcacatcgtggaggagctgctgaagtgcggcgtgaacctggagcacagagacatgggcggctggaccgccctgatgtgggcctgctacaagggcagaaccgacgtggtggagctgctgctgagccacggcgccaaccccagcgtgaccggcctgtacagcgtgtaccccatcatctgggccgccggcagaggccacgccgacatcgtgcacctgctgctgcagaacggcgccaaggtgaactgcagcgacaagtacggcaccacccccctggtgtgggccgccagaaagggccacctggagtgcgtgaagcacctgctggccatgggcgccgacgtggaccaggagggcgccaacagcatgaccgccctgatcgtggccgtgaagggcggctacacccagagcgtgaaggagatcctgaagagaaaccccaacgtgaacctgaccgacaaggacggcaacaccgccctgatgatcgccagcaaggagggccacaccgagatcgtgcaggacctgctggacgccggcacctacgtgaacatccccgacagaagcggcgacaccgtgctgatcggcgccgtgagaggcggccacgtggagatcgtgagagccctgctgcagaagtacgccgacatcgacatcagaggccaggacaacaagaccgccctgtactgggccgtggagaagggcaacgccaccatggtgagagacatcctgcagtgcaaccccgacaccgagatctgcaccaaggacggcgagacccccctgatcaaggccaccaagatgagaaacatcgaggtggtggagctgctgctggacaagggcgccaaggtgagcgccgtggacaagaagggcgacacccccctgcacatcgccatcagaggcagaagcagaaagctggccgagctgctgctgagaaaccccaaggacggcagactgctgtacagacccaacaaggccggcgagaccccctacaacatcgactgcagccaccagaagagcatcctgacccagatcttcggcgccagacacctgagccccaccgagaccgacggcgacatgctgggctacgacctgtacagcagcgccctggccgacatcctgagcgagcccaccatgcagccccccatctgcgtgggcctgtacgcccagtggggcagcggcaagagcttcctgctgaagaagctggaggacgagatgaagaccttcgccggccagcagatcgagcccctgttccagttcagctggctgatcgtgttcctgaccctgctgctgtgcggcggcctgggcctgctgttcgccttcaccgtgcaccccaacctgggcatcgccgtgagcctgagcttcctggccctgctgtacatcttcttcatcgtgatctacttcggcggcagaagagagggcgagagctggaactgggcctgggtgctgagcaccagactggccagacacatcggctacctggagctgctgctgaagctgatgttcgtgaacccccccgagctgcccgagcagaccaccaaggccctgcccgtgagattcctgttcaccgactacaacagactgagcagcgtgggcggcgagaccagcctggccgagatgatcgccaccctgagcgacgcctgcgagagagagttcggcttcctggccaccagactgttcagagtgttcaagaccgaggacacccagggcaagaagaagtggaagaagacctgctgcctgcccagcttcgtgatcttcctgttcatcatcggctgcatcatcagcggcatcaccctgctggccatcttcagagtggaccccaagcacctgaccgtgaacgccgtgctgatcagcatcgccagcgtggtgggcctggccttcgtgctgaactgcagaacctggtggcaggtgctggacagcctgctgaacagccagagaaagagactgcacaacgccgccagcaagctgcacaagctgaagagcgagggcttcatgaaggtgctgaagtgcgaggtggagctgatggccagaatggccaagaccatcgacagcttcacccagaaccagaccagactggtggtgatcatcgacggcctggacgcctgcgagcaggacaaggtgctgcagatgctggacaccgtgagagtgctgttcagcaagggccccttcatcgccatcttcgccagcgacccccacatcatcatcaaggccatcaaccagaacctgaacagcgtgctgagagacagcaacatcaacggccacgactacatgagaaacatcgtgcacctgcccgtgttcctgaacagcagaggcctgagcaacgccagaaagttcctggtgaccagcgccaccaacggcgacgtgccctgcagcgacaccaccggcatccaggaggacgccgacagaagagtgagccagaacagcctgggcgagatgaccaagctgggcagcaagaccgccctgaacagaagagacacctacagaagaagacagatgcagagaaccatcaccagacagatgagcttcgacctgaccaagctgctggtgaccgaggactggttcagcgacatcagcccccagaccatgagaagactgctgaacatcgtgagcgtgaccggcagactgctgagagccaaccagatcagcttcaactgggacagactggccagctggatcaacctgaccgagcagtggccctacagaaccagctggctgatcctgtacctggaggagaccgagggcatccccgaccagatgaccctgaagaccatctacgagagaatcagcaagaacatccccaccaccaaggacgtggagcccctgctggagatcgacggcgacatcagaaacttcgaggtgttcctgagcagcagaacccccgtgctggtggccagagacgtgaaggtgttcctgccctgcaccgtgaacctggaccccaagctgagagagatcatcgccgacgtgagagccgccagagagcagatcagcatcggcggcctggcctacccccccctgcccctgcacgagggcccccccagagcccccagcggctacagccagccccccagcgtgtgcagcagcaccagcttcaacggccccttcgccggcggcgtggtgagcccccagccccacagcagctactacagcggcatgaccggcccccagcaccccttctacaacagacccttcttcgccccctacctgtacacccccagatactaccccggcggcagccagcacctgatcagcagacccagcgtgaagaccagcctgcccagagaccagaacaacggcctggaggtgatcaaggaggacgccgccgagggcctgagcagccccaccgacagcagcagaggcagcggccccgcccccggccccgtggtgctgctgaacagcctgaacgtggacgccgtgtgcgagaagctgaagcagatcgagggcctggaccagagcatgctgccccagtactgcaccaccatcaagaaggccaacatcaacggcagagtgctggcccagtgcaacatcgacgagctgaagaaggagatgaacatgaacttcggcgactggcacctgttcagaagcaccgtgctggagatgagaaacgccgagagccacgtggtgcccgaggaccccagattcctgagcgagagcagcagcggccccgccccccacggcgagcccgccagaagagccagccacaacgagctgccccacaccgagctgagcagccagaccccctacaccctgaacttcagcttcgaggagctgaacaccctgggcctggacgagggcgcccccagacacagcaacctgagctggcagagccagaccagaagaacccccagcctgagcagcctgaacagccaggacagcagcatcgagatcagcaagctgaccgacaaggtgcaggccgagtacagagacgcctacagagagtacatcgcccagatgagccagctggagggcggccccggcagcaccaccatcagcggcagaagcagcccccacagcacctactacatgggccagagcagcagcggcggcagcatccacagcaacctggagcaggagaagggcaaggacagcgagcccaagcccgacgacggcagaaagagcttcctgatgaagagaggcgacgtgatcgactacagcagcagcggcgtgagcaccaacgacgccagccccctggaccccatcaccgaggaggacgagaagagcgaccagagcggcagcaagctgctgcccggcaagaagagcagcgagagaagcagcctgttccagaccgacctgaagctgaagggcagcggcctgagataccagaagctgcccagcgacgaggacgagagcggcaccgaggagagcgacaacacccccctgctgaaggacgacaaggacagaaaggccgagggcaaggtggagagagtgcccaagagccccgagcacagcgccgagcccatcagaaccttcatcaaggccaaggagtacctgagcgacgccctgctggacaagaaggacagcagcgacagcggcgtgagaagcagcgagagcagccccaaccacagcctgcacaacgaggtggccgacgacagccagctggagaaggccaacctgatcgagctggaggacgacagccacagcggcaagagaggcatcccccacagcctgagcggcctgcaggaccccatcatcgccagaatgagcatctgcagcgaggacaagaagagccccagcgagtgcagcctgatcgccagcagccccgaggagaactggcccgcctgccagaaggcctacaacctgaacagaacccccagcaccgtgaccctgaacaacaacagcgcccccgccaacagagccaaccagaacttcgacgagatggagggcatcagagagaccagccaggtgatcctgagacccagcagcagccccaaccccaccaccatccagaacgagaacctgaagagcatgacccacaagagaagccagagaagcagctacaccagactgagcaaggacccccccgagctgcacgccgccgccagcagcgagagcaccggcttcggcgaggagagagagagcatcctgtag

SEQ ID NO: 18956 - DNA, 3096 bp, Artificial Sequence
  Description of Artificial Sequence: Synthetic coding sequence
atgagcgtgctgatcagccagagcgtgatcaactacgtggaggaggagaacatccccgccctgaaggccctgctggagaagtgcaaggacgtggacgagagaaacgagtgcggccagacccccctgatgatcgccgccgagcagggcaacctggagatcgtgaaggagctgatcaagaacggcgccaactgcaacctggaggacctggacaactggaccgccctgatcagcgccagcaaggagggccacgtgcacatcgtggaggagctgctgaagtgcggcgtgaacctggagcacagagacatgggcggctggaccgccctgatgtgggcctgctacaagggcagaaccgacgtggtggagctgctgctgagccacggcgccaaccccagcgtgaccggcctgcagtacagcgtgtaccccatcatctgggccgccggcagaggccacgccgacatcgtgcacctgctgctgcagaacggcgccaaggtgaactgcagcgacaagtacggcaccacccccctggtgtgggccgccagaaagggccacctggagtgcgtgaagcacctgctggccatgggcgccgacgtggaccaggagggcgccaacagcatgaccgccctgatcgtggccgtgaagggcggctacacccagagcgtgaaggagatcctgaagagaaaccccaacgtgaacctgaccgacaaggacggcaacaccgccctgatgatcgccagcaaggagggccacaccgagatcgtgcaggacctgctggacgccggcacctacgtgaacatccccgacagaagcggcgacaccgtgctgatcggcgccgtgagaggcggccacgtggagatcgtgagagccctgctgcagaagtacgccgacatcgacatcagaggccaggacaacaagaccgccctgtactgggccgtggagaagggcaacgccaccatggtgagagacatcctgcagtgcaaccccgacaccgagatctgcaccaaggacggcgagacccccctgatcaaggccaccaagatgagaaacatcgaggtggtggagctgctgctggacaagggcgccaaggtgagcgccgtggacaagaagggcgacacccccctgcacatcgccatcagaggcagaagcagaaagctggccgagctgctgctgagaaaccccaaggacggcagactgctgtacagacccaacaaggccggcgagaccccctacaacatcgactgcagccaccagaagagcatcctgacccagatcttcggcgccagacacctgagccccaccgagaccgacggcgacatgctgggctacgacctgtacagcagcgccctggccgacatcctgagcgagcccaccatgcagccccccatctgcgtgggcctgtacgcccagtggggcagcggcaagagcttcctgctgaagaagctggaggacgagatgaagaccttcgccggccagcagatcgagcccctgttccagttcagctggctgatcgtgttcctgaccctgctgctgtgcggcggcctgggcctgctgttcgccttcaccgtgcaccccaacctgggcatcgccgtgagcctgagcttcctggccctgctgtacatcttcttcatcgtgatctacttcggcggcagaagagagggcgagagctggaactgggcctgggtgctgagcaccagactggccagacacatcggctacctggagctgctgctgaagctgatgttcgtgaacccccccgagctgcccgagcagaccaccaaggccctgcccgtgagattcctgttcaccgactacaacagactgagcagcgtgggcggcgagaccagcctggccgagatgatcgccaccctgagcgacgcctgcgagagagagttcggcttcctggccaccagactgttcagagtgttcaagaccgaggacacccagggcaagaagaagtggaagaagacctgctgcctgcccagcttcgtgatcttcctgttcatcatcggctgcatcatcagcggcatcaccctgctggccatcttcagagtggaccccaagcacctgaccgtgaacgccgtgctgatcagcatcgccagcgtggtgggcctggccttcgtgctgaactgcagaacctggtggcaggtgctggacagcctgctgaacagccagagaaagagactgcacaacgccgccagcaagctgcacaagctgaagagcgagggcttcatgaaggtgctgaagtgcgaggtggagctgatggccagaatggccaagaccatcgacagcttcacccagaaccagaccagactggtggtgatcatcgacggcctggacgcctgcgagcaggacaaggtgctgcagatgctggacaccgtgagagtgctgttcagcaagggccccttcatcgccatcttcgccagcgacccccacatcatcatcaaggccatcaaccagaacctgaacagcgtgctgagagacagcaacatcaacggccacgactacatgagaaacatcgtgcacctgcccgtgttcctgaacagcagaggcctgagcaacgccagaaagttcctggtgaccagcgccaccaacggcgacgtgccctgcagcgacaccaccggcatccaggaggacgccgacagaagagtgagccagaacagcctgggcgagatgaccaagctgggcagcaagaccgccctgaacagaagagacacctacagaagaagacagatgcagagaaccatcaccagacagatgagcttcgacctgaccaagctgctggtgaccgaggactggttcagcgacatcagcccccagaccatgagaagactgctgaacatcgtgagcgtgaccggcagactgctgagagccaaccagatcagcttcaactgggacagactggccagctggatcaacctgaccgagcagtggccctacagaaccagctggctgatcctgtacctggaggagaccgagggcatccccgaccagatgaccctgaagaccatctacgagagatgctgcggcgccgacagctgcgacagagacagaatcggcatcagcaagagcgtgctggtggccatgctgatggagagctag

SEQ ID NO: 18957 - DNA, 5019 bp, Artificial Sequence
  Description of Artificial Sequence: Synthetic coding sequence
atgatcgccgccgagcagggcaacctggagatcgtgaaggagctgatcaagaacggcgccaactgcaacctggaggacctggacaactggaccgccctgatcagcgccagcaaggagggccacgtgcacatcgtggaggagctgctgaagtgcggcgtgaacctggagcacagagacatgggcggctggaccgccctgatgtgggcctgctacaagggcagaaccgacgtggtggagctgctgctgagccacggcgccaaccccagcgtgaccggcctgtacagcgtgtaccccatcatctgggccgccggcagaggccacgccgacatcgtgcacctgctgctgcagaacggcgccaaggtgaactgcagcgacaagtacggcaccacccccctggtgtgggccgccagaaagggccacctggagtgcgtgaagcacctgctggccatgggcgccgacgtggaccaggagggcgccaacagcatgaccgccctgatcgtggccgtgaagggcggctacacccagagcgtgaaggagatcctgaagagaaaccccaacgtgaacctgaccgacaaggacggcaacaccgccctgatgatcgccagcaaggagggccacaccgagatcgtgcaggacctgctggacgccggcacctacgtgaacatccccgacagaagcggcgacaccgtgctgatcggcgccgtgagaggcggccacgtggagatcgtgagagccctgctgcagaagtacgccgacatcgacatcagaggccaggacaacaagaccgccctgtactgggccgtggagaagggcaacgccaccatggtgagagacatcctgcagtgcaaccccgacaccgagatctgcaccaaggacggcgagacccccctgatcaaggccaccaagatgagaaacatcgaggtggtggagctgctgctggacaagggcgccaaggtgagcgccgtggacaagaagggcgacacccccctgcacatcgccatcagaggcagaagcagaaagctggccgagctgctgctgagaaaccccaaggacggcagactgctgtacagacccaacaaggccggcgagaccccctacaacatcgactgcagccaccagaagagcatcctgacccagatcttcggcgccagacacctgagccccaccgagaccgacggcgacatgctgggctacgacctgtacagcagcgccctggccgacatcctgagcgagcccaccatgcagccccccatctgcgtgggcctgtacgcccagtggggcagcggcaagagcttcctgctgaagaagctggaggacgagatgaagaccttcgccggccagcagatcgagcccctgttccagttcagctggctgatcgtgttcctgaccctgctgctgtgcggcggcctgggcctgctgttcgccttcaccgtgcaccccaacctgggcatcgccgtgagcctgagcttcctggccctgctgtacatcttcttcatcgtgatctacttcggcggcagaagagagggcgagagctggaactgggcctgggtgctgagcaccagactggccagacacatcggctacctggagctgctgctgaagctgatgttcgtgaacccccccgagctgcccgagcagaccaccaaggccctgcccgtgagattcctgttcaccgactacaacagactgagcagcgtgggcggcgagaccagcctggccgagatgatcgccaccctgagcgacgcctgcgagagagagttcggcttcctggccaccagactgttcagagtgttcaagaccgaggacacccagggcaagaagaagtggaagaagacctgctgcctgcccagcttcgtgatcttcctgttcatcatcggctgcatcatcagcggcatcaccctgctggccatcttcagagtggaccccaagcacctgaccgtgaacgccgtgctgatcagcatcgccagcgtggtgggcctggccttcgtgctgaactgcagaacctggtggcaggtgctggacagcctgctgaacagccagagaaagagactgcacaacgccgccagcaagctgcacaagctgaagagcgagggcttcatgaaggtgctgaagtgcgaggtggagctgatggccagaatggccaagaccatcgacagcttcacccagaaccagaccagactggtggtgatcatcgacggcctggacgcctgcgagcaggacaaggtgctgcagatgctggacaccgtgagagtgctgttcagcaagggccccttcatcgccatcttcgccagcgacccccacatcatcatcaaggccatcaaccagaacctgaacagcgtgctgagagacagcaacatcaacggccacgactacatgagaaacatcgtgcacctgcccgtgttcctgaacagcagaggcctgagcaacgccagaaagttcctggtgaccagcgccaccaacggcgacgtgccctgcagcgacaccaccggcatccaggaggacgccgacagaagagtgagccagaacagcctgggcgagatgaccaagctgggcagcaagaccgccctgaacagaagagacacctacagaagaagacagatgcagagaaccatcaccagacagatgagcttcgacctgaccaagctgctggtgaccgaggactggttcagcgacatcagcccccagaccatgagaagactgctgaacatcgtgagcgtgaccggcagactgctgagagccaaccagatcagcttcaactgggacagactggccagctggatcaacctgaccgagcagtggccctacagaaccagctggctgatcctgtacctggaggagaccgagggcatccccgaccagatgaccctgaagaccatctacgagagaatcagcaagaacatccccaccaccaaggacgtggagcccctgctggagatcgacggcgacatcagaaacttcgaggtgttcctgagcagcagaacccccgtgctggtggccagagacgtgaaggtgttcctgccctgcaccgtgaacctggaccccaagctgagagagatcatcgccgacgtgagagccgccagagagcagatcagcatcggcggcctggcctacccccccctgcccctgcacgagggcccccccagagcccccagcggctacagccagccccccagcgtgtgcagcagcaccagcttcaacggccccttcgccggcggcgtggtgagcccccagccccacagcagctactacagcggcatgaccggcccccagcaccccttctacaacagaggcagcggccccgcccccggccccgtggtgctgctgaacagcctgaacgtggacgccgtgtgcgagaagctgaagcagatcgagggcctggaccagagcatgctgccccagtactgcaccaccatcaagaaggccaacatcaacggcagagtgctggcccagtgcaacatcgacgagctgaagaaggagatgaacatgaacttcggcgactggcacctgttcagaagcaccgtgctggagatgagaaacgccgagagccacgtggtgcccgaggaccccagattcctgagcgagagcagcagcggccccgccccccacggcgagcccgccagaagagccagccacaacgagctgccccacaccgagctgagcagccagaccccctacaccctgaacttcagcttcgaggagctgaacaccctgggcctggacgagggcgcccccagacacagcaacctgagctggcagagccagaccagaagaacccccagcctgagcagcctgaacagccaggacagcagcatcgagatcagcaagctgaccgacaaggtgcaggccgagtacagagacgcctacagagagtacatcgcccagatgagccagctggagggcggccccggcagcaccaccatcagcggcagaagcagcccccacagcacctactacatgggccagagcagcagcggcggcagcatccacagcaacctggagcaggagaagggcaaggacagcgagcccaagcccgacgacggcagaaagagcttcctgatgaagagaggcgacgtgatcgactacagcagcagcggcgtgagcaccaacgacgccagccccctggaccccatcaccgaggaggacgagaagagcgaccagagcggcagcaagctgctgcccggcaagaagagcagcgagagaagcagcctgttccagaccgacctgaagctgaagggcagcggcctgagataccagaagctgcccagcgacgaggacgagagcggcaccgaggagagcgacaacacccccctgctgaaggacgacaaggacagaaaggccgagggcaaggtggagagagtgcccaagagccccgagcacagcgccgagcccatcagaaccttcatcaaggccaaggagtacctgagcgacgccctgctggacaagaaggacagcagcgacagcggcgtgagaagcagcgagagcagccccaaccacagcctgcacaacgaggtggccgacgacagccagctggagaaggccaacctgatcgagctggaggacgacagccacagcggcaagagaggcatcccccacagcctgagcggcctgcaggaccccatcatcgccagaatgagcatctgcagcgaggacaagaagagccccagcgagtgcagcctgatcgccagcagccccgaggagaactggcccgcctgccagaaggcctacaacctgaacagaacccccagcaccgtgaccctgaacaacaacagcgcccccgccaacagagccaaccagaacttcgacgagatggagggcatcagagagaccagccaggtgatcctgagacccagcagcagccccaaccccaccaccatccagaacgagaacctgaagagcatgacccacaagagaagccagagaagcagctacaccagactgagcaaggacccccccgagctgcacgccgccgccagcagcgagagcaccggcttcggcgaggagagagagagcatcctgtag

SEQ ID NO: 18958 - DNA, 5259 bp, Artificial Sequence
  Description of Artificial Sequence: Synthetic coding sequence
atgagcgtgctgatcagccagagcgtgatcaactacgtggaggaggagaacatccccgccctgaaggccctgctggagaagtgcaaggacgtggacgagagaaacgagtgcggccagacccccctgatgatcgccgccgagcagggcaacctggagatcgtgaaggagctgatcaagaacggcgccaactgcaacctggaggacctggacaactggaccgccctgatcagcgccagcaaggagggccacgtgcacatcgtggaggagctgctgaagtgcggcgtgaacctggagcacagagacatgggcggctggaccgccctgatgtgggcctgctacaagggcagaaccgacgtggtggagctgctgctgagccacggcgccaaccccagcgtgaccggcctgtacagcgtgtaccccatcatctgggccgccggcagaggccacgccgacatcgtgcacctgctgctgcagaacggcgccaaggtgaactgcagcgacaagtacggcaccacccccctggtgtgggccgccagaaagggccacctggagtgcgtgaagcacctgctggccatgggcgccgacgtggaccaggagggcgccaacagcatgaccgccctgatcgtggccgtgaagggcggctacacccagagcgtgaaggagatcctgaagagaaaccccaacgtgaacctgaccgacaaggacggcaacaccgccctgatgatcgccagcaaggagggccacaccgagatcgtgcaggacctgctggacgccggcacctacgtgaacatccccgacagaagcggcgacaccgtgctgatcggcgccgtgagaggcggccacgtggagatcgtgagagccctgctgcagaagtacgccgacatcgacatcagaggccaggacaacaagaccgccctgtactgggccgtggagaagggcaacgccaccatggtgagagacatcctgcagtgcaaccccgacaccgagatctgcaccaaggacggcgagacccccctgatcaaggccaccaagatgagaaacatcgaggtggtggagctgctgctggacaagggcgccaaggtgagcgccgtggacaagaagggcgacacccccctgcacatcgccatcagaggcagaagcagaaagctggccgagctgctgctgagaaaccccaaggacggcagactgctgtacagacccaacaaggccggcgagaccccctacaacatcgactgcagccaccagaagagcatcctgacccagatcttcggcgccagacacctgagccccaccgagaccgacggcgacatgctgggctacgacctgtacagcagcgccctggccgacatcctgagcgagcccaccatgcagccccccatctgcgtgggcctgtacgcccagtggggcagcggcaagagcttcctgctgaagaagctggaggacgagatgaagaccttcgccggccagcagatcgagcccctgttccagttcagctggctgatcgtgttcctgaccctgctgctgtgcggcggcctgggcctgctgttcgccttcaccgtgcaccccaacctgggcatcgccgtgagcctgagcttcctggccctgctgtacatcttcttcatcgtgatctacttcggcggcagaagagagggcgagagctggaactgggcctgggtgctgagcaccagactggccagacacatcggctacctggagctgctgctgaagctgatgttcgtgaacccccccgagctgcccgagcagaccaccaaggccctgcccgtgagattcctgttcaccgactacaacagactgagcagcgtgggcggcgagaccagcctggccgagatgatcgccaccctgagcgacgcctgcgagagagagttcggcttcctggccaccagactgttcagagtgttcaagaccgaggacacccagggcaagaagaagtggaagaagacctgctgcctgcccagcttcgtgatcttcctgttcatcatcggctgcatcatcagcggcatcaccctgctggccatcttcagagtggaccccaagcacctgaccgtgaacgccgtgctgatcagcatcgccagcgtggtgggcctggccttcgtgctgaactgcagaacctggtggcaggtgctggacagcctgctgaacagccagagaaagagactgcacaacgccgccagcaagctgcacaagctgaagagcgagggcttcatgaaggtgctgaagtgcgaggtggagctgatggccagaatggccaagaccatcgacagcttcacccagaaccagaccagactggtggtgatcatcgacggcctggacgcctgcgagcaggacaaggtgctgcagatgctggacaccgtgagagtgctgttcagcaagggccccttcatcgccatcttcgccagcgacccccacatcatcatcaaggccatcaaccagaacctgaacagcgtgctgagagacagcaacatcaacggccacgactacatgagaaacatcgtgcacctgcccgtgttcctgaacagcagaggcctgagcaacgccagaaagttcctggtgaccagcgccaccaacggcgacgtgccctgcagcgacaccaccggcatccaggaggacgccgacagaagagtgagccagaacagcctgggcgagatgaccaagctgggcagcaagaccgccctgaacagaagagacacctacagaagaagacagatgcagagaaccatcaccagacagatgagcttcgacctgaccaagctgctggtgaccgaggactggttcagcgacatcagcccccagaccatgagaagactgctgaacatcgtgagcgtgaccggcagactgctgagagccaaccagatcagcttcaactgggacagactggccagctggatcaacctgaccgagcagtggccctacagaaccagctggctgatcctgtacctggaggagaccgagggcatccccgaccagatgaccctgaagaccatctacgagagaatcagcaagaacatccccaccaccaaggacgtggagcccctgctggagatcgacggcgacatcagaaacttcgaggtgttcctgagcagcagaacccccgtgctggtggccagagacgtgaaggtgttcctgccctgcaccgtgaacctggaccccaagctgagagagatcatcgccgacgtgagagccgccagagagcagatcagcatcggcggcctggcctacccccccctgcccctgcacgagggcccccccagagcccccagcggctacagccagccccccagcgtgtgcagcagcaccagcttcaacggccccttcgccggcggcgtggtgagcccccagccccacagcagctactacagcggcatgaccggcccccagcaccccttctacaacagacccttcttcgccccctacctgtacacccccagatactaccccggcggcagccagcacctgatcagcagacccagcgtgaagaccagcctgcccagagaccagaacaacggcctgggcagcggccccgcccccggccccgtggtgctgctgaacagcctgaacgtggacgccgtgtgcgagaagctgaagcagatcgagggcctggaccagagcatgctgccccagtactgcaccaccatcaagaaggccaacatcaacggcagagtgctggcccagtgcaacatcgacgagctgaagaaggagatgaacatgaacttcggcgactggcacctgttcagaagcaccgtgctggagatgagaaacgccgagagccacgtggtgcccgaggaccccagattcctgagcgagagcagcagcggccccgccccccacggcgagcccgccagaagagccagccacaacgagctgccccacaccgagctgagcagccagaccccctacaccctgaacttcagcttcgaggagctgaacaccctgggcctggacgagggcgcccccagacacagcaacctgagctggcagagccagaccagaagaacccccagcctgagcagcctgaacagccaggacagcagcatcgagatcagcaagctgaccgacaaggtgcaggccgagtacagagacgcctacagagagtacatcgcccagatgagccagctggagggcggccccggcagcaccaccatcagcggcagaagcagcccccacagcacctactacatgggccagagcagcagcggcggcagcatccacagcaacctggagcaggagaagggcaaggacagcgagcccaagcccgacgacggcagaaagagcttcctgatgaagagaggcgacgtgatcgactacagcagcagcggcgtgagcaccaacgacgccagccccctggaccccatcaccgaggaggacgagaagagcgaccagagcggcagcaagctgctgcccggcaagaagagcagcgagagaagcagcctgttccagaccgacctgaagctgaagggcagcggcctgagataccagaagctgcccagcgacgaggacgagagcggcaccgaggagagcgacaacacccccctgctgaaggacgacaaggacagaaaggccgagggcaaggtggagagagtgcccaagagccccgagcacagcgccgagcccatcagaaccttcatcaaggccaaggagtacctgagcgacgccctgctggacaagaaggacagcagcgacagcggcgtgagaagcagcgagagcagccccaaccacagcctgcacaacgaggtggccgacgacagccagctggagaaggccaacctgatcgagctggaggacgacagccacagcggcaagagaggcatcccccacagcctgagcggcctgcaggaccccatcatcgccagaatgagcatctgcagcgaggacaagaagagccccagcgagtgcagcctgatcgccagcagccccgaggagaactggcccgcctgccagaaggcctacaacctgaacagaacccccagcaccgtgaccctgaacaacaacagcgcccccgccaacagagccaaccagaacttcgacgagatggagggcatcagagagaccagccaggtgatcctgagacccagcagcagccccaaccccaccaccatccagaacgagaacctgaagagcatgacccacaagagaagccagagaagcagctacaccagactgagcaaggacccccccgagctgcacgccgccgccagcagcgagagcaccggcttcggcgaggagagagagagcatcctgtag

SEQ ID NO: 18959 - DNA, 5259 bp, Artificial Sequence; identical to SEQ ID NO: 18958
  Description of Artificial Sequence: Synthetic coding sequence

SEQ ID NO: 18960 - DNA, 2985 bp, Artificial Sequence
  Description of Artificial Sequence: Synthetic coding sequence
atggtgagagacatcctgcagtgcaaccccgacaccgagatctgcaccaaggacggcgagacccccctgatcaaggccaccaagatgagaaacatcgaggtggtggagctgctgctggacaagggcgccaaggtgagcgccgtggacaagaagggcgacacccccctgcacatcgccatcagaggcagaagcagaaagctggccgagctgctgctgagaaaccccaaggacggcagactgctgtacagacccaacaaggccggcgagaccccctacaacatcgactgcagccaccagaagagcatcctgacccagatcttcggcgccagacacctgagccccaccgagaccgacggcgacatgctgggctacgacctgtacagcagcgccctggccgacatcctgagcgagcccaccatgcagccccccatctgcgtgggcctgtacgcccagtggggcagcggcaagagcttcctgctgaagaagctggaggacgagatgaagaccttcgccggccagcagatcgagcccctgttccagttcagctggctgatcgtgttcctgaccctgctgctgtgcggcggcctgggcctgctgttcgccttcaccgtgcaccccaacctgggcatcgccgtgagcctgagcttcctggccctgctgtacatcttcttcatcgtgatctacttcggcggcagaagagagggcgagagctggaactgggcctgggtgctgagcaccagactggccagacacatcggctacctggagctgctgctgaagctgatgttcgtgaacccccccgagctgcccgagcagaccaccaaggccctgcccgtgagattcctgttcaccgactacaacagactgagcagcgtgggcggcgagaccagcctggccgagatgatcgccaccctgagcgacgcctgcgagagagagttcggcttcctggccaccagactgttcagagtgttcaagaccgaggacacccagggcaagaagaagtggaagaagacctgctgcctgcccagcttcgtgatcttcctgttcatcatcggctgcatcatcagcggcatcaccctgctggccatcttcagagtggaccccaagcacctgaccgtgaacgccgtgctgatcagcatcgccagcgtggtgggcctggccttcgtgctgaactgcagaacctggtggcaggtgctggacagcctgctgaacagccagagaaagagactgcacaacgccgccagcaagctgcacaagctgaagagcgagggcttcatgaaggtgctgaagtgcgaggtggagctgatggccagaatggccaagaccatcgacagcttcacccagaaccagaccagactggtggtgatcatcgacggcctggacgcctgcgagcaggacaaggtgctgcagatgctggacaccgtgagagtgctgttcagcaagggccccttcatcgccatcttcgccagcgacccccacatcatcatcaaggccatcaaccagaacctgaacagcgtgctgagagacagcaacatcaacggccacgactacatgagaaacatcgtgcacctgcccgtgttcctgaacagcagaggcctgagcaacgccagaaagttcctggtgaccagcgccaccaacggcgacgtgccctgcagcgacaccaccggcatccaggaggacgccgacagaagagtgagccagaacagcctgggcgagatgaccaagctgggcagcaagaccgccctgaacagaagagacacctacagaagaagacagatgcagagaaccatcaccagacagatgagcttcgacctgaccaagctgctggtgaccgaggactggttcagcgacatcagcccccagaccatgagaagactgctgaacatcgtgagcgtgaccggcagactgctgagagccaaccagatcagcttcaactgggacagactggccagctggatcaacctgaccgagcagtggccctacagaaccagctggctgatcctgtacctggaggagaccgagggcatccccgaccagatgaccctgaagaccatctacgagagaatcagcaagaacatccccaccaccaaggacgtggagcccctgctggagatcgacggcgacatcagaaacttcgaggtgttcctgagcagcagaacccccgtgctggtggccagagacgtgaaggtgttcctgccctgcaccgtgaacctggaccccaagctgagagagatcatcgccgacgtgagagccgccagagagcagatcagcatcggcggcctggcctacccccccctgcccctgcacgagggcccccccagagcccccagcggctacagccagccccccagcgtgtgcagcagcaccagcttcaacggccccttcgccggcggcgtggtgagcccccagccccacagcagctactacagcggcatgaccggcccccagcaccccttctacaacagaggcagcggccccgcccccggccccgtggtgctgctgaacagcctgaacgtggacgccgtgtgcgagaagctgaagcagatcgagggcctggaccagagcatgctgccccagtactgcaccaccatcaagaaggccaacatcaacggcagagtgctggcccagtgcaacatcgacgagctgaagaaggagatgaacatgaacttcggcgactggcacctgttcagaagcaccgtgctggagatgagaaacgccgagagccacgtggtgcccgaggaccccagattcctgagcgagagcagcagcggccccgccccccacggcgagcccgccagaagagccagccacaacgagctgccccacaccgagctgagcagccagaccccctacaccctgaacttcagcttcgaggagctgaacaccctgggcctggacgagggcgcccccagacacagcaacctgagctggcaggaggagaacgccggcctggagatcgacagcagcagcgaggaccccgactag

SEQ ID NO: 18961 - DNA, 3954 bp, Artificial Sequence
  Description of Artificial Sequence: Synthetic coding sequence
atggccagcgtgaaggtggccgtgagagtgagacccatgaacagaagagagaaggacctggaggccaagttcatcatccagatggagaagagcaagaccaccatcaccaacctgaagatccccgagggcggcaccggcgacagcggcagagagagaaccaagaccttcacctacgacttcagcttctacagcgccgacaccaagagccccgactacgtgagccaggagatggtgttcaagaccctgggcaccgacgtggtgaagagcgccttcgagggctacaacgcctgcgtgttcgcctacggccagaccggcagcggcaagagctacaccatgatgggcaacagcggcgacagcggcctgatccccagaatctgcgagggcctgttcagcagaatcaacgagaccaccagatgggacgaggccagcttcagaaccgaggtgagctacctggagatctacaacgagagagtgagagacctgctgagaagaaagagcagcaagaccttcaacctgagagtgagagagcaccccaaggagggcccctacgtggaggacctgagcaagcacctggtgcagaactacggcgacgtggaggagctgatggacgccggcaacatcaacagaaccaccgccgccaccggcatgaacgacgtgagcagcagaagccacgccatcttcaccatcaagttcacccaggccaagttcgacagcgagatgccctgcgagaccgtgagcaagatccacctggtggacctggccggcagcgagagagccgacgccaccggcgccaccggcgtgagactgaaggagggcggcaacatcaacaagagcctggtgaccctgggcaacgtgatcagcgccctggccgacctgagccaggacgccgccaacaccctggccaagaagaagcaggtgttcgtgccctacagagacagcgtgctgacctggctgctgaaggacagcctgggcggcaacagcaagaccatcatgatcgccaccatcagccccgccgacgtgaactacggcgagaccctgagcaccctgagatacgccaacagagccaagaacatcatcaacaagcccaccatcaacgaggacgccaacgtgaagctgatcagagagctgagagccgagatcgccagactgaagaccctgctggcccagggcaaccagatcgccctgctggacagccccaccgccctgagcatggaggagaagctgcagcagaacgaggccagagtgcaggagctgaccaaggagtggaccaacaagtggaacgagacccagaacatcctgaaggagcagaccctggccctgagaaaggagggcatcggcgtggtgctggacagcgagctgccccacctgatcggcatcgacgacgacctgctgagcaccggcatcatcctgtaccacctgaaggagggccagacctacgtgggcagagacgacgccagcaccgagcaggacatcgtgctgcacggcctggacctggagagcgagcactgcatcttcgagaacatcggcggcaccgtgaccctgatccccctgagcggcagccagtgcagcgtgaacggcgtgcagatcgtggaggccacccacctgaaccagggcgccgtgatcctgctgggcagaaccaacatgttcagattcaaccaccccaaggaggccgccaagctgagagagaagagaaagagcggcctgctgagcagcttcagcctgagcatgaccgacctgagcaagagcagagagaacctgagcgccgtgatgctgtacaaccccggcctggagttcgagagacagcagagagaggagctggagaagctggagagcaagagaaagctgatcgaggagatggaggagaagcagaagagcgacaaggccgagctggagagaatgcagcaggaggtggagacccagagaaaggagaccgagatcgtgcagctgcagatcagaaagcaggaggagagcctgaagagaagaagcttccacatcgagaacaagctgaaggacctgctggccgagaaggagaagttcgaggaggagagactgagagagcagcaggagatcgagctgcagaagaagagacaggaggaggagaccttcctgagagtgcaggaggagctgcagagactgaaggagctgaacaacaacgagaaggccgagaagttccagatcttccaggagctggaccagctgcagaaggagaaggacgagcagtacgccaagctggagctggagaagaagagactggaggagcaggagaaggagcaggtgatgctggtggcccacctggaggagcagctgagagagaagcaggagatgatccagctgctgagaagaggcgaggtgcagtgggtggaggaggagaagagagacctggagggcatcagagagagcctgctgagagtgaaggaggccagagccggcggcgacgaggacggcgaggagctggagaaggcccagctgagattcttcgagttcaagagaagacagctggtgaagctggtgaacctggagaaggacctggtgcagcagaaggacatcctgaagaaggaggtgcaggaggagcaggagatcctggagtgcctgaagtgcgagcacgacaaggagagcagactgctggagaagcacgacgagagcgtgaccgacgtgaccgaggtgccccaggacttcgagaagatcaagcccgtggagtacagactgcagtacaaggagagacagctgcagtacctgctgcagaaccacctgcccaccctgctggaggagaagcagagagccttcgagatcctggacagaggccccctgagcctggacaacaccctgtaccaggtggagaaggagatggaggagaaggaggagcagctggcccagtaccaggccaacgccaaccagctgcagaagctgcaggccaccttcgagttcaccgccaacatcgccagacaggaggagaaggtgagaaagaaggagaaggagatcctggagagcagagagaagcagcagagagaggccctggagagagccctggccagactggagagaagacacagcgccctgcagagacacagcaccctgggcatggagatcgaggagcagagacagaagctggccagcctgaacagcggcagcagagagcagagcggcctgcaggccagcctggaggccgagcaggaggccctggagaaggaccaggagagactggagtacgagatccagcagctgaagcagaagatctacgaggtggacggcgtgcagaaggaccaccacggcaccctggagggcaaggtggccagcagcagcctgcccgtgagcgccgagaagagccacctggtgcccctgatggacgccagaatcaacgcctacatcgaggaggaggtgcagagaagactgcaggacctgcacagagtgatcagcgagggctgcagcaccagcgccgacaccatgaaggacaacgagaagctgcacaacggcaccatccagagaaagctgaagtacgagagaatggtgagcagaagcctgggcgccaaccccgacgacctgaaggaccccatcaagatcagcatccccagatacgtgctgtgcggccagggcaaggacgcccacttcgagttcgaggtgaagatcaccgtgctggacgagacctggaccgtgttcagaagatacagcagattcagagagatgcacaagaccctgaagctgaagtacgccgagctggccgccctggagttcccccccaagaagctgttcggcaacaaggacgagagagtgatcgccgagagaagaagccacctggagaagtacctgagagacttcttcagcgtgatgctgcagagcgccaccagccccctgcacatcaacaaggtgggcctgaccctgagcaagcacaccatctgcgagttcagccccttcttcaagaagggcgtgttcgactacagcagccacggcaccggctag

SEQ ID NO: 18962 - DNA, 3864 bp, Artificial Sequence
  Description of Artificial Sequence: Synthetic coding sequence
atggccagcgtgaaggtggccgtgagagtgagacccatgaacagaagagagaaggacctggaggccaagttcatcatccagatggagaagagcaagaccaccatcaccaacctgaagatccccgagggcggcaccggcgacagcggcagagagagaaccaagaccttcacctacgacttcagcttctacagcgccgacaccaagagccccgactacgtgagccaggagatggtgttcaagaccctgggcaccgacgtggtgaagagcgccttcgagggctacaacgcctgcgtgttcgcctacggccagaccggcagcggcaagagctacaccatgatgggcaacagcggcgacagcggcctgatccccagaatctgcgagggcctgttcagcagaatcaacgagaccaccagatgggacgaggccagcttcagaaccgaggtgagctacctggagatctacaacgagagagtgagagacctgctgagaagaaagagcagcaagaccttcaacctgagagtgagagagcaccccaaggagggcccctacgtggaggacctgagcaagcacctggtgcagaactacggcgacgtggaggagctgatggacgccggcaacatcaacagaaccaccgccgccaccggcatgaacgacgtgagcagcagaagccacgccatcttcaccatcaagttcacccaggccaagttcgacagcgagatgccctgcgagaccgtgagcaagatccacctggtggacctggccggcagcgagagagccgacgccaccggcgccaccggcgtgagactgaaggagggcggcaacatcaacaagagcctggtgaccctgggcaacgtgatcagcgccctggccgacctgagccaggacgccgccaacaccctggccaagaagaagcaggtgttcgtgccctacagagacagcgtgctgacctggctgctgaaggacagcctgggcggcaacagcaagaccatcatgatcgccaccatcagccccgccgacgtgaactacggcgagaccctgagcaccctgagatacgccaacagagccaagaacatcatcaacaagcccaccatcaacgaggacgccaacgtgaagctgatcagagagctgagagccgagatcgccagactgaagaccctgctggcccagggcaaccagatcgccctgctggacagccccaccgccctgagcatggaggagaagctgcagcagaacgaggccagagtgcaggagctgaccaaggagtggaccaacaagtggaacgagacccagaacatcctgaaggagcagaccctggccctgagaaaggagggcatcggcgtggtgctggacagcgagctgccccacctgatcggcatcgacgacgacctgctgagcaccggcatcatcctgtaccacctgaaggagggccagacctacgtgggcagagacgacgccagcaccgagcaggacatcgtgctgcacggcctggacctggagagcgagcactgcatcttcgagaacatcggcggcaccgtgaccctgatccccctgagcggcagccagtgcagcgtgaacggcgtgcagatcgtggaggccacccacctgaaccagggcgccgtgatcctgctgggcagaaccaacatgttcagattcaaccaccccaaggaggccgccaagctgagagagaagagaaagagcggcctgctgagcagcttcagcctgagcatgaccgacctgagcaagagcagagagaacctgagcgccgtgatgctgtacaaccccggcctggagttcgagagacagcagagagaggagctggagaagctggagagcaagagaaagctgatcgaggagatggaggagaagcagaagagcgacaaggccgagctggagagaatgcagcaggaggtggagacccagagaaaggagaccgagatcgtgcagctgcagatcagaaagcaggaggagagcctgaagagaagaagcttccacatcgagaacaagctgaaggacctgctggccgagaaggagaagttcgaggaggagagactgagagagcagcaggagatcgagctgcagaagaagagacaggaggaggagaccttcctgagagtgcaggaggagctgcagagactgaaggagctgaacaacaacgagaaggccgagaagttccagatcttccaggagctggaccagctgcagaaggagaaggacgagcagtacgccaagctggagctggagaagaagagactggaggagcaggagaaggagcaggtgatgctggtggcccacctggaggagcagctgagagagaagcaggagatgatccagctgctgagaagaggcgaggtgcagtgggtggaggaggagaagagagacctggagggcatcagagagagcctgctgagagtgaaggaggccagagccggcggcgacgaggacggcgaggagctggagaaggcccagctgagattcttcgagttcaagagaagacagctggtgaagctggtgaacctggagaaggacctggtgcagcagaaggacatcctgaagaaggaggtgcaggaggagcaggagatcctggagtgcctgaagtgcgagcacgacaaggagagcagactgctggagaagcacgacgagagcgtgaccgacgtgaccgaggtgccccaggacttcgagaagatcaagcccgtggagtacagactgcagtacaaggagagacagctgcagtacctgctgcagaaccacctgcccaccctgctggaggagaagcagagagccttcgagatcctggacagaggccccctgagcctggacaacaccctgtaccaggtggagaaggagatggaggagaaggaggagcagctggcccagtaccaggccaacgccaaccagctgcagaagctgcaggccaccttcgagttcaccgccaacatcgccagacaggaggagaaggtgagaaagaaggagaaggagatcctggagagcagagagaagcagcagagagaggccctggagagagccctggccagactggagagaagacacagcgccctgcagagacacagcaccctgggcatggagatcgaggagcagagacagaagctggccagcctgaacagcggcagcagagagcagagcggcctgcaggccagcctggaggccgagcaggaggccctggagaaggaccaggagagactggagtacgagatccagcagctgaagcagaagatctacgaggtggacggcgtgcagaaggaccaccacggcaccctggagggcaaggtggccagcagcagcctgcccgtgagcgccgagaagagccacctggtgcccctgatggacgccagaatcaacgcctacatcgaggaggaggtgcagagaagactgcaggacctgcacagagtgatcagcgagggctgcagcaccagcgccgacaccatgaaggacaacgagaagctgcacaacggcaccatccagagaaagctgaagtacgagagaatggtgagcagaagcctgggcgccaaccccgacgacctgaaggaccccatcaagatcagcatccccagatacgtgctgtgcggccagggcaaggacgcccacttcgagttcgaggtgaagctggccgccctggagttcccccccaagaagctgttcggcaacaaggacgagagagtgatcgccgagagaagaagccacctggagaagtacctgagagacttcttcagcgtgatgctgcagagcgccaccagccccctgcacatcaacaaggtgggcctgaccctgagcaagcacaccatctgcgagttcagccccttcttcaagaagggcgtgttcgactacagcagccacggcaccggctag

SEQ ID NO: 18963 - DNA, 3486 bp, Artificial Sequence
  Description of Artificial Sequence: Synthetic coding sequence
atggccagcgtgaaggtggccgtgagagtgagacccatgaacagaagagagaaggacctggaggccaagttcatcatccagatggagaagagcaagaccaccatcaccaacctgaagatccccgagggcggcaccggcgacagcggcagagagagaaccaagaccttcacctacgacttcagcttctacagcgccgacaccaagagccccgactacgtgagccaggagatggtgttcaagaccctgggcaccgacgtggtgaagagcgccttcgagggctacaacgcctgcgtgttcgcctacggccagaccggcagcggcaagagctacaccatgatgggcaacagcggcgacagcggcctgatccccagaatctgcgagggcctgttcagcagaatcaacgagaccaccagatgggacgaggccagcttcagaaccgaggtgagctacctggagatctacaacgagagagtgagagacctgctgagaagaaagagcagcaagaccttcaacctgagagtgagagagcaccccaaggagggcccctacgtggaggacctgagcaagcacctggtgcagaactacggcgacgtggaggagctgatggacgccggcaacatcaacagaaccaccgccgccaccggcatgaacgacgtgagcagcagaagccacgccatcttcaccatcaagttcacccaggccaagttcgacagcgagatgccctgcgagaccgtgagcaagatccacctggtggacctggccggcagcgagagagccgacgccaccggcgccaccggcgtgagactgaaggagggcggcaacatcaacaagagcctggtgaccctgggcaacgtgatcagcgccctggccgacctgagccaggacgccgccaacaccctggccaagaagaagcaggtgttcgtgccctacagagacagcgtgctgacctggctgctgaaggacagcctgggcggcaacagcaagaccatcatgatcgccaccatcagccccgccgacgtgaactacggcgagaccctgagcaccctgagatacgccaacagagccaagaacatcatcaacaagcccaccatcaacgaggacgccaacgtgaagctgatcagagagctgagagccgagatcgccagactgaagaccctgctggcccagggcaaccagatcgccctgctggacagccccaccgccctgagcatggaggagaagctgcagcagaacgaggccagagtgcaggagctgaccaaggagtggaccaacaagtggaacgagacccagaacatcctgaaggagcagaccctggccctgagaaaggagggcatcggcgtggtgctggacagcgagctgccccacctgatcggcatcgacgacgacctgctgagcaccggcatcatcctgtaccacctgaaggagggccagacctacgtgggcagagacgacgccagcaccgagcaggacatcgtgctgcacggcctggacctggagagcgagcactgcatcttcgagaacatcggcggcaccgtgaccctgatccccctgagcggcagccagtgcagcgtgaacggcgtgcagatcgtggaggccacccacctgaaccagggcgccgtgatcctgctgggcagaaccaacatgttcagattcaaccaccccaaggaggccgccaagctgagagagaagagaaagagcggcctgctgagcagcttcagcctgagcatgaccgacctgagcaagagcagagagaacctgagcgccgtgatgctgtacaaccccggcctggagttcgagagacagcagagagaggagctggagaagctggagagcaagagaaagctgatcgaggagatggaggagaagcagaagagcgacaaggccgagctggagagaatgcagcaggaggtggagacccagagaaaggagaccgagatcgtgcagctgcagatcagaaagcaggaggagagcctgaagagaagaagcttccacatcgagaacaagctgaaggacctgctggccgagaaggagaagttcgaggaggagagactgaaggacctggtgcagcagaaggacatcctgaagaaggaggtgcaggaggagcaggagatcctggagtgcctgaagtgcgagcacgacaaggagagcagactgctggagaagcacgacgagagcgtgaccgacgtgaccgaggtgccccaggacttcgagaagatcaagcccgtggagtacagactgcagtacaaggagagacagctgcagtacctgctgcagaaccacctgcccaccctgctggaggagaagcagagagccttcgagatcctggacagaggccccctgagcctggacaacaccctgtaccaggtggagaaggagatggaggagaaggaggagcagctggcccagtaccaggccaacgccaaccagctgcagaagctgcaggccaccttcgagttcaccgccaacatcgccagacaggaggagaaggtgagaaagaaggagaaggagatcctggagagcagagagaagcagcagagagaggccctggagagagccctggccagactggagagaagacacagcgccctgcagagacacagcaccctgggcatggagatcgaggagcagagacagaagctggccagcctgaacagcggcagcagagagcagagcggcctgcaggccagcctggaggccgagcaggaggccctggagaaggaccaggagagactggagtacgagatccagcagctgaagcagaagatctacgaggtggacggcgtgcagaaggaccaccacggcaccctggagggcaaggtggccagcagcagcctgcccgtgagcgccgagaagagccacctggtgcccctgatggacgccagaatcaacgcctacatcgaggaggaggtgcagagaagactgcaggacctgcacagagtgatcagcgagggctgcagcaccagcgccgacaccatgaaggacaacgagaagctgcacaacggcaccatccagagaaagctgaagtacgagagaatggtgagcagaagcctgggcgccaaccccgacgacctgaaggaccccatcaagatcagcatccccagatacgtgctgtgcggccagggcaaggacgcccacttcgagttcgaggtgaagatcaccgtgctggacgagacctggaccgtgttcagaagatacagcagattcagagagatgcacaagaccctgaagctgaagtacgccgagctggccgccctggagttcccccccaagaagctgttcggcaacaaggacgagagagtgatcgccgagagaagaagccacctggagaagtacctgagagacttcttcagcgtgatgctgcagagcgccaccagccccctgcacatcaacaaggtgggcctgaccctgagcaagcacaccatctgcgagttcagccccttcttcaagaagggcgtgttcgactacagcagccacggcaccggctag

SEQ ID NO: 18964 - DNA, 1509 bp, Artificial Sequence
  Description of Artificial Sequence: Synthetic coding sequence
atgatccagctgctgagaagaggcgaggtgcagtgggtggaggaggagaagagagacctggagggcatcagagagagcctgctgagagtgaaggaggccagagccggcggcgacgaggacggcgaggagctggagaaggcccagctgagattcttcgagttcaagagaagacagctggtgaagctggtgaacctggagaaggacctggtgcagcagaaggacatcctgaagaaggaggtgcaggaggagcaggagatcctggagtgcctgaagtgcgagcacgacaaggagagcagactgctggagaagcacgacgagagcgtgaccgacgtgaccgaggtgccccaggacttcgagaagatcaagcccgtggagtacagactgcagtacaaggagagacagctgcagtacctgctgcagaaccacctgcccaccctgctggaggagaagcagagagccttcgagatcctggacagaggccccctgagcctggacaacaccctgtaccaggtggagaaggagatggaggagaaggaggagcagctggcccagtaccaggccaacgccaaccagctgcagaagctgcaggccaccttcgagttcaccgccaacatcgccagacaggaggagaaggtgagaaagaaggagaaggagatcctggagagcagagagaagcagcagagagaggccctggagagagccctggccagactggagagaagacacagcgccctgcagagacacagcaccctgggcatggagatcgaggagcagagacagaagctggccagcctgaacagcggcagcagagagcagagcggcctgcaggccagcctggaggccgagcaggaggccctggagaaggaccaggagagactggagtacgagatccagcagctgaagcagaagatctacgaggtggacggcgtgcagaaggaccaccacggcaccctggagggcaaggtggccagcagcagcctgcccgtgagcgccgagaagagccacctggtgcccctgatggacgccagaatcaacgcctacatcgaggaggaggtgcagagaagactgcaggacctgcacagagtgatcagcgagggctgcagcaccagcgccgacaccatgaaggacaacgagaagctgcacaacggcaccatccagagaaagctgaagtacgagatcaccgtgctggacgagacctggaccgtgttcagaagatacagcagattcagagagatgcacaagaccctgaagctgaagtacgccgagctggccgccctggagttcccccccaagaagctgttcggcaacaaggacgagagagtgatcgccgagagaagaagccacctggagaagtacctgagagacttcttcagcgtgatgctgcagagcgccaccagccccctgcacatcaacaaggtgggcctgaccctgagcaagcacaccatctgcgagttcagccccttcttcaagaagggcgtgttcgactacagcagccacggcaccggctag

SEQ ID NO: 18965 - DNA, 4179 bp, Artificial Sequence
  Description of Artificial Sequence: Synthetic coding sequence
atggccagcgtgaaggtggccgtgagagtgagacccatgaacagaagagagaaggacctggaggccaagttcatcatccagatggagaagagcaagaccaccatcaccaacctgaagatccccgagggcggcaccggcgacagcggcagagagagaaccaagaccttcacctacgacttcagcttctacagcgccgacaccaagagccccgactacgtgagccaggagatggtgttcaagaccctgggcaccgacgtggtgaagagcgccttcgagggctacaacgcctgcgtgttcgcctacggccagaccggcagcggcaagagctacaccatgatgggcaacagcggcgacagcggcctgatccccagaatctgcgagggcctgttcagcagaatcaacgagaccaccagatgggacgaggccagcttcagaaccgaggtgagctacctggagatctacaacgagagagtgagagacctgctgagaagaaagagcagcaagaccttcaacctgagagtgagagagcaccccaaggagggcccctacgtggaggacctgagcaagcacctggtgcagaactacggcgacgtggaggagctgatggacgccggcaacatcaacagaaccaccgccgccaccggcatgaacgacgtgagcagcagaagccacgccatcttcaccatcaagttcacccaggccaagttcgacagcgagatgccctgcgagaccgtgagcaagatccacctggtggacctggccggcagcgagagagccgacgccaccggcgccaccggcgtgagactgaaggagggcggcaacatcaacaagagcctggtgaccctgggcaacgtgatcagcgccctggccgacctgagccaggacgccgccaacaccctggccaagaagaagcaggtgttcgtgccctacagagacagcgtgctgacctggctgctgaaggacagcctgggcggcaacagcaagaccatcatgatcgccaccatcagccccgccgacgtgaactacggcgagaccctgagcaccctgagatacgccaacagagccaagaacatcatcaacaagcccaccatcaacgaggacgccaacgtgaagctgatcagagagctgagagccgagatcgccagactgaagaccctgctggcccagggcaaccagatcgccctgctggacagccccaccgccctgagcatggaggagaagctgcagcagaacgaggccagagtgcaggagctgaccaaggagtggaccaacaagtggaacgagacccagaacatcctgaaggagcagaccctggccctgagaaaggagggcatcggcgtggtgctggacagcgagctgccccacctgatcggcatcgacgacgacctgctgagcaccggcatcatcctgtaccacctgaaggagggccagacctacgtgggcagagacgacgccagcaccgagcaggacatcgtgctgcacggcctggacctggagagcgagcactgcatcttcgagaacatcggcggcaccgtgaccctgatccccctgagcggcagccagtgcagcgtgaacggcgtgcagatcgtggaggccacccacctgaaccagggcgccgtgatcctgctgggcagaaccaacatgttcagattcaaccaccccaaggaggccgccaagctgagagagaagagaaagagcggcctgctgagcagcttcagcctgagcatgaccgacctgagcaagagcagagagaacctgagcgccgtgatgctgtacaaccccggcctggagttcgagagacagcagagagaggagctggagaagctggagagcaagagaaagctgatcgaggagatggaggagaagcagaagagcgacaaggccgagctggagagaatgcagcaggaggtggagacccagagaaaggagaccgagatcgtgcagctgcagatcagaaagcaggaggagagcctgaagagaagaagcttccacatcgagaacaagctgaaggacctgctggccgagaaggagaagttcgaggaggagagactgagagagcagcaggagatcgagctgcagaagaagagacaggaggaggagaccttcctgagagtgcaggaggagctgcagagactgaaggagctgaacaacaacgagaaggccgagaagttccagatcttccaggagctggaccagctgcagaaggagaaggacgagcagtacgccaagctggagctggagaagaagagactggaggagcaggagaaggagcaggtgatgctggtggcccacctggaggagcagctgagagagaagcaggagatgatccagctgctgagaagaggcgaggtgcagtgggtggaggaggagaagagagacctggagggcatcagagagagcctgctgagagtgaaggaggccagagccggcggcgacgaggacggcgaggagctggagaaggcccagctgagattcttcgagttcaagagaagacagctggtgaagctggtgaacctggagaaggacctggtgcagcagaaggacatcctgaagaaggaggtgcaggaggagcaggagatcctggagtgcctgaagtgcgagcacgacaaggagagcagactgctggagaagcacgacgagagcgtgaccgacgtgaccgaggtgccccaggacttcgagaagatcaagcccgtggagtacagactgcagtacaaggagagacagctgcagtacctgctgcagaaccacctgcccaccctgctggaggagaagcagagagccttcgagatcctggacagaggccccctgagcctggacaacaccctgtaccaggtggagaaggagatggaggagaaggaggagcagctggcccagtaccaggccaacgccaaccagctgcagaagctgcaggccaccttcgagttcaccgccaacatcgccagacaggaggagaaggtgagaaagaaggagaaggagatcctggagagcagagagaagcagcagagagaggccctggagagagccctggccagactggagagaagacacagcgccctgcagagacacagcaccctgggcatggagatcgaggagcagagacagaagctggccagcctgaacagcggcagcagagagcagagcggcctgcaggccagcctggaggccgagcaggaggccctggagaaggaccaggagagactggagtacgagatccagcagctgaagcagaagatctacgaggtggacggcgtgcagaaggaccaccacggcaccctggagggcaaggtggccagcagcagcctgcccgtgagcgccgagaagagccacctggtgcccctgatggacgccagaatcaacgcctacatcgaggaggaggtgcagagaagactgcaggacctgcacagagtgatcagcgagggctgcagcaccagcgccgacaccatgaaggacaacgagaagctgcacaacggcaccatccagagaaagctgaagtacgagctgtgcagagacctgctgtgcgtgctgatgcccgagcccgacgccgccgcctgcgccaaccaccccctgctgcagcaggacctggtgcagctgagcctggactggaagaccgagatccccgacctggtgctgcccaacggcgtgcaggtgagcagcaagttccagaccaccctggtggacatgatctacttcctgcacggcaacatggaggtgaacgtgcccagcctggccgaggtgcagctgctgctgtacaccaccgtgaaggtgatgggcgacagcggccacgaccagtgccagagcctggtgctgctgaacacccacatcgccctggtgaaggaggactgcgtgttctaccccagaatcagaagcagaaacatccccccccccggcgcccagttcgacgtgatcaagtgccacgccctgagcgagttcagatgcgtggtggtgcccgagaagaagaacgtgagcaccgtggagctggtgttcctgcagaagctgaagcccagcgtgggcagcagaaacagcccccccgagcacctgcaggaggcccccaacgtgcagctgttcaccacccccctgtacctgcagggcagccagaacgtggcccccgaggtgtggaagctgaccttcaacagccaggacgaggccctgtggctgatcagccacctgaccagactgtag

SEQ ID NO: 18966 - DNA, 2697 bp, Artificial Sequence
  Description of Artificial Sequence: Synthetic coding sequence
atgagcgtgaccgaggaggacctgtgccaccacatgaaggtggtggtgagagtgagacccgagaacaccaaggagaaggccgccggcttccacaaggtggtgcacgtggtggacaagcacatcctggtgttcgaccccaagcaggaggaggtgagcttcttccacggcaagaagaccaccaaccagaacgtgatcaagaagcagaacaaggacctgaagttcgtgttcgacgccgtgttcgacgagaccagcacccagagcgaggtgttcgagcacaccaccaagcccatcctgagaagcttcctgaacggctacaactgcaccgtgctggcctacggcgccaccggcgccggcaagacccacaccatgctgggcagcgccgacgagcccggcgtgatgtacctgaccatgctgcacctgtacaagtgcatggacgagatcaaggaggagaagatctgcagcaccgccgtgagctacctggaggtgtacaacgagcagatcagagacctgctggtgaacagcggccccctggccgtgagagaggacacccagaagggcgtggtggtgcacggcctgaccctgcaccagcccaagagcagcgaggagatcctgcacctgctggacaacggcaacaagaacagaacccagcaccccaccgacatgaacgccaccagcagcagaagccacgccgtgttccagatctacctgagacagcaggacaagaccgccagcatcaaccagaacgtgagaatcgccaagatgagcctgatcgacctggccggcagcgagagagccagcaccagcggcgccaagggcaccagattcgtggagggcaccaacatcaacagaagcctgctggccctgggcaacgtgatcaacgccctggccgacagcaagagaaagaaccagcacatcccctacagaaacagcaagctgaccagactgctgaaggacagcctgggcggcaactgccagaccatcatgatcgccgccgtgagccccagcagcgtgttctacgacgacacctacaacaccctgaagtacgccaacagagccaaggacatcaagagcagcctgaagagcaacgtgctgaacgtgaacaaccacatcacccagtacgtgaagatctgcaacgagcagaaggccgagatcctgctgctgaaggagaagctgaaggcctacgaggagcagaaggccttcaccaacgagaacgaccaggccaagctgatgatcagcaacccccaggagaaggagatcgagagattccaggagatcctgaactgcctgttccagaacagagaggagatcagacaggagtacctgaagctggagatgctgctgaaggagaacgagctgaagagcttctaccagcagcagtgccacaagcagatcgagatgatgtgcagcgaggacaaggtggagaaggccaccggcaagagagaccacagactggccatgctgaagaccagaagaagctacctggagaagagaagagaggaggagctgaagcagttcgacgagaacaccaactggctgcacagagtggagaaggagatgggcctgctgagccagaacggccacatccccaaggagctgaagaaggacctgcactgccaccacctgcacctgcagaacaaggacctgaaggcccagatcagacacatgatggacctggcctgcctgcaggagcagcagcacagacagaccgaggccgtgctgaacgccctgctgcccaccctgagaaagcagtactgcaccctgaaggaggccggcctgagcaacgccgccttcgagagcgacttcaaggagatcgagcacctggtggagagaaagaaggtggtggtgtgggccgaccagaccgccgagcagcccaagcagaacgacctgcccggcatcagcgtgctgatgaccttcccccagctgggccccgtgcagcccatcccctgctgcagcagcagcggcggcaccaacctggtgaagatccccaccgagaagagaaccagaagaaagctgatgcccagccccctgaagggccagcacaccctgaagagcccccccagccagagcgtgcagctgaacgacagcctgagcaaggagctgcagcccatcgtgtacacccccgaggactgcagaaaggccttccagaaccccagcaccgtgaccctgatgaagcccagcagcttcaccaccagcttccaggccatcagcagcaacatcaacagcgacaactgcctgaagatgctgtgcgaggtggccatcccccacaacagaagaaaggagtgcggccaggaggacctggacagcaccttcaccatctgcgaggacatcaagagcagcaagtgcaagctgcccgagcaggagagcctgcccaacgacaacaaggacatcctgcagagactggaccccagcagcttcagcaccaagcacagcatgcccgtgcccagcatggtgcccagctacatggccatgaccaccgccgccaagagaaagagaaagctgaccagcagcaccagcaacagcagcctgaccgccgacgtgaacagcggcttcgccaagagagtgagacaggacaacagcagcgagaagcacctgcaggagaacaagcccaccatggagcacaagagaaacatctgcaagatcaaccccagcatggtgagaaagttcggcagaaacatcagcaagggcaacctgagatag

SEQ ID NO: 18967 - DNA, 1479 bp, Artificial Sequence
  Description of Artificial Sequence: Synthetic coding sequence
atggccccccccgccgccagactggccctgctgagcgccgccgccctgaccctggccgccagacccgcccccagccccggcctgggccccggccccgagtgcttcaccgccaacggcgccgactacagaggcacccagaactggaccgccctgcagggcggcaagccctgcctgttctggaacgagaccttccagcacccctacaacaccctgaagtaccccaacggcgagggcggcctgggcgagcacaactactgcagaaaccccgacggcgacgtgagcccctggtgctacgtggccgagcacgaggacggcgtgtactggaagtactgcgagatccccgcctgccagatgcccggcaacctgggctgctacaaggaccacggcaaccccccccccctgaccggcaccagcaagaccagcaacaagctgaccatccagacctgcatcagcttctgcagaagccagagattcaagttcgccggcatggagagcggctacgcctgcttctgcggcaacaaccccgactactggaagtacggcgaggccgccagcaccgagtgcaacagcgtgtgcttcggcgaccacacccagccctgcggcggcgacggcagaatcatcctgttcgacaccctggtgggcgcctgcggcggcaactacagcgccatgagcagcgtggtgtacagccccgacttccccgacacctacgccaccggcagagtgtgctactggaccatcagagtgcccggcgccagccacatccacttcagcttccccctgttcgacatcagagacagcgccgacatggtggagctgctggacggctacacccacagagtgctggccagattccacggcagaagcagaccccccctgagcttcaacgtgagcctggacttcgtgatcctgtacttcttcagcgacagaatcaaccaggcccagggcttcgccgtgctgtaccaggccgtgaaggaggagctgccccaggagagacccgccgtgaaccagaccgtggccgaggtgatcaccgagcaggccaacctgagcgtgagcgccgccagaagcagcaaggtgctgtacgtgatcaccaccagccccagccaccccccccagaccgtgcccggcagcaacagctgggccccccccatgggcgccggcagccacagagtggagggctggaccgtgtacggcctggccaccctgctgatcctgaccgtgaccgccatcgtggccaagatcctgctgcacgtgaccttcaagagccacagagtgcccgccagcggcgacctgagagactgccaccagcccggcaccagcggcgagatctggagcatcttctacaagcccagcaccagcatcagcatcttcaagaagaagctgaagggccagagccagcaggacgacagaaaccccctggccatccaggacagcgaggtgaccagcctgatctggagccagggccagcccagaagcatctag

SEQ ID NO: 18968 - DNA, 1377 bp, Artificial Sequence
  Description of Artificial Sequence: Synthetic coding sequence
atggccccccccgccgccagactggccctgctgagcgccgccgccctgaccctggccgccagacccgcccccagccccggcctgggccccggccccgagtgcttcaccgccaacggcgccgactacagaggcacccagaactggaccgccctgcagggcggcaagccctgcctgttctggaacgagaccttccagcacccctacaacaccctgaagtaccccaacggcgagggcggcctgggcgagcacaactactgcagaaaccccgacggcgacgtgagcccctggtgctacgtggccgagcacgaggacggcgtgtactggaagtactgcgagatccccgcctgccagatgcccggcaacctgggctgctacaaggaccacggcaaccccccccccctgaccggcaccagcaagaccagcaacaagctgaccatccagacctgcatcagcttctgcagaagccagagattcaagttcgccggcatggagagcggctacgcctgcttctgcggcaacaaccccgactactggaagtacggcgaggccgccagcaccgagtgcaacagcgtgtgcttcggcgaccacacccagccctgcggcggcgacggcagaatcatcctgttcgacaccctggtgggcgcctgcggcggcaactacagcgccatgagcagcgtggtgtacagccccgacttccccgacacctacgccaccggcagagtgtgctactggaccatcagagtgcccggcgccagccacatccacttcagcttccccctgttcgacatcagagacagcgccgacatggtggagctgctggacggctacacccacagagtgctggccagattccacggcagaagcagaccccccctgagcttcaacgtgagcctggacttcgtgatcctgtacttcttcagcgacagaatcaaccaggcccagggcttcgccgtgctgtaccaggccgtgaaggaggagctgccccaggagagacccgccgtgaaccagaccgtggccgaggtgatcaccgagcaggccaacctgagcgtgagcgccgccagaagcagcaaggtgctgtacgtgatcaccaccagccccagccaccccccccagaccgtgcccggctggaccgtgtacggcctggccaccctgctgatcctgaccgtgaccgccatcgtggccaagatcctgctgcacgtgaccttcaagagccacagagtgcccgccagcggcgacctgagagactgccaccagcccggcaccagcggcgagatctggagcatcttctacaagcccagcaccagcatcagcatcttcaagaagaagctgaagggccagagccagcaggacgacagaaaccccctggtgagcgactag

SEQ ID NO: 18969 - DNA, 1428 bp, Artificial Sequence
  Description of Artificial Sequence: Synthetic coding sequence
atggccccccccgccgccagactggccctgctgagcgccgccgccctgaccctggccgccagacccgcccccagccccggcctgggccccggccccgagtgcttcaccgccaacggcgccgactacagaggcacccagaactggaccgccctgcagggcggcaagccctgcctgttctggaacgagaccttccagcacccctacaacaccctgaagtaccccaacggcgagggcggcctgggcgagcacaactactgcagaaaccccgacggcgacgtgagcccctggtgctacgtggccgagcacgaggacggcgtgtactggaagtactgcgagatccccgcctgccagatgcccggcaacctgggctgctacaaggaccacggcaaccccccccccctgaccggcaccagcaagaccagcaacaagctgaccatccagacctgcatcagcttctgcagaagccagagattcaagttcgccggcatggagagcggctacgcctgcttctgcggcaacaaccccgactactggaagtacggcgaggccgccagcaccgagtgcaacagcgtgtgcttcggcgaccacacccagccctgcggcggcgacggcagaatcatcctgttcgacaccctggtgggcgcctgcggcggcaactacagcgccatgagcagcgtggtgtacagccccgacttccccgacacctacgccaccggcagagtgtgctactggaccatcagagtgcccggcgccagccacatccacttcagcttccccctgttcgacatcagagacagcgccgacatggtggagctgctggacggctacacccacagagtgctggccagattccacggcagaagcagaccccccctgagcttcaacgtgagcctggacttcgtgatcctgtacttcttcagcgacagaatcaaccaggcccagggcttcgccgtgctgtaccaggccgtgaaggaggagctgccccaggagagacccgccgtgaaccagaccgtggccgaggtgatcaccgagcaggccaacctgagcgtgagcgccgccagaagcagcaaggtgctgtacgtgatcaccaccagccccagccaccccccccagaccgtgcccggcagcaacagctgggccccccccatgggcgccggcagccacagagtggagggctggaccgtgtacggcctggccaccctgctgatcctgaccgtgaccgccatcgtggccaagatcctgctgcacgtgaccttcaagagccacagagtgcccgccagcggcgacctgagagactgccaccagcccggcaccagcggcgagatctggagcatcttctacaagcccagcaccagcatcagcatcttcaagaagaagctgaagggccagagccagcaggacgacagaaaccccctggtgagcgactag

SEQ ID NO: 18970 - DNA, 1422 bp, Artificial Sequence
  Description of Artificial Sequence: Synthetic coding sequence
atggccccccccgccgccagactggccctgctgagcgccgccgccctgaccctggccgccagacccgcccccagccccggcctgggccccgagtgcttcaccgccaacggcgccgactacagaggcacccagaactggaccgccctgcagggcggcaagccctgcctgttctggaacgagaccttccagcacccctacaacaccctgaagtaccccaacggcgagggcggcctgggcgagcacaactactgcagaaaccccgacggcgacgtgagcccctggtgctacgtggccgagcacgaggacggcgtgtactggaagtactgcgagatccccgcctgccagatgcccggcaacctgggctgctacaaggaccacggcaaccccccccccctgaccggcaccagcaagaccagcaacaagctgaccatccagacctgcatcagcttctgcagaagccagagattcaagttcgccggcatggagagcggctacgcctgcttctgcggcaacaaccccgactactggaagtacggcgaggccgccagcaccgagtgcaacagcgtgtgcttcggcgaccacacccagccctgcggcggcgacggcagaatcatcctgttcgacaccctggtgggcgcctgcggcggcaactacagcgccatgagcagcgtggtgtacagccccgacttccccgacacctacgccaccggcagagtgtgctactggaccatcagagtgcccggcgccagccacatccacttcagcttccccctgttcgacatcagagacagcgccgacatggtggagctgctggacggctacacccacagagtgctggccagattccacggcagaagcagaccccccctgagcttcaacgtgagcctggacttcgtgatcctgtacttcttcagcgacagaatcaaccaggcccagggcttcgccgtgctgtaccaggccgtgaaggaggagctgccccaggagagacccgccgtgaaccagaccgtggccgaggtgatcaccgagcaggccaacctgagcgtgagcgccgccagaagcagcaaggtgctgtacgtgatcaccaccagccccagccaccccccccagaccgtgcccggcagcaacagctgggccccccccatgggcgccggcagccacagagtggagggctggaccgtgtacggcctggccaccctgctgatcctgaccgtgaccgccatcgtggccaagatcctgctgcacgtgaccttcaagagccacagagtgcccgccagcggcgacctgagagactgccaccagcccggcaccagcggcgagatctggagcatcttctacaagcccagcaccagcatcagcatcttcaagaagaagctgaagggccagagccagcaggacgacagaaaccccctggtgagcgactag

SEQ ID NO: 18971 - DNA, 867 bp, Artificial Sequence
  Description of Artificial Sequence: Synthetic coding sequence
atggccgccgtgctgcagagagtggagagactgagcaacagagtggtgagagtgctgggctgcaaccccggccccatgaccctgcagggcaccaacacctacctggtgggcaccggccccagaagaatcctgatcgacaccggcgagcccgccatccccgagtacatcagctgcctgaagcaggccctgaccgagttcaacaccgccatccaggagatcgtggtgacccactggcacagagaccacagcggcggcatcggcgacatctgcaagagcatcaacaacgacaccacctactgcatcaagaagctgcccagaaacccccagagagaggagatcatcggcaacggcgagcagcagtacgtgtacctgaaggacggcgacgtgatcaagaccgagggcgccaccctgagagtgctgtacacccccggccacaccgacgaccacatggccctgctgctggaggaggagaacgccatcttcagcggcgactgcatcctgggcgagggcaccaccgtgttcgaggacctgtacgactacatgaacagcctgaaggagctgctgaagatcaaggccgacatcatctaccccggccacggccccgtgatccacaacgccgaggccaagatccagcagtacatcagccacagaaacatcagagagcagcagatcctgaccctgttcagagagaacttcgagaagagcttcaccgtgatggagctggtgaagatcatctacaagaacacccccgagaacctgcacgagatggccaagcacaacctgctgctgcacctgaagaagctggagaaggagggcaagatcttcagcaacaccgaccccgacaagaagtggaaggcccacctgtag

SEQ ID NO: 18972 - DNA, 867 bp, Artificial Sequence; identical to SEQ ID NO: 18971
  Description of Artificial Sequence: Synthetic coding sequence

SEQ ID NO: 18973 - DNA, 1704 bp, Artificial Sequence
  Description of Artificial Sequence: Synthetic coding sequence
atgaagcccgtgtgggtggccaccctgctgtggatgctgctgctggtgcccagactgggcgccgccagaaagggcagccccgaggaggccagcttctactacggcaccttccccctgggcttcagctggggcgtgggcagcagcgcctaccagaccgagggcgcctgggaccaggacggcaagggccccagcatctgggacgtgttcacccacagcggcaagggcaaggtgctgggcaacgagaccgccgacgtggcctgcgacggctactacaaggtgcaggaggacatcatcctgctgagagagctgcacgtgaaccactacagattcagcctgagctggcccagactgctgcccaccggcatcagagccgagcaggtgaacaagaagggcatcgagttctacagcgacctgatcgacgccctgctgagcagcaacatcacccccatcgtgaccctgcaccactgggacctgccccagctgctgcaggtgaagtacggcggctggcagaacgtgagcatggccaactacttcagagactacgccaacctgtgcttcgaggccttcggcgacagagtgaagcactggatcaccttcagcgaccccagagccatggccgagaagggctacgagaccggccaccacgcccccggcctgaagctgagaggcaccggcctgtacaaggccgcccaccacatcatcaaggcccacgccaaggcctggcacagctacaacaccacctggagaagcaagcagcagggcctggtgggcatcagcctgaactgcgactggggcgagcccgtggacatcagcaaccccaaggacctggaggccgccgagagatacctgcagttctgcctgggctggttcgccaaccccatctacgccggcgactacccccaggtgatgaaggactacatcggcagaaagagcgccgagcagggcctggagatgagcagactgcccgtgttcagcctgcaggagaagagctacatcaagggcaccagcgacttcctgggcctgggccacttcaccaccagatacatcaccgagagaaactaccccagcagacagggccccagctaccagaacgacagagacctgatcgagctggtggaccccaactggcccgacctgggcagcaagtggctgtacagcgtgccctggggcttcagaagactgctgaacttcgcccagacccagtacggcgacccccccatctacgtgatggagaacggcgccagccagaagttccactgcacccagctgtgcgacgagtggagaatccagtacctgaagggctacatcaacgagatgctgaaggccatcaaggacggcgccaacatcaagggctacaccagctggagcctgctggacaagttcgagtgggagaagggctacagcgacagatacggcttctactacgtggagttcaacgacagaaacaagcccagataccccaaggccagcgtgcagtactacaagaagatcatcatcgccaacggcttccccaaccccagagaggtggagagctggtacctgaaggccctggagacctgcagcatcaacaaccagatgctggccgccgagcccctgctgagccacatgcagatggtgaccgagatcgtggtgcccaccgtgtgcagcctgtgcgtgctgatcaccgccgtgctgctgatgctgctgctgagaagacagagctag

SEQ ID NO: 18974 - DNA, 1185 bp, Artificial Sequence
  Description of Artificial Sequence: Synthetic coding sequence
atggccaactacttcagagactacgccaacctgtgcttcgaggccttcggcgacagagtgaagcactggatcaccttcagcgaccccagagccatggccgagaagggctacgagaccggccaccacgcccccggcctgaagctgagaggcaccggcctgtacaaggccgcccaccacatcatcaaggcccacgccaaggcctggcacagctacaacaccacctggagaagcaagcagcagggcctggtgggcatcagcctgaactgcgactggggcgagcccgtggacatcagcaaccccaaggacctggaggccgccgagagatacctgcagttctgcctgggctggttcgccaaccccatctacgccggcgactacccccaggtgatgaaggactacatcggcagaaagagcgccgagcagggcctggagatgagcagactgcccgtgttcagcctgcaggagaagagctacatcaagggcaccagcgacttcctgggcctgggccacttcaccaccagatacatcaccgagagaaactaccccagcagacagggccccagctaccagaacgacagagacctgatcgagctggtggaccccaactggcccgacctgggcagcaagtggctgtacagcgtgccctggggcttcagaagactgctgaacttcgcccagacccagtacggcgacccccccatctacgtgatggagaacggcgccagccagaagttccactgcacccagctgtgcgacgagtggagaatccagtacctgaagggctacatcaacgagatgctgaaggccatcaaggacggcgccaacatcaagggctacaccagctggagcctgctggacaagttcgagtgggagaagggctacagcgacagatacggcttctactacgtggagttcaacgacagaaacaagcccagataccccaaggccagcgtgcagtactacaagaagatcatcatcgccaacggcttccccaaccccagagaggtggagagctggtacctgaaggccctggagacctgcagcatcaacaaccagatgctggccgccgagcccctgctgagccacatgcagatggtgaccgagatcgtggtgcccaccgtgtgcagcctgtgcgtgctgatcaccgccgtgctgctgatgctgctgctgagaagacagagctag

SEQ ID NO: 18975 - DNA, 1446 bp, Artificial Sequence
  Description of Artificial Sequence: Synthetic coding sequence
atggccgccagctggagcctgctggtgaccctgagacccctggcccagagccccctgagaggcagatgcgtgggctgcggcgcctgggccgccgccctggcccccctggccaccgcccccggcaagcccttctggaaggcctacaccgtgcagaccagcgagagcatgacccccaccgccaccagcgagacctacctgaaggccctggccgtgtgccacggccccctggaccactacgacttcctgatcaaggcccacgagctgaaggacgacgagcaccagagaagagtgatccagtgcctgcagaagctgcacgaggacctgaagggctacaacatcgaggccgagggcctgttcagcaagctgttcagcagaagcaagccccccagaggcctgtacgtgtacggcgacgtgggcaccggcaagaccatggtgatggacatgttctacgcctacgtggagatgaagagaaagaagagagtgcacttccacggcttcatgctggacgtgcacaagagaatccacagactgaagcagagcctgcccaagagaaagcccggcttcatggccaagagctacgaccccatcgcccccatcgccgaggagatcagcgaggaggcctgcctgctgtgcttcgacgagttccaggtgaccgacatcgccgacgccatgatcctgaagcagctgttcgagaacctgttcaagaacggcgtggtggtggtggccaccagcaacagaccccccgaggacctgtacaagaacggcctgcagagagccaacttcgtgcccttcatcgccgtgctgaaggagtactgcaacaccgtgcagctggacagcggcatcgactacagaaagagagagctgcccgccgccggcaagctgtactacctgaccagcgaggccgacgtggaggccgtgatggacaagctgttcgacgagctggcccagaagcagaacgacctgaccagacccagaatcctgaaggtgcagggcagagagctgagactgaacaaggcctgcggcaccgtggccgactgcaccttcgaggagctgtgcgagagacccctgggcgccagcgactacctggagctgagcaagaacttcgacaccatcttcctgagaaacatcccccagttcaccctggccaacagaacccagggcagaagattcatcaccctgatcgacaacttctacgacctgaaggtgagaatcatctgcagcgccagcacccccatcagcagcctgttcctgcaccagcaccacgacagcgagctggagcagagcagaatcctgatggacgacctgggcctgagccaggacagcgccgagggcctgagcatgttcaccggcgaggaggagatcttcgccttccagagaaccatcagcagactgaccgagatgcagaccgagcagtactggaacgagggcgacagaaccaagaagtag

SEQ ID NO: 18976 - DNA, 486 bp, Artificial Sequence
  Description of Artificial Sequence: Synthetic coding sequence
atgggctgctgctacagcagcgagaacgaggacagcgaccaggacagagaggagagaaagctgctgctggaccccagcagcccccccaccaaggccctgaacggcgccgagcccaactaccacagcctgcccagcgccagaaccgacgagcaggccctgctgagcagcatcctggccaagaccgccagcaacatcatcgacgtgagcgccgccgacagccagggcatggagcagcacgagtacatggacagagccagacagtacagcaccagactggccgtgctgagcagcagcctgacccactggaagaagctgccccccctgcccagcctgaccagccagccccaccaggtgctggccagcgagcccatccccttcagcgacctgcagcaggtgagcagaatcgccgcctacgcctacagcgccctgagccagatcagagtggacgccaaggaggagctggtggtgcagttcggcatcccctag

SEQ ID NO: 18977 - DNA, 453 bp, Artificial Sequence
  Description of Artificial Sequence: Synthetic coding sequence
atgctgagacccaaggccctgacccaggtgctgagccaggccaacaccggcggcgtgcagagcaccctgctgctgaacaacgagggcagcctgctggcctacagcggctacggcgacaccgacgccagagtgaccgccgccatcgccagcaacatctgggccgcctacgacagaaacggcaaccaggccttcaacgaggacaacctgaagttcatcctgatggactgcatggagggcagagtggccatcaccagagtggccaacctgctgctgtgcatgtacgccaaggagaccgtgggcttcggcatgctgaaggccaaggccgtgtgcggcaccgacctgtgcagccccagcgccggccccggcttcggcgccgtgcccggcggcgccccccaccccagcggcggcatcctgaccgccctggtggaggccggcgtgagaaaggagaagtag

SEQ ID NO: 18978 - DNA, 288 bp, Artificial Sequence
  Description of Artificial Sequence: Synthetic coding sequence
atgctgagacccaaggccctgacccaggtgctgagccaggccaacaccggcggcgtgcagagcaccctgctgctgaacaacgagggcagcctgctggcctacagcggctacggcgacaccgacgccagagtgaccgccgccatcgccagcaacatctgggccgcctacgacagaaacggcaaccaggccttcaacgaggacaacctgaagttcatcctgatggactgcatggcccaggccctggtgcagtacctggaggagcccctgacccaggtggccgccagctag

SEQ ID NO: 18979 - DNA, 378 bp, Artificial Sequence
  Description of Artificial Sequence: Synthetic coding sequence
atgctgagacccaaggccctgacccaggtgctgagccaggccaacaccggcggcgtgcagagcaccctgctgctgaacaacgagggcagcctgctggcctacagcggctacggcgacaccgacgccagagtgaccgccgccatcgccagcaacatctgggccgcctacgacagaaacggcaaccaggccttcaacgaggacaacctgaagttcatcctgatggactgcatggagggcagagtggccatcaccagagtggccaacctgctgctgtgcatgtacgccaaggagaccgtgggcttcggcatgctgaaggccaaggcccaggccctggtgcagtacctggaggagcccctgacccaggtggccgccagctag

SEQ ID NO: 18980 - DNA, 375 bp, Artificial Sequence
  Description of Artificial Sequence: Synthetic coding sequence
atggccgacgacctgaagagattcctgtacaagaagctgcccagcgtggagggcctgcacgccatcgtggtgagcgacagagacggcgtgcccgtgatcaaggtggccaacgacaacgcccccgagcacgccctgagacccggcttcctgagcaccttcgccctggccaccgaccagggcagcaagctgggcctgagcaagaacaagagcatcatctgctactacaacacctaccaggtggtgcagttcaacagactgcccctggtggtgagcttcatcgccagcagcagcgccaacaccggcctgatcgtgagcctggagaaggagctggcccccctgttcgaggagctgagacaggtggtggaggtgagctag

SEQ ID NO: 18981 - DNA, 4425 bp, Artificial Sequence
  Description of Artificial Sequence: Synthetic coding sequence
atggccagactggccgccgtgctgtggaacctgtgcgtgaccgccgtgctggtgaccagcgccacccagggcctgagcagagccggcctgcccttcggcctgatgagaagagagctggcctgcgagggctaccccatcgagctgagatgccccggcagcgacgtgatcatggtggagaacgccaactacggcagaaccgacgacaagatctgcgacgccgaccccttccagatggagaacgtgcagtgctacctgcccgacgccttcaagatcatgagccagagatgcaacaacagaacccagtgcgtggtggtggccggcagcgacgccttccccgacccctgccccggcacctacaagtacctggaggtgcagtacgactgcgtgccctacaaggtggagcagaaggtgttcgtgtgccccggcaccctgcagaaggtgctggagcccaccagcacccacgagagcgagcaccagagcggcgcctggtgcaaggaccccctgcaggccggcgacagaatctacgtgatgccctggatcccctacagaaccgacaccctgaccgagtacgccagctgggaggactacgtggccgccagacacaccaccacctacagactgcccaacagagtggacggcaccggcttcgtggtgtacgacggcgccgtgttctacaacaaggagagaaccagaaacatcgtgaagtacgacctgagaaccagaatcaagagcggcgagaccgtgatcaacaccgccaactaccacgacaccagcccctacagatggggcggcaagaccgacatcgacctggccgtggacgagaacggcctgtgggtgatctacgccaccgagggcaacaacggcagactggtggtgagccagctgaacccctacaccctgagattcgagggcacctgggagaccggctacgacaagagaagcgccagcaacgccttcatggtgtgcggcgtgctgtacgtgctgagaagcgtgtacgtggacgacgacagcgaggccgccggcaacagagtggactacgccttcaacaccaacgccaacagagaggagcccgtgagcctgaccttccccaacccctaccagttcatcagcagcgtggactacaaccccagagacaaccagctgtacgtgtggaacaactacttcgtggtgagatacagcctggagttcggcccccccgaccccagcgccggccccgccaccagcccccccctgagcaccaccaccaccgccagacccacccccctgaccagcaccgccagccccgccgccaccacccccctgagaagagcccccctgaccacccaccccgtgggcgccatcaaccagctgggccccgacctgccccccgccaccgcccccgtgcccagcaccagaagaccccccgcccccaacctgcacgtgagccccgagctgttctgcgagcccagagaggtgagaagagtgcagtggcccgccacccagcagggcatgctggtggagagaccctgccccaagggcaccagaggcatcgccagcttccagtgcctgcccgccctgggcctgtggaaccccagaggccccgacctgagcaactgcaccagcccctgggtgaaccaggtggcccagaagatcaagagcggcgagaacgccgccaacatcgccagcgagctggccagacacaccagaggcagcatctacgccggcgacgtgagcagcagcgtgaagctgatggagcagctgctggacatcctggacgcccagctgcaggccctgagacccatcgagagagagagcgccggcaagaactacaacaagatgcacaagagagagagaacctgcaaggactacatcaaggccgtggtggagaccgtggacaacctgctgagacccgaggccctggagagctggaaggacatgaacgccaccgagcaggtgcacaccgccaccatgctgctggacgtgctggaggagggcgccttcctgctggccgacaacgtgagagagcccgccagattcctggccgccaaggagaacgtggtgctggaggtgaccgtgctgaacaccgagggccaggtgcaggagctggtgttcccccaggaggagtaccccagaaagaacagcatccagctgagcgccaagaccatcaagcagaacagcagaaacggcgtggtgaaggtggtgttcatcctgtacaacaacctgggcctgttcctgagcaccgagaacgccaccgtgaagctggccggcgaggccggccccggcggccccggcggcgccagcctggtggtgaacagccaggtgatcgccgccagcatcaacaaggagagcagcagagtgttcctgatggaccccgtgatcttcaccgtggcccacctggaggacaagaaccacttcaacgccaactgcagcttctggaactacagcgagagaagcatgctgggctactggagcacccagggctgcagactggtggagagcaacaagacccacaccacctgcgcctgcagccacctgaccaacttcgccgtgctgatggcccacagagagatctaccagggcagaatcaacgagctgctgctgagcgtgatcacctgggtgggcatcgtgatcagcctggtgtgcctggccatctgcatcagcaccttctgcttcctgagaggcctgcagaccgacagaaacaccatccacaagaacctgtgcatcaacctgttcctggccgagctgctgttcctggtgggcatcgacaagacccagtacgagatcgcctgccccatcttcgccggcctgctgcactacttcttcctggccgccttcagctggctgtgcctggagggcgtgcacctgtacctgctgctggtggaggtgttcgagagcgagtacagcagaaccaagtactactacctgggcggctactgcttccccgccctggtggtgggcatcgccgccgccatcgactacagaagctacggcaccgagaaggcctgctggctgagagtggacaactacttcatctggagcttcatcggccccgtgagcttcgtgatcgtggtgaacctggtgttcctgatggtgaccctgcacaagatgatcagaagcagcagcgtgctgaagcccgacagcagcagactggacaacatcaagagctgggccctgggcgccatcgccctgctgttcctgctgggcctgacctgggccttcggcctgctgttcatcaacaaggagagcgtggtgatggcctacctgttcaccaccttcaacgccttccagggcgtgttcatcttcgtgttccactgcgccctgcagaagaaggtgcacaaggagtacagcaagtgcctgagacacagctactgctgcatcagaagcccccccggcggcacccacggcagcctgaagaccagcgccatgagaagcaacaccagatactacaccggcacccagagcagaatcagaagaatgtggaacgacaccgtgagaaagcagaccgagagcagcttcatggccggcgacatcaacagcacccccaccctgaacagaggcaccatgggcaaccacctgctgaccaaccccgtgctgcagcccagaggcggcaccagcccctacaacaccctgatcgccgagagcgtgggcttcaaccccagcagcccccccgtgttcaacagccccggcagctacagagagcccaagcaccccctgggcggcagagaggcctgcggcatggacaccctgcccctgaacggcaacttcaacaacagctacagcctgagaagcggcgacttcccccccggcgacggcggccccgagccccccagaggcagaaacctggccgacgccgccgccttcgagaagatgatcatcagcgagctggtgcacaacaacctgagaggcagcagcagcgccgccaagggcccccccccccccgagccccccgtgccccccgtgcccggcggcggcggcgaggaggaggccggcggccccggcggcgccgacagagccgagatcgagctgctgtacaaggccctggaggagcccctgctgctgcccagagcccagagcgtgctgtaccagagcgacctggacgagagcgagagctgcaccgccgaggacggcgccaccagcagacccctgagcagcccccccggcagagacagcctgtacgccagcggcgccaacctgagagacagccccagctaccccgacagcagccccgagggccccagcgaggccctgcccccccccccccccgccccccccggcccccccgagatctactacaccagcagaccccccgccctggtggccagaaaccccctgcagggctactaccaggtgagaagacccagccacgagggctacctggccgcccccggcctggagggccccggccccgacggcgacggccagatgcagctggtgaccagcctgtag

SEQ ID NO: 18982 - DNA, 4410 bp, Artificial Sequence
  Description of Artificial Sequence: Synthetic coding sequence
atggccagactggccgccgtgctgtggaacctgtgcgtgaccgccgtgctggtgaccagcgccacccagggcctgagcagagccggcctgcccttcggcctgatgagaagagagctggcctgcgagggctaccccatcgagctgagatgccccggcagcgacgtgatcatggtggagaacgccaactacggcagaaccgacgacaagatctgcgacgccgaccccttccagatggagaacgtgcagtgctacctgcccgacgccttcaagatcatgagccagagatgcaacaacagaacccagtgcgtggtggtggccggcagcgacgccttccccgacccctgccccggcacctacaagtacctggaggtgcagtacgactgcgtgccctacatcttcgtgtgccccggcaccctgcagaaggtgctggagcccaccagcacccacgagagcgagcaccagagcggcgcctggtgcaaggaccccctgcaggccggcgacagaatctacgtgatgccctggatcccctacagaaccgacaccctgaccgagtacgccagctgggaggactacgtggccgccagacacaccaccacctacagactgcccaacagagtggacggcaccggcttcgtggtgtacgacggcgccgtgttctacaacaaggagagaaccagaaacatcgtgaagtacgacctgagaaccagaatcaagagcggcgagaccgtgatcaacaccgccaactaccacgacaccagcccctacagatggggcggcaagaccgacatcgacctggccgtggacgagaacggcctgtgggtgatctacgccaccgagggcaacaacggcagactggtggtgagccagctgaacccctacaccctgagattcgagggcacctgggagaccggctacgacaagagaagcgccagcaacgccttcatggtgtgcggcgtgctgtacgtgctgagaagcgtgtacgtggacgacgacagcgaggccgccggcaacagagtggactacgccttcaacaccaacgccaacagagaggagcccgtgagcctgaccttccccaacccctaccagttcatcagcagcgtggactacaaccccagagacaaccagctgtacgtgtggaacaactacttcgtggtgagatacagcctggagttcggcccccccgaccccagcgccggccccgccaccagcccccccctgagcaccaccaccaccgccagacccacccccctgaccagcaccgccagccccgccgccaccacccccctgagaagagcccccctgaccacccaccccgtgggcgccatcaaccagctgggccccgacctgccccccgccaccgcccccgtgcccagcaccagaagaccccccgcccccaacctgcacgtgagccccgagctgttctgcgagcccagagaggtgagaagagtgcagtggcccgccacccagcagggcatgctggtggagagaccctgccccaagggcaccagaggcatcgccagcttccagtgcctgcccgccctgggcctgtggaaccccagaggccccgacctgagcaactgcaccagcccctgggtgaaccaggtggcccagaagatcaagagcggcgagaacgccgccaacatcgccagcgagctggccagacacaccagaggcagcatctacgccggcgacgtgagcagcagcgtgaagctgatggagcagctgctggacatcctggacgcccagctgcaggccctgagacccatcgagagagagagcgccggcaagaactacaacaagatgcacaagagagagagaacctgcaaggactacatcaaggccgtggtggagaccgtggacaacctgctgagacccgaggccctggagagctggaaggacatgaacgccaccgagcaggtgcacaccgccaccatgctgctggacgtgctggaggagggcgccttcctgctggccgacaacgtgagagagcccgccagattcctggccgccaaggagaacgtggtgctggaggtgaccgtgctgaacaccgagggccaggtgcaggagctggtgttcccccaggaggagtaccccagaaagaacagcatccagctgagcgccaagaccatcaagcagaacagcagaaacggcgtggtgaaggtggtgttcatcctgtacaacaacctgggcctgttcctgagcaccgagaacgccaccgtgaagctggccggcgaggccggccccggcggccccggcggcgccagcctggtggtgaacagccaggtgatcgccgccagcatcaacaaggagagcagcagagtgttcctgatggaccccgtgatcttcaccgtggcccacctggaggacaagaaccacttcaacgccaactgcagcttctggaactacagcgagagaagcatgctgggctactggagcacccagggctgcagactggtggagagcaacaagacccacaccacctgcgcctgcagccacctgaccaacttcgccgtgctgatggcccacagagagatctaccagggcagaatcaacgagctgctgctgagcgtgatcacctgggtgggcatcgtgatcagcctggtgtgcctggccatctgcatcagcaccttctgcttcctgagaggcctgcagaccgacagaaacaccatccacaagaacctgtgcatcaacctgttcctggccgagctgctgttcctggtgggcatcgacaagacccagtacgagatcgcctgccccatcttcgccggcctgctgcactacttcttcctggccgccttcagctggctgtgcctggagggcgtgcacctgtacctgctgctggtggaggtgttcgagagcgagtacagcagaaccaagtactactacctgggcggctactgcttccccgccctggtggtgggcatcgccgccgccatcgactacagaagctacggcaccgagaaggcctgctggctgagagtggacaactacttcatctggagcttcatcggccccgtgagcttcgtgatcgtggtgaacctggtgttcctgatggtgaccctgcacaagatgatcagaagcagcagcgtgctgaagcccgacagcagcagactggacaacatcaagagctgggccctgggcgccatcgccctgctgttcctgctgggcctgacctgggccttcggcctgctgttcatcaacaaggagagcgtggtgatggcctacctgttcaccaccttcaacgccttccagggcgtgttcatcttcgtgttccactgcgccctgcagaagaaggtgcacaaggagtacagcaagtgcctgagacacagctactgctgcatcagaagcccccccggcggcacccacggcagcctgaagaccagcgccatgagaagcaacaccagatactacaccggcacccagagcagaatcagaagaatgtggaacgacaccgtgagaaagcagaccgagagcagcttcatggccggcgacatcaacagcacccccaccctgaacagaggcaccatgggcaaccacctgctgaccaaccccgtgctgcagcccagaggcggcaccagcccctacaacaccctgatcgccgagagcgtgggcttcaaccccagcagcccccccgtgttcaacagccccggcagctacagagagcccaagcaccccctgggcggcagagaggcctgcggcatggacaccctgcccctgaacggcaacttcaacaacagctacagcctgagaagcggcgacttcccccccggcgacggcggccccgagccccccagaggcagaaacctggccgacgccgccgccttcgagaagatgatcatcagcgagctggtgcacaacaacctgagaggcagcagcagcgccgccaagggcccccccccccccgagccccccgtgccccccgtgcccggcggcggcggcgaggaggaggccggcggccccggcggcgccgacagagccgagatcgagctgctgtacaaggccctggaggagcccctgctgctgcccagagcccagagcgtgctgtaccagagcgacctggacgagagcgagagctgcaccgccgaggacggcgccaccagcagacccctgagcagcccccccggcagagacagcctgtacgccagcggcgccaacctgagagacagccccagctaccccgacagcagccccgagggccccagcgaggccctgcccccccccccccccgccccccccggcccccccgagatctactacaccagcagaccccccgccctggtggccagaaaccccctgcagggctactaccaggtgagaagacccagccacgagggctacctggccgcccccggcctggagggccccggccccgacggcgacggccagatgcagctggtgaccagcctgtag

SEQ ID NO: 18983 - DNA, 4296 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaagctgcagaagagagagaagacctgcagagcctacctgaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaacaactacagagtgtgcgacggctactacaacaccgacctgcccggcagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18984 - DNA, 4212 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18985 - DNA, 4251 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaagctgcagaagagagagaagacctgcagagcctacctgaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18986 - DNA, 4212 bp, Artificial Sequence; identical to SEQ ID NO: 18984
  Description of Artificial Sequence: Synthetic coding sequence

SEQ ID NO: 18987 - DNA, 3372 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccaggacatccactag

SEQ ID NO: 18988 - DNA, 3534 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcctgaccagccacggcctgagagcccacctgcaggacctgtaccacctggagctgctgctgggccagatcgcctag

SEQ ID NO: 18989 - DNA, 4425 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaagctgcagaagagagagaagacctgcagagcctacctgaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaacaactacagagtgtgcgacggctactacaacaccgacctgcccggcagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18990 - DNA, 4155 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatggagcagaaggtgttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18991 - DNA, 4386 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaacaactacagagtgtgcgacggctactacaacaccgacctgcccggcagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18992 - DNA, 4425 bp, Artificial Sequence; identical to SEQ ID NO: 18989
  Description of Artificial Sequence: Synthetic coding sequence

SEQ ID NO: 18993 - DNA, 4296 bp, Artificial Sequence; identical to SEQ ID NO: 18983
  Description of Artificial Sequence: Synthetic coding sequence

SEQ ID NO: 18994 - DNA, 4380 bp, Artificial Sequence
  Description of Artificial Sequence: Synthetic coding sequence
atggtgagcagcggctgcagaatgagaagcctgtggttcatcatcgtgatcagcttcctgcccaacaccgagggcttcagcagagccgccctgcccttcggcctggtgagaagagagctgagctgcgagggctacagcatcgacctgagatgccccggcagcgacgtgatcatgatcgagagcgccaactacggcagaaccgacgacaagatctgcgacgccgaccccttccagatggagaacaccgactgctacctgcccgacgccttcaagatcatgacccagagatgcaacaacagaacccagtgcatcgtggtgaccggcagcgacgtgttccccgacccctgccccggcacctacaagtacctggaggtgcagtacgagtgcgtgccctacatcttcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaagctgcagaagagagagaagacctgcagagcctacctgaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18995 - DNA, 4251 bp, Artificial Sequence; identical to SEQ ID NO: 18985
  Description of Artificial Sequence: Synthetic coding sequence

SEQ ID NO: 18996 - DNA, 4386 bp, Artificial Sequence; identical to SEQ ID NO: 18991
  Description of Artificial Sequence: Synthetic coding sequence

SEQ ID NO: 18997 - DNA, 1416 bp, Artificial Sequence
  Description of Artificial Sequence: Synthetic coding sequence
tgaatcaccctgtgcaagatggtgaagcacagcaacaccctgaagcccgacagcagcagactggagaacatcaacaactacagagtgtgcgacggctactacaacaccgacctgcccggcagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccgccacctacagagagaccagacacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18998 - DNA, 4056 bp, Artificial Sequence
  Description of Artificial Sequence: Synthetic coding sequence
tgattcgtgtgccccggcaccctgaaggccatcgtggacagcccctgcatctacgaggccgagcagaaggccggcgcctggtgcaaggaccccctgcaggccgccgacaagatctacttcatgccctggaccccctacagaaccgacaccctgatcgagtacgccagcctggaggacttccagaacagcagacagaccaccacctacaagctgcccaacagagtggacggcaccggcttcgtggtgtacgacggcgccgtgttcttcaacaaggagagaaccagaaacatcgtgaagttcgacctgagaaccagaatcaagagcggcgaggccatcatcaactacgccaactaccacgacaccagcccctacagatggggcggcaagaccgacatcgacctggccgtggacgagaacggcctgtgggtgatctacgccaccgagcagaacaacggcatgatcgtgatcagccagctgaacccctacaccctgagattcgaggccacctgggagaccgtgtacgacaagagagccgccagcaacgccttcatgatctgcggcgtgctgtacgtggtgagaagcgtgtaccaggacaacgagagcgagaccggcaagaacagcatcgactacatctacaacaccagactgaacagaggcgagtacgtggacgtgcccttccccaaccagtaccagtacatcgccgccgtggactacaaccccagagacaaccagctgtacgtgtggaacaacaacttcatcctgagatacagcctggagttcggcccccccgaccccgcccaggtgcccaccaccgccgtgaccatcaccagcagcgccgagctgttcaagaccatcatcagcaccaccagcaccaccagccagaagggccccatgagcaccaccgtggccggcagccaggagggcagcaagggcaccaagcccccccccgccgtgagcaccaccaagatcccccccatcaccaacatcttccccctgcccgagagattctgcgaggccctggacagcaagggcatcaagtggccccagacccagagaggcatgatggtggagagaccctgccccaagggcaccagaggcaccgccagctacctgtgcatgatcagcaccggcacctggaaccccaagggccccgacctgagcaactgcaccagccactgggtgaaccagctggcccagaagatcagaagcggcgagaacgccgccagcctggccaacgagctggccaagcacaccaagggccccgtgttcgccggcgacgtgagcagcagcgtgagactgatggagcagctggtggacatcctggacgcccagctgcaggagctgaagcccagcgagaaggacagcgccggcagaagctacaacaagctgcagaagagagagaagacctgcagagcctacctgaaggccatcgtggacaccgtggacaacctgctgagacccgaggccctggagagctggaagcacatgaacagcagcgagcaggcccacaccgccaccatgctgctggacaccctggaggagggcgccttcgtgctggccgacaacctgctggagcccaccagagtgagcatgcccaccgagaacatcgtgctggaggtggccgtgctgagcaccgagggccagatccaggacttcaagttccccctgggcatcaagggcgccggcagcagcatccagctgagcgccaacaccgtgaagcagaacagcagaaacggcctggccaagctggtgttcatcatctacagaagcctgggccagttcctgagcaccgagaacgccaccatcaagctgggcgccgacttcatcggcagaaacagcaccatcgccgtgaacagccacgtgatcagcgtgagcatcaacaaggagagcagcagagtgtacctgaccgaccccgtgctgttcaccctgccccacatcgaccccgacaactacttcaacgccaactgcagcttctggaactacagcgagagaaccatgatgggctactggagcacccagggctgcaagctggtggacaccaacaagaccagaaccacctgcgcctgcagccacctgaccaacttcgccatcctgatggcccacagagagatcgcctacaaggacggcgtgcacgagctgctgctgaccgtgatcacctgggtgggcatcgtgatcagcctggtgtgcctggccatctgcatcttcaccttctgcttcttcagaggcctgcagagcgacagaaacaccatccacaagaacctgtgcatcaacctgttcatcgccgagttcatcttcctgatcggcatcgacaagaccaagtacgccatcgcctgccccatcttcgccggcctgctgcacttcttcttcctggccgccttcgcctggatgtgcctggagggcgtgcagctgtacctgatgctggtggaggtgttcgagagcgagtacagcagaaagaagtactactacgtggccggctacctgttccccgccaccgtggtgggcgtgagcgccgccatcgactacaagagctacggcaccgagaaggcctgctggctgcacgtggacaactacttcatctggagcttcatcggccccgtgaccttcatcatcctgctgaacatcatcttcctggtgatcaccctgtgcaagatggtgaagcacagcaacaccctgaagcccgacagcagcagactggagaacatcaacaactacagagtgtgcgacggctactacaacaccgacctgcccggctacgaggacaacaagcccttcatcaagagctgggtgctgggcgccttcgccctgctgtgcctgctgggcctgacctggagcttcggcctgctgttcatcaacgaggagaccatcgtgatggcctacctgttcaccatcttcaacgccttccagggcgtgttcatcttcatcttccactgcgccctgcagaagaaggtgagaaaggagtacggcaagtgcttcagacacagctactgctgcggcggcctgcccaccgagagcccccacagcagcgtgaaggccagcaccaccagaaccagcgccagatacagcagcggcacccagagcagaatcagaagaatgtggaacgacaccgtgagaaagcagagcgagagcagcttcatcagcggcgacatcaacagcaccagcaccctgaaccagggcatgaccggcaactacctgctgaccaaccccctgctgagaccccacggcaccaacaacccctacaacaccctgctggccgagaccgtggtgtgcaacgcccccagcgcccccgtgttcaacagccccggccacagcctgaacaacgccagagacaccagcgccatggacaccctgcccctgaacggcaacttcaacaacagctacagcctgcacaagggcgactacaacgacagcgtgcaggtggtggactgcggcctgagcctgaacgacaccgccttcgagaagatgatcatcagcgagctggtgcacaacaacctgagaggcagcagcaagacccacaacctggagctgaccctgcccgtgaagcccgtgatcggcggcagcagcagcgaggacgacgccatcgtggccgacgccagcagcctgatgcacagcgacaaccccggcctggagctgcaccacaaggagctggaggcccccctgatcccccagagaacccacagcctgctgtaccagccccagaagaaggtgaagagcgagggcaccgacagctacgtgagccagctgaccgccgaggccgaggaccacctgcagagccccaacagagacagcctgtacaccagcatgcccaacctgagagacagcccctaccccgagagcagccccgacatggaggaggacctgagccccagcagaagaagcgagaacgaggacatctactacaagagcatgcccaacctgggcgccggccaccagctgcagatgtgctaccagatcagcagaggcaacagcgacggctacatcatccccatcaacaaggagggctgcatccccgagggcgacgtgagagagggccagatgcagctggtgaccagcctgtag

SEQ ID NO: 18999 - DNA, 3723 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacagagtggaccagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagccctacagagagaccagcatgggcgtgaagctgaacatcgcctaccagatcggcgccagcgagcagtgccagggctacaagtgccacggctacagcaccaccgagtggtag

SEQ ID NO: 19000 - DNA, 4344 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacagagtggaccagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19001 - DNA, 2757 bp, Artificial Sequence
  Description of Artificial Sequence: Synthetic coding sequence
tgatacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19002 - DNA, 3852 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagccctacagagagaccagcatgggcgtgaagctgaacatcgcctaccagatcggcgccagcgagcagtgccagggctacaagtgccacggctacagcaccaccgagtggtag

SEQ ID NO: 19003 - DNA, 3696 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagccctacagagagaccagcatgggcgtgaagctgaacatcgcctaccagatcggcgccagcgagcagtgccagggctacaagtgccacggctacagcaccaccgagtggtag

SEQ ID NO: 19004 - DNA, 4743 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19005 - DNA, 4716 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19006 - DNA, 4029 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagccctacagagagaccagcatgggcgtgaagctgaacatcgcctaccagatcggcgccagcgagcagtgccagggctacaagtgccacggctacagcaccaccgagtggtag

SEQ ID NO: 19007 - DNA, 4587 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19008 - DNA, 4056 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagccctacagagagaccagcatgggcgtgaagctgaacatcgcctaccagatcggcgccagcgagcagtgccagggctacaagtgccacggctacagcaccaccgagtggtag

SEQ ID NO: 19009 - DNA, 4539 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19010 - DNA, 3927 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagccctacagagagaccagcatgggcgtgaagctgaacatcgcctaccagatcggcgccagcgagcagtgccagggctacaagtgccacggctacagcaccaccgagtggtag

SEQ ID NO: 19011 - DNA, 3900 bp, Artificial Sequence
  Description of Artificial Sequence: Synthetic coding sequence
atgtggcccagccagctgctgatcttcatgatgctgctggcccccatcatccacggcggcaagcacagcgagagacaccccgccctggccgcccccctgagacacgccgagagaagccccggcggcgccctgccccccagacacctgctgcagcagcccgccgccgagagaaccgccgcccacagaggccagggccccagaggcgccaccagaggcgtgagaggccccggcgcccagggcgcccagatcgccgcccaggccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagccctacagagagaccagcatgggcgtgaagctgaacatcgcctaccagatcggcgccagcgagcagtgccagggctacaagtgccacggctacagcaccaccgagtggtag

SEQ ID NO: 19012 - DNA, 3723 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagccctacagagagaccagcatgggcgtgaagctgaacatcgcctaccagatcggcgccagcgagcagtgccagggctacaagtgccacggctacagcaccaccgagtggtag

SEQ ID NO: 19013 - DNA, 3825 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagccctacagagagaccagcatgggcgtgaagctgaacatcgcctaccagatcggcgccagcgagcagtgccagggctacaagtgccacggctacagcaccaccgagtggtag

SEQ ID NO: 19014 - DNA, 4410 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaactacgaggacaacagacccttcatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagagagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19015 - DNA, 4512 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacaaggtggagcagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaagctgcagaagagagagagaagctgcagagcctacgtgcaggccatggtggagaccgtgaacaacctgctgcagccccaggccctgaacgcctggagagacctgaccaccagcgaccagctgagagccgccaccatgctgctgcacaccgtggaggagagcgccttcgtgctggccgacaacctgctgaagaccgacatcgtgagagagaacaccgacaacatcaagctggaggtggccagactgagcaccgagggcaacctggaggacctgaagttccccgagaacatgggccacggcagcaccatccagctgagcgccaacaccctgaagcagaacggcagaaacggcgagatcagagtggccttcgtgctgtacaacaacctgggcccctacctgagcaccgagaacgccagcatgaagctgggcaccgaggccctgagcaccaaccacagcgtgatcgtgaacagccccgtgatcaccgccgccatcaacaaggagttcagcaacaaggtgtacctggccgaccccgtggtgttcaccgtgaagcacatcaagcagagcgaggagaacttcaaccccaactgcagcttctggagctacagcaagagaaccatgaccggctactggagcacccagggctgcagactgctgaccaccaacaagacccacaccacctgcagctgcaaccacctgaccaacttcgccgtgctgatggcccacgtggaggtgaagcacagcgacgccgtgcacgacctgctgctggacgtgatcacctgggtgggcatcctgctgagcctggtgtgcctgctgatctgcatcttcaccttctgcttcttcagaggcctgcagagcgacagaaacaccatccacaagaacctgtgcatcagcctgttcgtggccgagctgctgttcctgatcggcatcaacagaaccgaccagcccatcgcctgcgccgtgttcgccgccctgctgcacttcttcttcctggccgccttcacctggatgttcctggagggcgtgcagctgtacatcatgctggtggaggtgttcgagagcgagcacagcagaagaaagtacttctacctggtgggctacggcatgcccgccctgatcgtggccgtgagcgccgccgtggactacagaagctacggcaccgacaaggtgtgctggctgagactggacacctacttcatctggagcttcatcggccccgccaccctgatcatcatgctgaacgtgatcttcctgggcatcgccctgtacaagatgttccaccacaccgccatcctgaagcccgagagcggctgcctggacaacatcaagagctgggtgatcggcgccatcgccctgctgtgcctgctgggcctgacctgggccttcggcctgatgtacatcaacgagagcaccgtgatcatggcctacctgttcaccatcttcaacagcctgcagggcatgttcatcttcatcttccactgcgtgctgcagaagaaggtgagaaaggagtacggcaagtgcctgagaacccactgctgcagcggcaagagcaccgagagcagcatcggcagcggcaagaccagcggcagcagaacccccggcagatacagcaccggcagccagagcagaatcagaagaatgtggaacgacaccgtgagaaagcagagcgagagcagcttcatcaccggcgacatcaacagcagcgccagcctgaacagaggcgccatggccaaccacctgatcagcaacgccctgctgagaccccacggcaccaacaacccctacaacaccctgctgggcgagcccgccgtgtgcaacaaccccagcgtgagcatgtacaacgcccaggagggcctgctgaacaacgccagagacaccagcgtgatggacaccctgcccctgaacggcaaccacggcaacagctacagcatcgccagcggcgagtacctgagcaactgcgtgcagatcatcgacagaggctacaaccacaacgagaccgccctggagaagaagatcctgaaggagctgaccagcaactacatccccagctacctgaacaaccacgagagaagcagcgagcagaacagaaacctgatgaacaagctggtgaacaacctgggcagcggcagagaggacgacgccatcgtgctggacgacgccaccagcttcaaccacgaggagagcctgggcctggagctgatccacgaggagagcgacgcccccctgctgccccccagagtgtacagcaccgagaaccaccagccccaccactacaccagaagaagaatcccccaggaccacagcgagagcttcttccccctgctgaccaacgagcacaccgaggacctgcagagcccccacagagacagcctgtacaccagcatgcccaccctggccggcgtggccgccaccgagagcgtgaccaccagcacccagaccgagcccccccccgccaagtgcggcgacgccgaggacgtgtactacaagagcatgcccaacctgggcagcagaaaccacgtgcaccagctgcacacctactaccagctgggcagaggcagcagcgacggcttcatcgtgccccccaacaaggacggcaccccccccgagggcagcagcaagggccccgcccacctggtgaccagcctgtag

SEQ ID NO: 19016 - DNA, 2124 bp, Artificial Sequence
  Description of Artificial Sequence: Synthetic coding sequence
atgtggcccagccagctgctgatcttcatgatgctgctggcccccatcatccacgccttcagcagagcccccatccccatggccgtggtgagaagagagctgagctgcgagagctaccccatcgagctgagatgccccggcaccgacgtgatcatgatcgagagcgccaactacggcagaaccgacgacaagatctgcgacagcgaccccgcccagatggagaacatcagatgctacctgcccgacgcctacaagatcatgagccagagatgcaacaacagaacccagtgcgccgtggtggccggccccgacgtgttccccgacccctgccccggcacctacaagtacctggaggtgcagtacgagtgcgtgccctacagagtggaccagaaggtgttcctgtgccccggcctgctgaagggcgtgtaccagagcgagcacctgttcgagagcgaccaccagagcggcgcctggtgcaaggaccccctgcaggccagcgacaagatctactacatgccctggaccccctacagaaccgacaccctgaccgagtacagcagcaaggacgacttcatcgccggcagacccaccaccacctacaagctgccccacagagtggacggcaccggcttcgtggtgtacgacggcgccctgttcttcaacaaggagagaaccagaaacatcgtgaagttcgacctgagaaccagaatcaagagcggcgaggccatcatcgccaacgccaactaccacgacaccagcccctacagatggggcggcaagagcgacatcgacctggccgtggacgagaacggcctgtgggtgatctacgccaccgagcagaacaacggcaagatcgtgatcagccagctgaacccctacaccctgagaatcgagggcacctgggacaccgcctacgacaagagaagcgccagcaacgccttcatgatctgcggcatcctgtacgtggtgaagagcgtgtacgaggacgacgacaacgaggccaccggcaacaagatcgactacatctacaacaccgaccagagcaaggacagcctggtggacgtgcccttccccaacagctaccagtacatcgccgccgtggactacaaccccagagacaacctgctgtacgtgtggaacaactaccacgtggtgaagtacagcctggacttcggccccctggacagcagaagcggccaggcccaccacggccaggtgagctacatcagcccccccatccacctggacagcgagctggagagacccagcgtgaaggacatcagcaccaccggccccctgggcatgggcagcaccaccaccagcaccaccctgagaaccaccaccctgagccccggcagaagcaccacccccagcgtgagcggcagaagaaacagaagcaccagcacccccagccccgccgtggaggtgctggacgacatgaccacccacctgcccagcgccagcagccagatccccgccctggaggagagctgcgaggccgtggaggccagagagatcatgtggttcaagaccagacagggccagatcgccaagcagccctgccccgccggcaccatcggcgtgagcacctacctgtgcctggcccccgacggcatctgggacccccagggccccgacctgagcaactgcagcagcccctgggtgaaccacatcacccagaagctgaagagcggcgagaccgccgccaacatcgccagagagctggccgagcagaccagaaaccacctgaacgccggcgacatcacctacagcgtgagagccatggaccagctggtgggcctgctggacgtgcagctgagaaacctgacccccggcggcaaggacagcgccgccagaagcctgaacaaggccatggtggagaccgtgaacaacctgctgcagccccaggccctgaacgcctggagagacctgaccaccagcgaccagctgagagccgccaccatgctgctgcacaccgtggaggagagcgccttcgtgctggtgctgcaggtgtgcctgcccgtgagagagcagagcttcctgcccttcttcagcttcttcatcttcttcttcagcttcctgcccttcatccccctgaagttcagactggccaagaacaagtag

SEQ ID NO: 19017 - DNA, 4410 bp, Artificial Sequence; identical to SEQ ID NO: 19014
  Description of Artificial Sequence: Synthetic coding sequence

SEQ ID NO: 19018 - DNA, 1125 bp, Artificial Sequence
  Description of Artificial Sequence: Synthetic coding sequence
atgagacccggcaccgccctgcaggccgtgctgctggccgtgctgctggtgggcctgagagccgccaccggcagactgctgagcggccagcccgtgtgcagaggcggcacccagagaccctgctacaaggtgatctacttccacgacaccagcagaagactgaacttcgaggaggccaaggaggcctgcagaagagacggcggccagctggtgagcatcgagagcgaggacgagcagaagctgatcgagaagttcatcgagaacctgctgcccagcgacggcgacttctggatcggcctgagaagaagagaggagaagcagagcaacagcaccgcctgccaggacctgtacgcctggaccgacggcagcatcagccagttcagaaactggtacgtggacgagcccagctgcggcagcgaggtgtgcgtggtgatgtaccaccagcccagcgcccccgccggcatcggcggcccctacatgttccagtggaacgacgacagatgcaacatgaagaacaacttcatctgcaagtacagcgacgagaagcccgccgtgcccagcagagaggccgagggcgaggagaccgagctgaccacccccgtgctgcccgaggagacccaggaggaggacgccaagaagaccttcaaggagagcagagaggccgccctgaacctggcctacatcctgatccccagcatccccctgctgctgctgctggtggtgaccaccgtggtgtgctgggtgtggatctgcagaaagagaaagagagagcagcccgaccccagcaccaagaagcagcacaccatctggcccagcccccaccagggcaacagccccgacctggaggtgtacaacgtgatcagaaagcagagcgaggccgacctggccgagaccagacccgacctgaagaacatcagcttcagagtgtgcagcggcgaggccacccccgacgacatgagctgcgactacgacaacatggccgtgaaccccagcgagagcggcttcgtgaccctggtgagcgtggagagcggcttcgtgaccaacgacatctacgagttcagccccgaccagatgggcagaagcaaggagagcggctgggtggagaacgagatctacggctactag

SEQ ID NO: 19019 - DNA, 1149 bp, Artificial Sequence
  Description of Artificial Sequence: Synthetic coding sequence
atgagacccggcaccgccctgcaggccgtgctgctggccgtgctgctggtgggcctgagagccgccaccggcagactgctgagcgccagcgacctggacctgagaggcggccagcccgtgtgcagaggcggcacccagagaccctgctacaaggtgatctacttccacgacaccagcagaagactgaacttcgaggaggccaaggaggcctgcagaagagacggcggccagctggtgagcatcgagagcgaggacgagcagaagctgatcgagaagttcatcgagaacctgctgcccagcgacggcgacttctggatcggcctgagaagaagagaggagaagcagagcaacagcaccgcctgccaggacctgtacgcctggaccgacggcagcatcagccagttcagaaactggtacgtggacgagcccagctgcggcagcgaggtgtgcgtggtgatgtaccaccagcccagcgcccccgccggcatcggcggcccctacatgttccagtggaacgacgacagatgcaacatgaagaacaacttcatctgcaagtacagcgacgagaagcccgccgtgcccagcagagaggccgagggcgaggagaccgagctgaccacccccgtgctgcccgaggagacccaggaggaggacgccaagaagaccttcaaggagagcagagaggccgccctgaacctggcctacatcctgatccccagcatccccctgctgctgctgctggtggtgaccaccgtggtgtgctgggtgtggatctgcagaaagagaaagagagagcagcccgaccccagcaccaagaagcagcacaccatctggcccagcccccaccagggcaacagccccgacctggaggtgtacaacgtgatcagaaagcagagcgaggccgacctggccgagaccagacccgacctgaagaacatcagcttcagagtgtgcagcggcgaggccacccccgacgacatgagctgcgactacgacaacatggccgtgaaccccagcgagagcggcttcgtgaccctggtgagcgtggagagcggcttcgtgaccaacgacatctacgagttcagccccgaccagatgggcagaagcaaggagagcggctgggtggagaacgagatctacggctactag

SEQ ID NO: 19020 - DNA, 690 bp, Artificial Sequence
  Description of Artificial Sequence: Synthetic coding sequence
atggtgaccagcggcctgggcagcggcggcgtgagaagaaacaaggccatcgcccagcccgccagaaccttcatgctgggcctgatggccgcctaccacaacctggagaagcccgccgtgcccagcagagaggccgagggcgaggagaccgagctgaccacccccgtgctgcccgaggagacccaggaggaggacgccaagaagaccttcaaggagagcagagaggccgccctgaacctggcctacatcctgatccccagcatccccctgctgctgctgctggtggtgaccaccgtggtgtgctgggtgtggatctgcagaaagagaaagagagagcagcccgaccccagcaccaagaagcagcacaccatctggcccagcccccaccagggcaacagccccgacctggaggtgtacaacgtgatcagaaagcagagcgaggccgacctggccgagaccagacccgacctgaagaacatcagcttcagagtgtgcagcggcgaggccacccccgacgacatgagctgcgactacgacaacatggccgtgaaccccagcgagagcggcttcgtgaccctggtgagcgtggagagcggcttcgtgaccaacgacatctacgagttcagccccgaccagatgggcagaagcaaggagagcggctgggtggagaacgagatctacggctactag

SEQ ID NO: 19021 - DNA, 1014 bp, Artificial Sequence
  Description of Artificial Sequence: Synthetic coding sequence
atgagacccggcaccgccctgcaggccgtgctgctggccgtgctgctggtgggcctgagagccgccaccggcagactgctgagcggccagcccgtgtgcagaggcggcacccagagaccctgctacaaggtgatctacttccacgacaccagcagaagactgaacttcgaggaggccaaggaggcctgcagaagaagagaggagaagcagagcaacagcaccgcctgccaggacctgtacgcctggaccgacggcagcatcagccagttcagaaactggtacgtggacgagcccagctgcggcagcgaggtgtgcgtggtgatgtaccaccagcccagcgcccccgccggcatcggcggcccctacatgttccagtggaacgacgacagatgcaacatgaagaacaacttcatctgcaagtacagcgacgagaagcccgccgtgcccagcagagaggccgagggcgaggagaccgagctgaccacccccgtgctgcccgaggagacccaggaggaggacgccaagaagaccttcaaggagagcagagaggccgccctgaacctggcctacatcctgatccccagcatccccctgctgctgctgctggtggtgaccaccgtggtgtgctgggtgtggatctgcagaaagagaaagagagagcagcccgaccccagcaccaagaagcagcacaccatctggcccagcccccaccagggcaacagccccgacctggaggtgtacaacgtgatcagaaagcagagcgaggccgacctggccgagaccagacccgacctgaagaacatcagcttcagagtgtgcagcggcgaggccacccccgacgacatgagctgcgactacgacaacatggccgtgaaccccagcgagagcggcttcgtgaccctggtgagcgtggagagcggcttcgtgaccaacgacatctacgagttcagccccgaccagatgggcagaagcaaggagagcggctgggtggagaacgagatctacggctactag

SEQ ID NO: 19022 - DNA, 405 bp, Artificial Sequence
  Description of Artificial Sequence: Synthetic coding sequence
atgagacccggcaccgccctgcaggccgtgctgctggccgtgctgctggtgggcctgagagccgccaccggcagactgctgagcggccagcccgtgtgcagaggcggcacccagagaccctgctacaaggtgatctacttccacgacaccagcagaagactgaacttcgaggaggccaaggaggcctgcagaagagacggcggccagctggtgagcatcgagagcgaggacgagcagaagctgatcgagaagttcatcgagaacctgctgcccagcgacggcgacttctggatcggcctgagaagaagagaggagaagcagagcaacagcaccgcctgccaggacctgtacgcctggaccgacggcagcatcagccagttcagagagaccagcagcagcttctag

SEQ ID NO: 19023 - DNA, 1071 bp, Artificial Sequence
  Description of Artificial Sequence: Synthetic coding sequence
atggccgccgagggctggatctggagatggggctggggcagaagatgcctgggcagacccggcctgctgggccccggccccggccccaccacccccctgttcctgctgctgctgctgggcagcgtgaccgccgacatcaccgacggcaacagcgagcacctgaagagagagcacagcctgatcaagccctaccagggcgtgggcagcagcagcatgcccctgtgggacttccagggcagcaccatgctgaccagccagtacgtgagactgacccccgacgagagaagcaaggagggcagcatctggaaccaccagccctgcttcctgaaggactgggagatgcacgtgcacttcaaggtgcacggcaccggcaagaagaacctgcacggcgacggcatcgccctgtggtacaccagagacagactggtgcccggccccgtgttcggcagcaaggacaacttccacggcctggccatcttcctggacacctaccccaacgacgagaccaccgagagagtgttcccctacatcagcgtgatggtgaacaacggcagcctgagctacgaccacagcaaggacggcagatggaccgagctggccggctgcaccgccgacttcagaaacagagaccacgacaccttcctggccgtgagatacagcagaggcagactgaccgtgatgaccgacctggaggacaagaacgagtggaagaactgcatcgacatcaccggcgtgagactgcccaccggctactacttcggcgccagcgccggcaccggcgacctgagcgacaaccacgacatcatcagcatgaagctgttccagctgatggtggagcacacccccgacgaggagagcatcgactggaccaagatcgagcccagcgtgaacttcctgaagagccccaaggacaacgtggacgaccccaccggcaacttcagaagcggccccctgaccggctggagagtgttcctgctgctgctgtgcgccctgctgggcatcgtggtgtgcgccgtggtgggcgccgtggtgttccagaagagacaggagagaaacaagagattctactag

SEQ ID NO: 19024 - DNA, 858 bp, Artificial Sequence
  Description of Artificial Sequence: Synthetic coding sequence
atgcccctgtgggacttccagggcagcaccatgctgaccagccagtacgtgagactgacccccgacgagagaagcaaggagggcagcatctggaaccaccagccctgcttcctgaaggactgggagatgcacgtgcacttcaaggtgcacggcaccggcaagaagaacctgcacggcgacggcatcgccctgtggtacaccagagacagactggtgcccggccccgtgttcggcagcaaggacaacttccacggcctggccatcttcctggacacctaccccaacgacgagaccaccgagagagtgttcccctacatcagcgtgatggtgaacaacggcagcctgagctacgaccacagcaaggacggcagatggaccgagctggccggctgcaccgccgacttcagaaacagagaccacgacaccttcctggccgtgagatacagcagaggcagactgaccgtgatgaccgacctggaggacaagaacgagtggaagaactgcatcgacatcaccggcgtgagactgcccaccggctactacttcggcgccagcgccggcaccggcgacctgagcgacaaccacgacatcatcagcatgaagctgttccagctgatggtggagcacacccccgacgaggagagcatcgactggaccaagatcgagcccagcgtgaacttcctgaagagccccaaggacaacgtggacgaccccaccggcaacttcagaagcggccccctgaccggctggagagtgttcctgctgctgctgtgcgccctgctgggcatcgtggtgtgcgccgtggtgggcgccgtggtgttccagaagagacaggagagaaacaagagattctactag

SEQ ID NO: 19025 - DNA, 1047 bp, Artificial Sequence
  Description of Artificial Sequence: Synthetic coding sequence
atggccgccaccctgggccccctgggcagctggcagcagtggagaagatgcctgagcgccagagacggcagcagaatgctgctgctgctgctgctgctgggcagcggccagggcccccagcaggtgggcgccggccagaccttcgagtacctgaagagagagcacagcctgagcaagccctaccagggcgtgggcaccggcagcagcagcctgtggaacctgatgggcaacgccatggtgatgacccagtacatcagactgacccccgacatgcagagcaagcagggcgccctgtggaacagagtgccctgcttcctgagagactgggagctgcaggtgcacttcaagatccacggccagggcaagaagaacctgcacggcgacggcctggccatctggtacaccaaggacagaatgcagcccggccccgtgttcggcaacatggacaagttcgtgggcctgggcgtgttcgtggacacctaccccaacgaggagaagcagcaggagagagtgttcccctacatcagcgccatggtgaacaacggcagcctgagctacgaccacgagagagacggcagacccaccgagctgggcggctgcaccgccatcgtgagaaacctgcactacgacaccttcctggtgatcagatacgtgaagagacacctgaccatcatgatggacatcgacggcaagcacgagtggagagactgcatcgaggtgcccggcgtgagactgcccagaggctactacttcggcaccagcagcatcaccggcgacctgagcgacaaccacgacgtgatcagcctgaagctgttcgagctgaccgtggagagaacccccgaggaggagaagctgcacagagacgtgttcctgcccagcgtggacaacatgaagctgcccgagatgaccgcccccctgccccccctgagcggcctggccctgttcctgatcgtgttcttcagcctggtgttcagcgtgttcgccatcgtgatcggcatcatcctgtacaacaagtggcaggagcagagcagaaagagattctactag

SEQ ID NO: 19026 - DNA, 1080 bp, Artificial Sequence
  Description of Artificial Sequence: Synthetic coding sequence
atggccgccaccctgggccccctgggcagctggcagcagtggagaagatgcctgagcgccagagacggcagcagaatgctgctgctgctgctgctgctgggcagcggccagggcccccagcaggtgggcgccggccagaccttcgagtacctgaagagagagcacagcctgagcaagccctaccagggcgtgggcaccggcagcagcagcctgtggaacctgatgggcaacgccatggtgatgacccagtacatcagactgacccccgacatgcagagcaagcagggcgccctgtggaacagagtgccctgcttcctgagagactgggagctgcaggtgcacttcaagatccacggccagggcaagaagaacctgcacggcgacggcctggccatctggtacaccaaggacagaatgcagcccggccccgtgttcggcaacatggacaagttcgtgggcctgggcgtgttcgtggacacctaccccaacgaggagaagcagcaggaggcccagaagagaagatacagccccggcgtgcagagagtgttcccctacatcagcgccatggtgaacaacggcagcctgagctacgaccacgagagagacggcagacccaccgagctgggcggctgcaccgccatcgtgagaaacctgcactacgacaccttcctggtgatcagatacgtgaagagacacctgaccatcatgatggacatcgacggcaagcacgagtggagagactgcatcgaggtgcccggcgtgagactgcccagaggctactacttcggcaccagcagcatcaccggcgacctgagcgacaaccacgacgtgatcagcctgaagctgttcgagctgaccgtggagagaacccccgaggaggagaagctgcacagagacgtgttcctgcccagcgtggacaacatgaagctgcccgagatgaccgcccccctgccccccctgagcggcctggccctgttcctgatcgtgttcttcagcctggtgttcagcgtgttcgccatcgtgatcggcatcatcctgtacaacaagtggcaggagcagagcagaaagagattctactag

SEQ ID NO: 19027 - DNA, 645 bp, Artificial Sequence
  Description of Artificial Sequence: Synthetic coding sequence
atggacaaggagagaagaatctgcatgggcatggcctggcagagcggcacccagagaatcggctgcagccaggcccagaagagaagatacagccccggcgtgcagagagtgttcccctacatcagcgccatggtgaacaacggcagcctgagctacgaccacgagagagacggcagacccaccgagctgggcggctgcaccgccatcgtgagaaacctgcactacgacaccttcctggtgatcagatacgtgaagagacacctgaccatcatgatggacatcgacggcaagcacgagtggagagactgcatcgaggtgcccggcgtgagactgcccagaggctactacttcggcaccagcagcatcaccggcgacctgagcgacaaccacgacgtgatcagcctgaagctgttcgagctgaccgtggagagaacccccgaggaggagaagctgcacagagacgtgttcctgcccagcgtggacaacatgaagctgcccgagatgaccgcccccctgccccccctgagcggcctggccctgttcctgatcgtgttcttcagcctggtgttcagcgtgttcgccatcgtgatcggcatcatcctgtacaacaagtggcaggagcagagcagaaagagattctactag

SEQ ID NO: 19028 - DNA, 612 bp, Artificial Sequence
  Description of Artificial Sequence: Synthetic coding sequence
atggacaaggagagaagaatctgcatgggcatggcctggcagagcggcacccagagaatcggctgcagccagagagtgttcccctacatcagcgccatggtgaacaacggcagcctgagctacgaccacgagagagacggcagacccaccgagctgggcggctgcaccgccatcgtgagaaacctgcactacgacaccttcctggtgatcagatacgtgaagagacacctgaccatcatgatggacatcgacggcaagcacgagtggagagactgcatcgaggtgcccggcgtgagactgcccagaggctactacttcggcaccagcagcatcaccggcgacctgagcgacaaccacgacgtgatcagcctgaagctgttcgagctgaccgtggagagaacccccgaggaggagaagctgcacagagacgtgttcctgcccagcgtggacaacatgaagctgcccgagatgaccgcccccctgccccccctgagcggcctggccctgttcctgatcgtgttcttcagcctggtgttcagcgtgttcgccatcgtgatcggcatcatcctgtacaacaagtggcaggagcagagcagaaagagattctactag

SEQ ID NO: 19029 - DNA, 633 bp, Artificial Sequence
  Description of Artificial Sequence: Synthetic coding sequence
atgcagcccggccccgtgttcggcaacatggacaagttcgtgggcctgggcgtgttcgtggacacctaccccaacgaggagaagcagcaggagagagtgttcccctacatcagcgccatggtgaacaacggcagcctgagctacgaccacgagagagacggcagacccaccgagctgggcggctgcaccgccatcgtgagaaacctgcactacgacaccttcctggtgatcagatacgtgaagagacacctgaccatcatgatggacatcgacggcaagcacgagtggagagactgcatcgaggtgcccggcgtgagactgcccagaggctactacttcggcaccagcagcatcaccggcgacctgagcgacaaccacgacgtgatcagcctgaagctgttcgagctgaccgtggagagaacccccgaggaggagaagctgcacagagacgtgttcctgcccagcgtggacaacatgaagctgcccgagatgaccgcccccctgccccccctgagcggcctggccctgttcctgatcgtgttcttcagcctggtgttcagcgtgttcgccatcgtgatcggcatcatcctgtacaacaagtggcaggagcagagcagaaagagattctactag

SEQ ID NO: 19030 - DNA, 1581 bp, Artificial Sequence
  Description of Artificial Sequence: Synthetic coding sequence
atgcccgccgtgagcggccccggccccctgttctgcctgctgctgctgctgctggacccccacagccccgagaccggctgcccccccctgagaagattcgagtacaagctgagcttcaagggccccagactggccctgcccggcgccggcatccccttctggagccaccacggcgacgccatcctgggcctggaggaggtgagactgacccccagcatgagaaacagaagcggcgccgtgtggagcagagccagcgtgcccttcagcgcctgggaggtggaggtgcagatgagagtgaccggcctgggcagaagaggcgcccagggcatggccgtgtggtacaccagaggcagaggccacgtgggcagcgtgctgggcggcctggccagctgggacggcatcggcatcttcttcgacagccccgccgaggacacccaggacagccccgccatcagagtgctggccagcgacggccacatccccagcgagcagcccggcgacggcgccagccagggcctgggcagctgccactgggacttcagaaacagaccccaccccttcagagccagaatcacctactggggccagagactgagaatgagcctgaacagcggcctgacccccagcgaccccggcgagttctgcgtggacgtgggccccctgctgctggtgcccggcggcttcttcggcgtgagcgccgccaccggcaccctggccgacgaccacgacgtgctgagcttcctgaccttcagcctgagcgagcccagccccgaggtgcccccccagcccttcctggagatgcagcagctgagactggccagacagctggagggcctgtgggccagactgggcctgggcaccagagaggacgtgacccccaagagcgacagcgaggcccagggcgagggcgagagactgttcgacctggaggagaccctgggcagacacagaagaatcctgcaggccctgagaggcctgagcaagcagctggcccaggccgagagacagtggaagaagcagctgggcccccccggccaggccagacccgacggcggctgggccctggacgccagctgccagatccccagcacccccggcagaggcggccacctgagcatgagcctgaacaaggacagcgccaaggtgggcgccctgctgcacggccagtggaccctgctgcaggccctgcaggagatgagagacgccgccgtgagaatggccgccgaggcccaggtgagctacctgcccgtgggcatcgagcaccacttcctggagctggaccacatcctgggcctgctgcaggaggagctgagaggccccgccaaggccgccgccaaggcccccagaccccccggccagccccccagagccagcagctgcctgcagcccggcatcttcctgttctacctgctgatccagaccgtgggcttcttcggctacgtgcacttcagacaggagctgaacaagagcctgcaggagtgcctgagcaccggcagcctgcccctgggccccgccccccacacccccagagccctgggcatcctgagaagacagcccctgcccgccagcatgcccgcctag

SEQ ID NO: 19031 - DNA, 1545 bp, Artificial Sequence
  Description of Artificial Sequence: Synthetic coding sequence
atgcccgccgtgagcggccccggccccctgttctgcctgctgctgctgctgctggacccccacagccccgagaccggctgcccccccctgagaagattcgagtacaagctgagcttcaagggccccagactggccctgcccggcgccggcatccccttctggagccaccacggcgacgccatcctgggcctggaggaggtgagactgacccccagcatgagaaacagaagcggcgccgtgtggagcagagccagcgtgcccttcagcgcctgggaggtggaggtgcagatgagagtgaccggcctgggcagaagaggcgcccagggcatggccgtgtggtacaccagaggcagaggccacgtgggcagcgtgctgggcggcctggccagctgggacggcatcggcatcttcttcgacagccccgccgaggacacccaggacagccccgccatcagagtgctggccagcgacggccacatccccagcgagcagcccggcgacggcgccagccagggcctgggcagctgccactgggacttcagaaacagaccccaccccttcagagccagaatcacctactggggccagagactgagaatgagcctgaacagcggcctgacccccagcgaccccggcgagttctgcgtggacgtgggccccctgctgctggtgcccggcggcttcttcggcgtgagcgccgccaccggcaccctggccggcgaggaccccaccggccaggtgcccccccagcccttcctggagatgcagcagctgagactggccagacagctggagggcctgtgggccagactgggcctgggcaccagagaggacgtgacccccaagagcgacagcgaggcccagggcgagggcgagagactgttcgacctggaggagaccctgggcagacacagaagaatcctgcaggccctgagaggcctgagcaagcagctggcccaggccgagagacagtggaagaagcagctgggcccccccggccaggccagacccgacggcggctgggccctggacgccagctgccagatccccagcacccccggcagaggcggccacctgagcatgagcctgaacaaggacagcgccaaggtgggcgccctgctgcacggccagtggaccctgctgcaggccctgcaggagatgagagacgccgccgtgagaatggccgccgaggcccaggtgagctacctgcccgtgggcatcgagcaccacttcctggagctggaccacatcctgggcctgctgcaggaggagctgagaggccccgccaaggccgccgccaaggcccccagaccccccggccagccccccagagccagcagctgcctgcagcccggcatcttcctgttctacctgctgatccagaccgtgggcttcttcggctacgtgcacttcagacaggagctgaacaagagcctgcaggagtgcctgagcaccggcagcctgcccctgggccccgccccccacacccccagagccctgggcatcctgagaagacagcccctgcccgccagcatgcccgcctag

SEQ ID NO: 19032 - DNA, 435 bp, Artificial Sequence
  Description of Artificial Sequence: Synthetic coding sequence
atgagaaacagaagcggcgccgtgtggagcagagccagcgtgcccttcagcgcctgggaggtggaggtgcagatgagagtgaccggcctgggcagaagaggcgcccagggcatggacagccccgccatcagagtgctggccagcgacggccacatccccagcgagcagcccggcgacggcgccagccagggcctgggcagctgccactgggacttcagaaacagaccccaccccttcagagccagaatcacctactggggccagagactgagaatgagcctgaacagcggcctgacccccagcgaccccggcgagttctgcgtggacgtgggccccctgctgctggtgcccggcggcttcttcggcgtgagcgccgccaccggcaccctggccggcgaggaccccaccggccaggtgagagccgagggccagtag

SEQ ID NO: 19033 - DNA, 204 bp, Artificial Sequence
  Description of Artificial Sequence: Synthetic coding sequence
atggtggacgtgaagtgcctgagcgactgcaagctgcagaaccagctggagaagctgggcttcagccccggccccatcctgagaggcctgcaggagcaccaggcccccgagagccacatgggcctgagccccaagagagagaccaccgccagaaagaccagactgagcagagccggcgagaagaaggtgagccagtgggcctag

SEQ ID NO: 19034 - DNA, 423 bp, Artificial Sequence
  Description of Artificial Sequence: Synthetic coding sequence
atggtggacgtgaagtgcctgagcgactgcaagctgcagaaccagctggagaagctgggcttcagccccggccccatcctgcagctgaacatcatcctgcagggcaacatcatcctgagcaccgagaagagcaagaagctgaagaagtggcccgaggccagcaccaccaagagaaaggccgtggacacctactgcctggactacaagcccagcaagggcagaagatgggccgccagagcccccagcaccagaatcacctacggcaccatcaccaaggagagagactactgcgccgaggaccagaccatcgagagctggagagaggagggcttccccgtgggcctgaagctggccgtgctgggcatcttcatcatcgtggtgttcgtgtacctgaccgtggagaacaagagcctgttcggctag

SEQ ID NO: 19035 - DNA, 423 bp, Artificial Sequence; identical to SEQ ID NO: 19034
  Description of Artificial Sequence: Synthetic coding sequence

SEQ ID NO: 19036 - DNA, 546 bp, Artificial Sequence
  Description of Artificial Sequence: Synthetic coding sequence
atggtggacgtgaagtgcctgagcgactgcaagctgcagaaccagctggagaagctgggcttcagccccggccccatcctgcccagcaccagaaagctgtacgagaagaagctggtgcagctgctggtgagccccccctgcgccccccccgtgatgaacggccccagagagctggacggcgcccaggacagcgacgacagcgaggagctgaacatcatcctgcagggcaacatcatcctgagcaccgagaagagcaagaagctgaagaagtggcccgaggccagcaccaccaagagaaaggccgtggacacctactgcctggactacaagcccagcaagggcagaagatgggccgccagagcccccagcaccagaatcacctacggcaccatcaccaaggagagagactactgcgccgaggaccagaccatcgagagctggagagaggagggcttccccgtgggcctgaagctggccgtgctgggcatcttcatcatcgtggtgttcgtgtacctgaccgtggagaacaagagcctgttcggctag

SEQ ID NO: 19037 - DNA, 327 bp, Artificial Sequence
  Description of Artificial Sequence: Synthetic coding sequence
atggtggacgtgaagtgcctgagcgactgcaagctgcagaaccagctggagaagctgggcttcagccccggccccatcctgcccagcaccagaaagctgtacgagaagaagctggtgcagctgctggtgagccccccctgcgccccccccgtgatgaacggccccagagagctggacggcgcccaggacagcgacgacagcgagggcggcctgcaggagcaccaggcccccgagagccacatgggcctgagccccaagagagagaccaccgccagaaagaccagactgagcagagccggcgagaagaaggtgagccagtgggcctag

SEQ ID NO: 19038 - DNA, 327 bp, Artificial Sequence; identical to SEQ ID NO: 19037
  Description of Artificial Sequence: Synthetic coding sequence

SEQ ID NO: 19039 - DNA, 1512 bp, Artificial Sequence
  Description of Artificial Sequence: Synthetic coding sequence
atggccggcctgagcgacctggagctgagaagagagctgcaggccctgggcttccagcccggccccatcaccgacaccaccagagacgtgtacagaaacaagctgagaagactgagaggcgaggccagactgagagacgaggagagactgagagaggaggccagacccagaggcgaggagagactgagagaggaggccagactgagagaggacgcccccctgagagccagacccgccgccgccagccccagagccgagccctggctgagccagcccgccagcggcagcgcctacgccacccccggcgcctacggcgacatcagacccagcgccgccagctgggtgggcagcagaggcctggcctaccccgccagacccgcccagctgagaagaagagccagcgtgagaggcagcagcgaggaggacgaggacgccagaacccccgacagagccacccagggccccggcctggccgccagaagatggtgggccgccagccccgcccccgccagactgcccagcagcctgctgggccccgaccccagacccggcctgagagccaccagagccggccccgccggcgccgccagagccagacccgaggtgggcagaagactggagagatggctgagcagactgctgctgtgggccagcctgggcctgctgctggtgttcctgggcatcctgtgggtgaagatgggcaagcccagcgccccccaggaggccgaggacaacatgaagctgctgcccgtggactgcgagagaaagaccgacgagttctgccaggccaagcagaaggccgccctgctggagctgctgcacgagctgtacaacttcctggccatccaggccggcaacttcgagtgcggcaaccccgagaacctgaagagcaagtgcatccccgtgatggaggcccaggagtacatcgccaacgtgaccagcagcagcagcgccaagttcgaggccgccctgacctggatcctgagcagcaacaaggacgtgggcatctggctgaagggcgaggaccagagcgagctggtgaccaccgtggacaaggtggtgtgcctggagagcgcccaccccagaatgggcgtgggctgcagactgagcagagccctgctgaccgccgtgaccaacgtgctgatcttcttctggtgcctggccttcctgtggggcctgctgatcctgctgaagtacagatggagaaagctggaggaggaggagcaggccatgtacgagatggtgaagaagatcatcgacgtggtgcaggaccactacgtggactgggagcaggacatggagagatacccctacgtgggcatcctgcacgtgagagacagcctgatccccccccagagcagaagaagaatgaagagagtgtgggacagagccgtggagttcctggccagcaacgagagcagaatccagaccgagagccacagagtggccggcgaggacatgctggtgtggagatggaccaagcccagcagcttcagcgacagcgagagatag

SEQ ID NO: 19040 - DNA, 606 bp, Artificial Sequence
  Description of Artificial Sequence: Synthetic coding sequence
atggaggcccaggagtacatcgccaacgtgaccagcagcagcagcgccaagttcgaggccgccctgacctggatcctgagcagcaacaaggacgtgggcatctggctgaagggcgaggaccagagcgagctggtgaccaccgtggacaaggtggtgtgcctggagagcgcccaccccagaatgggcgtgggctgcagactgagcagagccctgctgaccgccgtgaccaacgtgctgatcttcttctggtgcctggccttcctgtggggcctgctgatcctgctgaagtacagatggagaaagctggaggaggaggagcaggccatgtacgagatggtgaagaagatcatcgacgtggtgcaggaccactacgtggactgggagcaggacatggagagatacccctacgtgggcatcctgcacgtgagagacagcctgatccccccccagagcagaagaagaatgaagagagtgtgggacagagccgtggagttcctggccagcaacgagagcagaatccagaccgagagccacagagtggccggcgaggacatgctggtgtggagatggaccaagcccagcagcttcagcgacagcgagagatag

SEQ ID NO: 19041 - DNA, 165 bp, Artificial Sequence
  Description of Artificial Sequence: Synthetic coding sequence
atggaggcccaggagtacatcgccaacgtgaccagcagcagcagcgccaagttcgaggccgccctgacctggatcctgagcagcaacaaggacgtgggcatctggctgaagggcgaggaccagagcgagctggtgaccaccgtggacaaggtggtgtgcctgtag

SEQ ID NO: 19042 - DNA, 4470 bp, Artificial Sequence
  Description of Artificial Sequence: Synthetic coding sequence
atgagacaggtgctgtggctgtgcaacgtgtgcgtgaccgccagagagaccagacaccacctgcacctgcccgccatcctggacaagatgcccgcccccggcgccctgatcctgctggccgccgtgagcgccagcggctgcctggccagccccgcccaccccgacggcttcgccctgggcagagcccccctggcccccccctacgccgtggtgctgatcagctgcagcggcctgctggccttcatcttcctgctgctgacctgcctgtgctgcaagagaggcgacgtgggcttcaaggagttcgagaaccccgagggcgaggactgcagcggcgagtacaccccccccgccgaggagaccagcagcagccagagcctgcccgacgtgtacatcctgcccctggccgaggtgagcctgcccatgcccgccccccagcccagccacagcgacatgaccacccccctgggcctgagcagacagcacctgagctacctgcaggagatcggcagcggctggttcggcaaggtgatcctgggcgagatcttcagcgactacacccccgcccaggtggtggtgaaggagctgagagccagcgccggccccctggagcagagaaagttcatcagcgaggcccagccctacagaagcctgcagcaccccaacgtgctgcagtgcctgggcctgtgcgtggagaccctgcccttcctgctgatcatggagttctgccagctgggcgacctgaagagatacctgagagcccagagaccccccgagggcctgagccccgagctgccccccagagacctgagaaccctgcagagaatgggcctggagatcgccagaggcctggcccacctgcacagccacaactacgtgcacagcgacctggccctgagaaactgcctgctgaccagcgacctgaccgtgagaatcggcgactacggcctggcccacagcaactacaaggaggactactacctgacccccgagagactgtggatccccctgagatgggccgcccccgagctgctgggcgagctgcacggcaccttcatggtggtggaccagagcagagagagcaacatctggagcctgggcgtgaccctgtgggagctgttcgagttcggcgcccagccctacagacacctgagcgacgaggaggtgctggccttcgtggtgagacagcagcacgtgaagctggccagacccagactgaagctgccctacgccgactactggtacgacatcctgcagagctgctggagaccccccgcccagagacccagcgccagcgacctgcagctgcagctgacctacctgctgagcgagagaccccccagaccccccccccccccccccccccccagagacggccccttcccctggccctggccccccgcccacagcgcccccagacccggcaccctgagcagccccttccccctgctggacggcttccccggcgccgaccccgacgacgtgctgaccgtgaccgagagcagcagaggcctgaacctggagtgcctgtgggagaaggccagaagaggcgccggcagaggcggcggcgcccccgcctggcagcccgccagcgccccccccgccccccacgccaaccccagcaaccccttctacgaggccctgagcacccccagcgtgctgcccgtgatcagcgccagaagccccagcgtgagcagcgagtactacatcagactggaggagcacggcagcccccccgagcccctgttccccaacgactgggaccccctggaccccggcgtgcccgccccccaggccccccaggcccccagcgaggtgccccagctggtgagcgagacctgggccagccccctgttccccgcccccagacccttccccgcccagagcagcgccagcggcagcttcctgctgagcggctgggaccccgagggcagaggcgccggcgagaccctggccggcgaccccgccgaggtgctgggcgagagaggcaccgccccctgggtggaggaggaggaggaggaggaggagggcagcagccccggcgaggacagcagcagcctgggcggcggccccagcagaagaggccccctgccctgccccctgtgcagcagagagggcgcctgcagctgcctgcccctggagagaggcgacgccgtggccggctggggcggccaccccgccctgggctgcccccacccccccgaggacgacagcagcctgagagccgagagaggcagcctggccgacctgcccatggccccccccgccagcgccccccccgagttcctggaccccctgatgggcgccgccgccccccagtaccccggcagaggccccccccccgccccccccccccccccccccccccccagagcccccgccgaccccgccgccagccccgacccccccagcgccgtggccagccccggcagcggcctgagcagccccggccccaagcccggcgacagcggctacgagaccgagacccccttcagccccgagggcgccttccccggcggcggcgccgccgaggaggagggcgtgcccagacccagagccccccccgagccccccgaccccggcgcccccagacccccccccgaccccggccccctgcccctgcccggccccagagagaagcccaccttcgtggtgcaggtgagcaccgagcagctgctgatgagcctgagagaggacgtgaccagaaacctgctgggcgagaagggcgccaccgccagagagaccggccccagaaaggccggcagaggccccggcaacagagagaaggtgcccggcctgaacagagaccccaccgtgctgggcaacggcaagcaggcccccagcctgagcctgcccgtgaacggcgtgaccgtgctggagaacggcgaccagagagcccccggcatcgaggagaaggccgccgagaacggcgccctgggcagccccgagagagaggagaaggtgctggagaacggcgagctgaccccccccagaagagaggagaaggccctggagaacggcgagctgagaagccccgaggccggcgagaaggtgctggtgaacggcggcctgaccccccccaagagcgaggacaaggtgagcgagaacggcggcctgagattccccagaaacaccgagagaccccccgagaccggcccctggagagcccccggcccctgggagaagacccccgagagctggggccccgcccccaccatcggcgagcccgcccccgagaccagcctggagagagcccccgcccccagcgccgtggtgagcagcagaaacggcggcgagaccgcccccggccccctgggccccgcccccaagaacggcaccctggagcccggcaccgagagaagagcccccgagaccggcggcgcccccagagcccccggcgccggcagactggacctgggcagcggcggcagagcccccgtgggcaccggcaccgcccccggcggcggccccggcagcggcgtggacgccaaggccggctgggtggacaacaccagaccccagcccccccccccccccctgccccccccccccgaggcccagcccagaagactggagcccgccccccccagagccagacccgaggtggcccccgagggcgagcccggcgcccccgacagcagagccggcggcgacaccgccctgagcggcgacggcgacccccccaagcccgagagaaagggccccgagatgcccagactgttcctggacctgggccccccccagggcaacagcgagcagatcaaggccagactgagcagactgagcctggccctgccccccctgaccctgacccccttccccggccccggccccagaagacccccctgggagggcgccgacgccggcgccgccggcggcgaggccggcggcgccggcgcccccggccccgccgaggaggacggcgaggacgaggacgaggacgaggaggaggacgaggaggccgccgcccccggcgccgccgccggccccagaggccccggcagagccagagccgcccccgtgcccgtggtggtgagcagcgccgacgccgacgccgccagacccctgagaggcctgctgaagagccccagaggcgccgacgagcccgaggacagcgagctggagagaaagagaaagatggtgagcttccacggcgacgtgaccgtgtacctgttcgaccaggagacccccaccaacgagctgagcgtgcaggccccccccgagggcgacaccgaccccagcaccccccccgccccccccacccccccccaccccgccacccccggcgacggcttccccagcaacgacagcggcttcggcggcagcttcgagtgggccgaggacttccccctgctgcccccccccggcccccccctgtgcttcagcagattcagcgtgagccccgccctggagacccccggcccccccgccagagcccccgacgccagacccgccggccccgtggagaactag

SEQ ID NO: 19043 - DNA, 1656 bp, Artificial Sequence
  Description of Artificial Sequence: Synthetic coding sequence
atgcacctgcagatgagagaggacatggccaagtacagaagaatgagcggcgtgagaccccagagcttcagagacctggagacccccccccactgggccgcctacgacaccggcctggagctgctgggcagacaggaggccggcctggccctgcccagactggaggaggccctgcagggcagcctggcccagatggagagctgcagagccgactgcgagggccccgaggagcagcagggcgccgaggaggaggaggacggcgccgccagccagggcggcctgtacgaggccatcgccggccactggatccaggtgctgcagtgcagacagagatgcgtgggcgagaccgccaccagacccggcagaagcttccccgtgcccgacttcctgcccaaccagctgagaagactgcacgaggcccacgcccaggtgggcaacctgagccaggccatcgagaacgtgctgagcgtgctgctgttctaccccgaggacgaggccgccaagagagccctgaaccagtaccaggcccagctgggcgagcccagacccggcctgggccccagagaggacatccagagattcatcctgagaagcctgggcgagaagagacagctgtactacgccatggagcacctgggcaccagcttcaaggaccccgacccctggacccccgccgccctgatccccgaggccctgagagagaagctgagagaggaccaggagaagagaccctgggaccacgagcccgtgaagcccaagcccctgacctactggaaggacgtgctgctgctggagggcgtgaccctgacccaggacagcagacagctgaacggcagcgagagagccgtgctggacggcctgctgacccccgccgagtgcggcgtgctgctgcagctggccaaggacgccgccggcgccggcgccagaagcggctacagaggcagaagaagcccccacaccccccacgagagattcgagggcctgaccgtgctgaaggccgcccagctggccagagccggcaccgtgggcagccagggcgccaagctgctgctggaggtgagcgagagagtgagaaccctgacccaggcctacttcagccccgagagacccctgcacctgagcttcacccacctggtgtgcagaagcgccatcgagggcgagcaggagcagagaatggacctgagccaccccgtgcacgccgacaactgcgtgctggaccccgacaccggcgagtgctggagagagccccccgcctacacctacagagactacagcggcctgctgtacctgaacgacgacttccagggcggcgacctgttcttcaccgagcccaacgccctgaccgtgaccgccagagtgagacccagatgcggcagactggtggccttcagcagcggcgtggagaacccccacggcgtgtgggccgtgaccagaggcagaagatgcgccctggccctgtggcacacctgggcccccgagcacagagagcaggagtggatcgaggccaaggagctgctgcaggagagccaggaggaggaggaggaggaggaggaggagatgcccagcaaggaccccagccccgagccccccagcagaagacaccagagagtgcaggacaagaccggcagagcccccagagtgagagaggagctgtag

SEQ ID NO: 19044 - DNA, 2208 bp, Artificial Sequence
  Description of Artificial Sequence: Synthetic coding sequence
atgctgagactgctgagacccctgctgctgctgctgctgctgcccccccccggcagccccgagccccccggcctgacccagctgagccccggcgcccccccccaggcccccgacctgctgtacgccgacggcctgagagcctacgccgccggcgcctgggcccccgccgtggccctgctgagagaggccctgagaagccaggccgccctgggcagagtgagactggactgcggcgccagctgcgccgccgaccccggcgccgccctgcccgccgtgctgctgggcgcccccgagcccgacagcggccccggccccacccagggcagctgggagagacagctgctgagagccgccctgagaagagccgactgcctgacccagtgcgccgccagaagactgggccccggcggcgccgccagaagagtgggcagcgccctgagagacgccttcagaagaagagagccctacaactacctgcagagagcctactaccagctgaagaagctggacctggccgccgccgccgcccacaccttcttcgtggccaaccccatgcacctgcagatgagagaggacatggccaagtacagaagaatgagcggcgtgagaccccagagcttcagagacctggagacccccccccactgggccgcctacgacaccggcctggagctgctgggcagacaggaggccggcctggccctgcccagactggaggaggccctgcagggcagcctggcccagatggagagctgcagagccgactgcgagggccccgaggagcagcagggcgccgaggaggaggaggacggcgccgccagccagggcggcctgtacgaggccatcgccggccactggatccaggtgctgcagtgcagacagagatgcgtgggcgagaccgccaccagacccggcagaagcttccccgtgcccgacttcctgcccaaccagctgagaagactgcacgaggcccacgcccaggtgggcaacctgagccaggccatcgagaacgtgctgagcgtgctgctgttctaccccgaggacgaggccgccaagagagccctgaaccagtaccaggcccagctgggcgagcccagacccggcctgggccccagagaggacatccagagattcatcctgagaagcctgggcgagaagagacagctgtactacgccatggagcacctgggcaccagcttcaaggaccccgacccctggacccccgccgccctgatccccgaggccctgagagagaagctgagagaggaccaggagaagagaccctgggaccacgagcccgtgaagcccaagcccctgacctactggaaggacgtgctgctgctggagggcgtgaccctgacccaggacagcagacagctgaacggcagcgagagagccgtgctggacggcctgctgacccccgccgagtgcggcgtgctgctgcagctggccaaggacgccgccggcgccggcgccagaagcggctacagaggcagaagaagcccccacaccccccacgagagattcgagggcctgaccgtgctgaaggccgcccagctggccagagccggcaccgtgggcagccagggcgccaagctgctgctggaggtgagcgagagagtgagaaccctgacccaggcctacttcagccccgagagacccctgcacctgagcttcacccacctggtgtgcagaagcgccatcgagggcgagcaggagcagagaatggacctgagccaccccgtgcacgccgacaactgcgtgctggaccccgacaccggcgagtgctggagagagccccccgcctacacctacagagactacagcggcctgctgtacctgaacgacgacttccagggcggcgacctgttcttcaccgagcccaacgccctgaccgtgaccgccagagtgagacccagatgcggcagactggtggccttcagcagcggcgtggagaacccccacggcgtgtgggccgtgaccagaggcagaagatgcgccctggccctgtggcacacctgggcccccgagcacagagagcaggagtggatcgaggccaaggagctgctgcaggagagccaggaggaggaggaggaggaggaggaggagatgcccagcaaggaccccagccccgagccccccagcagaagacaccagagagtgcaggacaagaccggcagagcccccagagtgagagaggagctgtag

SEQ ID NO: 19045 - DNA, 492 bp, Artificial Sequence
  Description of Artificial Sequence: Synthetic coding sequence
atgctgagactgctgagacccctgctgctgctgctgctgctgcccccccccggcagccccgagccccccggcctgacccagctgagccccggcgcccccccccaggcccccgacctgctgtacctgaacgacgacttccagggcggcgacctgttcttcaccgagcccaacgccctgaccgtgaccgccagagtgagacccagatgcggcagactggtggccttcagcagcggcgtggagaacccccacggcgtgtgggccgtgaccagaggcagaagatgcgccctggccctgtggcacacctgggcccccgagcacagagagcaggagtggatcgaggccaaggagctgctgcaggagagccaggaggaggaggaggaggaggaggaggagatgcccagcaaggaccccagccccgagccccccagcagaagacaccagagagtgcaggacaagaccggcagagcccccagagtgagagaggagctgtag

SEQ ID NO: 19046 - DNA, 1083 bp, Artificial Sequence
  Description of Artificial Sequence: Synthetic coding sequence
atggccctgagcagagtgtgctgggccagaagcgccgtgtggggcagcgccgtgacccccggccacttcgtgaccagaagactgcagctgggcagaagcggcctggcctggggcgcccccagaagcagcaagctgcacctgagccccaaggccgacgtgaagaacctgatgagctacgtggtgaccaagaccaaggccatcaacggcaagtaccacagattcctgggcagacacttccccagattctacgtgctgtacaccatcttcatgaagggcctgcagatgctgtgggccgacgccaagaaggccagaagaatcaagaccaacatgtggaagcacaacatcaagttccaccagctgccctacagagagatggagcacctgagacagttcagacaggacgtgaccaagtgcctgttcctgggcatcatcagcatcccccccttcgccaactacctggtgttcctgctgatgtacctgttccccagacagctgctgatcagacacttctggacccccaagcagcagaccgacttcctggacatctaccacgccttcagaaagcagagccaccccgagatcatcagctacctggagaaggtgatccccctgatcagcgacgccggcctgagatggagactgaccgacctgtgcaccaagatccagagaggcacccaccccgccatccacgacatcctggccctgagagagtgcttcagcaaccaccccctgggcatgaaccagctgcaggccctgcacgtgaaggccctgagcagagccatgctgctgaccagctacctgcccccccccctgctgagacacagactgaagacccacaccaccgtgatccaccagctggacaaggccctggccaagctgggcatcggccagctgaccgcccaggaggtgaagagcgcctgctacctgagaggcctgaacagcacccacatcggcgaggacagatgcagaacctggctgggcgagtggctgcagatcagctgcagcctgaaggaggccgagctgagcctgctgctgcacaacgtggtgctgctgagcaccaactacctgggcaccagaagatag

SEQ ID NO: 19047 - DNA, 300 bp, Artificial Sequence
  Description of Artificial Sequence: Synthetic coding sequence
atggccctgagcagagtgtgctgggccagaagcgccgtgtggggcagcgccgtgacccccggccacttcgtgaccagaagactgcagctgggcagaagcggcctggcctggggcgcccccagaagcagcaagctgcacctgagccccaaggccgacgtgaagaacctgatgagctacgtggtgaccaagaccaaggccatcaacggcaagtaccacagattcctgggcagacacttccccagattctacgtgctgtacaccatcttcatgaagggcacctgcttccccggcaactactag

SEQ ID NO: 19048 - DNA, 822 bp, Artificial Sequence
  Description of Artificial Sequence: Synthetic coding sequence
atggccctgagcagagtgtgctgggccagaagcgccgtgtggggcagcgccgtgacccccggccacttcgtgaccagaagactgcagctgggcagaagcggcctggcctggggcgcccccagaagcagcaagctgcacctgagccccaaggccgacgtgaagaacctgatgagctacgtggtgaccaagaccaaggccatcaacggcaagtaccacagattcctgggcagacacttccccagattctacgtgctgtacaccatcttcatgaagggcatcatcagcatcccccccttcgccaactacctggtgttcctgctgatgtacctgttccccagacagctgctgatcagacacttctggacccccaagcagcagaccgacttcctggacatctaccacgccttcagaaagcagagccaccccgagatcatcagctacctggagaaggtgatccccctgatcagcgacgccggcctgagatggagactgaccgacctgtgcaccaagatccagagaggcacccaccccgccatccacgacatcctggccctgagagagtgcttcagcaaccaccccctgggcatgaaccagctgcaggccctgcacgtgaaggccctgagcagagccatgctgctgaccagctacctgcccccccccctgctgagacacagactgaagacccacaccaccgtgatccaccagctggacaaggccctggccaagctgggcatcggccagctgaccgccctgcaccagctgccctgggacaaggccctgaacgagccctggagcggctggcactgccccgccgtggtgtag

SEQ ID NO: 19049 - DNA, 915 bp, Artificial Sequence
  Description of Artificial Sequence: Synthetic coding sequence
atgagctacgtggtgaccaagaccaaggccatcaacggcaagtaccacagattcctgggcagacacttccccagattctacgtgctgtacaccatcttcatgaagggcctgcagatgctgtgggccgacgccaagaaggccagaagaatcaagaccaacatgtggaagcacaacatcaagttccaccagctgccctacagagagatggagcacctgagacagttcagacaggacgtgaccaagtgcctgttcctgggcatcatcagcatcccccccttcgccaactacctggtgttcctgctgatgtacctgttccccagacagctgctgatcagacacttctggacccccaagcagcagaccgacttcctggacatctaccacgccttcagaaagcagagccaccccgagatcatcagctacctggagaaggtgatccccctgatcagcgacgccggcctgagatggagactgaccgacctgtgcaccaagatccagagaggcacccaccccgccatccacgacatcctggccctgagagagtgcttcagcaaccaccccctgggcatgaaccagctgcaggccctgcacgtgaaggccctgagcagagccatgctgctgaccagctacctgcccccccccctgctgagacacagactgaagacccacaccaccgtgatccaccagctggacaaggccctggccaagctgggcatcggccagctgaccgcccaggaggtgaagagcgcctgctacctgagaggcctgaacagcacccacatcggcgaggacagatgcagaacctggctgggcgagtggctgcagatcagctgcagcctgaaggaggccgagctgagcctgctgctgcacaacgtggtgctgctgagcaccaactacctgggcaccagaagatag

SEQ ID NO: 19050 - DNA, 1122 bp, Artificial Sequence
  Description of Artificial Sequence: Synthetic coding sequence
atggccctgagcagagtgtgctgggccagaagcgccgtgtggggcagcgccgtgacccccggccacttcgtgaccagaagactgcagctgggcagaagcggcctggcctggggcgcccccagaagcagcaagctgcacctgagccccaaggccgacgtgaagaacctgatgagctacgtggtgaccaagaccaaggccatcaacggcaagtaccacagattcctgggcagacacttccccagattctacgtgctgtacaccatcttcatgaagggcctgcagatgctgtgggccgacgccaagaaggccagaagaatcaagaccaacatgtggaagcacaacatcaagttccaccagctgccctacagagagatggagcacctgagacaggtgtgggccagaggcagataccccgaggtgcacggcgagttcagacaggacgtgaccaagtgcctgttcctgggcatcatcagcatcccccccttcgccaactacctggtgttcctgctgatgtacctgttccccagacagctgctgatcagacacttctggacccccaagcagcagaccgacttcctggacatctaccacgccttcagaaagcagagccaccccgagatcatcagctacctggagaaggtgatccccctgatcagcgacgccggcctgagatggagactgaccgacctgtgcaccaagatccagagaggcacccaccccgccatccacgacatcctggccctgagagagtgcttcagcaaccaccccctgggcatgaaccagctgcaggccctgcacgtgaaggccctgagcagagccatgctgctgaccagctacctgcccccccccctgctgagacacagactgaagacccacaccaccgtgatccaccagctggacaaggccctggccaagctgggcatcggccagctgaccgcccaggaggtgaagagcgcctgctacctgagaggcctgaacagcacccacatcggcgaggacagatgcagaacctggctgggcgagtggctgcagatcagctgcagcctgaaggaggccgagctgagcctgctgctgcacaacgtggtgctgctgagcaccaactacctgggcaccagaagatag

SEQ ID NO: 19051 - DNA, 1782 bp, Artificial Sequence
  Description of Artificial Sequence: Synthetic coding sequence
atggacgccgccaccgcccccaagcaggcctggcccccctggccccccctgctgttcctgctgctgctgcccggcggcagcggcggcagctgccccgccgtgtgcgactgcaccagccagccccaggccgtgctgtgcggccacagacagctggaggccgtgcccggcggcctgcccctggacaccgagctgctggacctgagcggcaacagactgtggggcctgcagcagggcatgctgagcagactgagcctgctgcaggagctggacctgagctacaaccagctgagcaccctggagcccggcgccttccacggcctgcagagcctgctgaccctgagactgcagggcaacagactgagaatcatgggccccggcgtgttcagcggcctgagcgccctgaccctgctggacctgagactgaaccagatcgtgctgttcctggacggcgccttcggcgagctgggcagcctgcagaagctggaggtgggcgacaaccacctggtgttcgtggcccccggcgccttcgccggcctggccaagctgagcaccctgaccctggagagatgcaacctgagcaccgtgcccggcctggccctggccagactgcccgccctggtggccctgagactgagagagctggacatcggcagactgcccgccggcgccctgagaggcctgggccagctgaaggagctggagatccacctgtggcccagcctggaggccctggaccccggcagcctggtgggcctgaacctgagcagcctggccatcaccagatgcaacctgagcagcgtgcccttccaggccctgtaccacctgagcttcctgagagtgctggacctgagccagaaccccatcagcgccatccccgccagaagactgagccccctggtgagactgcaggagctgagactgagcggcgcctgcctgaccagcatcgccgcccacgccttccacggcctgaccgccttccacctgctggacgtggccgacaacgccctgcagaccctggaggagaccgccttccccagccccgacaagctggtgaccctgagactgagcggcaaccccctgacctgcgactgcagactgctgtggctgctgagactgagaagacacctggacttcggcatgagcccccccgcctgcgccggcccccaccacgtgcagggcaagagcctgaaggagttcagcgacatcctgccccccggccacttcacctgcaagcccgccctgatcagaaagagcggccccagatgggtgatcgccgaggagggcggccacgccgtgttcagctgcagcggcgacggcgaccccgcccccaccgtgagctggatgagaccccacggcgcctggctgggcagagccggcagagtgagagtgctggaggacggcaccctggagatcagaagcgtgcagctgagagacagaggcgcctacgtgtgcgtggtgagcaacgtggccggcaacgacagcctgagaacctggctggaggtgatccaggtggagccccccaacggcaccctgagcgaccccaacatcaccgtgcccggcatccccggccccttcttcctggacagcagaggcgtggccatggtgctggccgtgggcttcctgcccttcctgaccagcgtgaccctgtgcttcggcctgatcgccctgtggagcaagggcaagggcagagtgaagcaccacatgaccttcgacttcgtggcccccagacccagcggcgacaagaacagcggcggcaacagagtgaccgccaagctgttctag

SEQ ID NO: 19052 - DNA, 1746 bp, Artificial Sequence
  Description of Artificial Sequence: Synthetic coding sequence
atgcccctgaagcactacctgctgctgctggtgggctgccaggcctggggcgccggcctggcctaccacggctgccccagcgagtgcacctgcagcagagccagccaggtggagtgcaccggcgccagaatcgtggccgtgcccacccccctgccctggaacgccatgagcctgcagatcctgaacacccacatcaccgagctgaacgagagccccttcctgaacatcagcgccctgatcgccctgagaatcgagaagaacgagctgagcagaatcacccccggcgccttcagaaacctgggcagcctgagatacctgagcctggccaacaacaagctgcaggtgctgcccatcggcctgttccagggcctggacagcctggagagcctgctgctgagcagcaaccagctgctgcagatccagcccgcccacttcagccagtgcagcaacctgaaggagctgcagctgcacggcaaccacctggagtacatccccgacggcgccttcgaccacctggtgggcctgaccaagctgaacctgggcaagaacagcctgacccacatcagccccagagtgttccagcacctgggcaacctgcaggtgctgagactgtacgagaacagactgaccgacatccccatgggcaccttcgacggcctggtgaacctgcaggagctggccctgcagcagaaccagatcggcctgctgagccccggcctgttccacaacaaccacaacctgcagagactgtacctgagcaacaaccacatcagccagctgccccccagcgtgttcatgcagctgccccagctgaacagactgaccctgttcggcaacagcctgaaggagctgagccccggcatcttcggccccatgcccaacctgagagagctgtggctgtacgacaaccacatcagcagcctgcccgacaacgtgttcagcaacctgagacagctgcaggtgctgatcctgagcagaaaccagatcagcttcatcagccccggcgccttcaacggcctgaccgagctgagagagctgagcctgcacaccaacgccctgcaggacctggacggcaacgtgttcagaatgctggccaacctgcagaacatcagcctgcagaacaacagactgagacagctgcccggcaacatcttcgccaacgtgaacggcctgatggccatccagctgcagaacaaccagctggagaacctgcccctgggcatcttcgaccacctgggcaagctgtgcgagctgagactgtacgacaacccctggagatgcgacagcgacatcctgcccctgagaaactggctgctgctgaaccagcccagactgggcaccgacaccgtgcccgtgtgcttcagccccgccaacgtgagaggccagagcctgatcatcatcaacgtgaacgtggccgtgcccagcgtgcacgtgcccgaggtgcccagctaccccgagaccccctggtaccccgacacccccagctaccccgacaccaccagcgtgagcagcaccaccgagctgaccagccccgtggaggactacaccgacctgaccaccatccaggtgaccgacgacagaagcgtgtggggcatgacccaggcccagagcggcctggccatcgccgccatcgtgatcggcatcgtggccctggcctgcagcctggccgcctgcgtgggctgctgctgctgcaagaagagaagccaggccgtgctgatgcagatgaaggcccccaacgagtgctag

SEQ ID NO: 19053 - DNA, 1764 bp, Artificial Sequence
  Description of Artificial Sequence: Synthetic coding sequence
atgcccctggacaaggccatgcccctgaagcactacctgctgctgctggtgggctgccaggcctggggcgccggcctggcctaccacggctgccccagcgagtgcacctgcagcagagccagccaggtggagtgcaccggcgccagaatcgtggccgtgcccacccccctgccctggaacgccatgagcctgcagatcctgaacacccacatcaccgagctgaacgagagccccttcctgaacatcagcgccctgatcgccctgagaatcgagaagaacgagctgagcagaatcacccccggcgccttcagaaacctgggcagcctgagatacctgagcctggccaacaacaagctgcaggtgctgcccatcggcctgttccagggcctggacagcctggagagcctgctgctgagcagcaaccagctgctgcagatccagcccgcccacttcagccagtgcagcaacctgaaggagctgcagctgcacggcaaccacctggagtacatccccgacggcgccttcgaccacctggtgggcctgaccaagctgaacctgggcaagaacagcctgacccacatcagccccagagtgttccagcacctgggcaacctgcaggtgctgagactgtacgagaacagactgaccgacatccccatgggcaccttcgacggcctggtgaacctgcaggagctggccctgcagcagaaccagatcggcctgctgagccccggcctgttccacaacaaccacaacctgcagagactgtacctgagcaacaaccacatcagccagctgccccccagcgtgttcatgcagctgccccagctgaacagactgaccctgttcggcaacagcctgaaggagctgagccccggcatcttcggccccatgcccaacctgagagagctgtggctgtacgacaaccacatcagcagcctgcccgacaacgtgttcagcaacctgagacagctgcaggtgctgatcctgagcagaaaccagatcagcttcatcagccccggcgccttcaacggcctgaccgagctgagagagctgagcctgcacaccaacgccctgcaggacctggacggcaacgtgttcagaatgctggccaacctgcagaacatcagcctgcagaacaacagactgagacagctgcccggcaacatcttcgccaacgtgaacggcctgatggccatccagctgcagaacaaccagctggagaacctgcccctgggcatcttcgaccacctgggcaagctgtgcgagctgagactgtacgacaacccctggagatgcgacagcgacatcctgcccctgagaaactggctgctgctgaaccagcccagactgggcaccgacaccgtgcccgtgtgcttcagccccgccaacgtgagaggccagagcctgatcatcatcaacgtgaacgtggccgtgcccagcgtgcacgtgcccgaggtgcccagctaccccgagaccccctggtaccccgacacccccagctaccccgacaccaccagcgtgagcagcaccaccgagctgaccagccccgtggaggactacaccgacctgaccaccatccaggtgaccgacgacagaagcgtgtggggcatgacccaggcccagagcggcctggccatcgccgccatcgtgatcggcatcgtggccctggcctgcagcctggccgcctgcgtgggctgctgctgctgcaagaagagaagccaggccgtgctgatgcagatgaaggcccccaacgagtgctag

SEQ ID NO: 19054 - DNA, 1764 bp, Artificial Sequence; identical to SEQ ID NO: 19053
  Description of Artificial Sequence: Synthetic coding sequence

SEQ ID NO: 19055 - DNA, 1113 bp, Artificial Sequence
  Description of Artificial Sequence: Synthetic coding sequence
atgaaggtgaccggcatcaccatcctgttctggcccctgagcatgatcctgctgagcgacaagatccagagcagcaagagagaggtgcagtgcaacttcaccgagaagaactacaccctgatccccgccgacatcaagaaggacgtgaccatcctggacctgagctacaaccagatcaccctgaacggcaccgacaccagagtgctgcagacctacttcctgctgaccgagctgtacctgatcgagaacaaggtgaccatcctgcacaacaacggcttcggcaacctgagcagcctggagatcctgaacatctgcagaaacagcatctacgtgatccagcagggcgccttcctgggcctgaacaagctgaagcagctgtacctgtgccagaacaagatcgagcagctgaacgccgacgtgttcgtgcccctgagaagcctgaagctgctgaacctgcagggcaacctgatcagctacctggacgtgccccccctgttccacctggagctgatcaccctgtacggcaacctgtggaactgcagctgcagcctgttcaacctgcagaactggctgaacaccagcaacgtgaccctggagaacgagaacatcaccatgtgcagctaccccaacagcctgcagagctacaacatcaagaccgtgccccacaaggccgagtgccacagcaagttccccagcagcgtgaccgaggacctgtacatccacttccagcccatcagcaacagcatcttcaacagcagcagcaacaacctgaccagaaacagcgagcacgagcccctgggcaagagctgggccttcctggtgggcgtggtggtgaccgtgctgaccaccagcctgctgatcttcatcgccatcaagtgccccatctggtacaacatcctgctgagctacaaccaccacagactggaggagcacgaggccgagacctacgaggacggcttcaccggcaaccccagcagcctgagccagatccccgagaccaacagcgaggagaccaccgtgatcttcgagcagctgcacagcttcgtggtggacgacgacggcttcatcgaggacaagtacatcgacatccacgagctgtgcgaggagaactag

SEQ ID NO: 19056 - DNA, 1542 bp, Artificial Sequence
  Description of Artificial Sequence: Synthetic coding sequence
atggccctgagagcccccgccctgctgcccctgctgctgctgctgctgcccctgagagccgccggctgccccgccgcctgcagatgctacagcgccaccgtggagtgcggcgccctgagactgagagtggtgcccctgggcatcccccccggcacccagaccctgttcctgcaggacaacaacatcgccagactggagcccggcgccctggcccccctggccgccctgagaagactgtacctgcacaacaacagcctgagagccctggaggccggcgccttcagagcccagcccagactgctggagctggccctgaccagcaacagactgagaggcctgagaagcggcgccttcgtgggcctggcccagctgagagtgctgtacctggccggcaaccagctggccagactgctggacttcaccttcctgcacctgcccagactgcaggagctgcacctgcaggagaacagcatcgagctgctggaggaccaggccctggccggcctgagcagcctggccctgctggacctgagcagaaaccagctgggcaccatcagcagagaggccctgcagcccctggccagcctgcaggtgctgagactgaccgagaacccctggagatgcgactgcgccctgcactggctgggcgcctggatcaaggagggcggccagagactgctgaccagcagagacagaaagatcatgtgcgccgagccccccagactggccctgcagagcctgctggacgtgagccacagcagcctgatctgcatcccccccagcgtgcacgtgcagcccctggagctgaccgccaacctgggcgaggacctgagagtggcctgccaggccagcggctacccccagcccctggtgacctggagaaaggtgccccagcccagagagggcagacccagagcccaggcccagctggagggcggcctgctgggcctgggcggccacagcgccagcgacaccggcagcggcatgctgttcctgagcaacatcaccctggcccacgccggcaagtacgagtgcgaggccagcaacgccggcggcgccgccagagtgcccttcagactgctggtgaacgccagcagacagcagccccagcagcccgcccagccccccccccccgccgccagacccgccggcagcgagcccagacccgaggccggcagcatggccttcagagccctgggcgtggccacccagaccgccatcgccgccgccatcgccctgctggccctgaccgccctgctgctggtggccatgatctgcagaagaagaagaagaagaaagaaggccagaggcccccccggcgagggcgccctgttcgtgaacgactacctggacggcccctgcaccttcgcccagctggaggagctgagagacgagagaggccacgagatgttcgtgatcaacagaagcaagcccctgttcgccgagggccccgccgaggcccccgccgactgcggccccgagcagggcgccggccccggcctgagagtgcccccccccgtggcctacgagatccactgctag

SEQ ID NO: 19057 - DNA, 774 bp, Artificial Sequence
  Description of Artificial Sequence: Synthetic coding sequence
atgggcaccgtgagaccccccagacccagcctgctgctggtgagcaccagagagagctgcctgttcctgctgttctgcctgcacctgggcgccgcctgcccccagccctgcagatgccccgaccacgccggcgccgtggccgtgttctgcagcctgagaggcctgcaggaggtgcccgaggacatccccgccaacaccgtgctgctgaagctggacgccaacaagatcagccacctgcccgacggcgccttccagcacctgcacagactgagagagctggacctgagccacaacgccatcgaggccatcggcagcgccaccttcgccggcctggccggcggcctgagactgctggacctgagctacaacagaatccagagaatccccaaggacgccctgggcaagctgagcgccaagatcagactgagccacaaccccctgcactgcgagtgcgccctgcaggaggccctgtgggagctgaagctggaccccgacagcgtggacgagatcgcctgccacaccagcgtgcaggaggagttcgtgggcaagcccctggtgcaggccctggacgccggcgccagcctgtgcagcgtgccccacagaaccaccgacgtggccatgctggtgaccatgttcggctggttcgccatggtgatcgcctacgtggtgtactacgtgagacacaaccaggaggacgccagaagacacctggagtacctgaagagcctgcccagcgcccccgccagcaaggaccccatcggccccggcccctag

SEQ ID NO: 19058 - DNA, 414 bp, Artificial Sequence
  Description of Artificial Sequence: Synthetic coding sequence
atgggcaccgtgagaccccccagacccagcctgctgctggtgagcaccagagagagctgcctgttcctgctgttctgcctgcacctgggcgccgcctgcccccagccctgcagatgccccgaccacgccggcgccgtggccgtgttctgcagcctgagaggcctgcaggaggtgcccgaggacatccccgccaacaccgtgctgctgaagctggacgccaacaagatcagccacctgcccgacggcgccttccagcacctgcacagactgagagagctggacctgagccacaacgccatcgaggccatcggcagcgccaccttcgccggcctggccggcggcctgagactgctggacctgagctacaacagaatccagagaatccccaaggaccccatcggccccggcccctag

SEQ ID NO: 19059 - DNA, 1989 bp, Artificial Sequence
  Description of Artificial Sequence: Synthetic coding sequence
atgagaccccagatcctgctgctgctggccctgctgaccctgggcctggccgcccagcaccaggacaaggtgccctgcaagatggtggacaagaaggtgagctgccaggtgctgggcctgctgcaggtgcccagcgtgctgccccccgacaccgagaccctggacctgagcggcaaccagctgagaagcatcctggccagccccctgggcttctacaccgccctgagacacctggacctgagcaccaacgagatcagcttcctgcagcccggcgccttccaggccctgacccacctggagcacctgagcctggcccacaacagactggccatggccaccgccctgagcgccggcggcctgggccccctgcccagagtgaccagcctggacctgagcggcaacagcctgtacagcggcctgctggagagactgctgggcgaggcccccagcctgcacaccctgagcctggccgagaacagcctgaccagactgaccagacacaccttcagagacatgcccgccctggagcagctggacctgcacagcaacgtgctgatggacatcgaggacggcgccttcgagggcctgcccagactgacccacctgaacctgagcagaaacagcctgacctgcatcagcgacttcagcctgcagcagctgagagtgctggacctgagctgcaacagcatcgaggccttccagaccgccagccagccccaggccgagttccagctgacctggctggacctgagagagaacaagctgctgcacttccccgacctggccgccctgcccagactgatctacctgaacctgagcaacaacctgatcagactgcccaccggccccccccaggacagcaagggcatccacgcccccagcgagggctggagcgccctgcccctgagcgcccccagcggcaacgccagcggcagacccctgagccagctgctgaacctggacctgagctacaacgagatcgagctgatccccgacagcttcctggagcacctgaccagcctgtgcttcctgaacctgagcagaaactgcctgagaaccttcgaggccagaagactgggcagcctgccctgcctgatgctgctggacctgagccacaacgccctggagaccctggagctgggcgccagagccctgggcagcctgagaaccctgctgctgcagggcaacgccctgagagacctgcccccctacaccttcgccaacctggccagcctgcagagactgaacctgcagggcaacagagtgagcccctgcggcggccccgacgagcccggccccagcggctgcgtggccttcagcggcatcaccagcctgagaagcctgagcctggtggacaacgagatcgagctgctgagagccggcgccttcctgcacacccccctgaccgagctggacctgagcagcaaccccggcctggaggtggccaccggcgccctgggcggcctggaggccagcctggaggtgctggccctgcagggcaacggcctgatggtgctgcaggtggacctgccctgcttcatctgcctgaagagactgaacctggccgagaacagactgagccacctgcccgcctggacccaggccgtgagcctggaggtgctggacctgagaaacaacagcttcagcctgctgcccggcagcgccatgggcggcctggagaccagcctgagaagactgtacctgcagggcaaccccctgagctgctgcggcaacggctggctggccgcccagctgcaccagggcagagtggacgtggacgccacccaggacctgatctgcagattcagcagccaggaggaggtgagcctgagccacgtgagacccgaggactgcgagaagggcggcctgaagaacatcaacctgatcatcatcctgaccttcatcctggtgagcgccatcctgctgaccaccctggccgcctgctgctgcgtgagaagacagaagttcaaccagcagtacaaggcctag

SEQ ID NO: 19060 - DNA, 1989 bp, Artificial Sequence; identical to SEQ ID NO: 19059
  Description of Artificial Sequence: Synthetic coding sequence

SEQ ID NO: 19061 - DNA, 1989 bp, Artificial Sequence; identical to SEQ ID NO: 19059
  Description of Artificial Sequence: Synthetic coding sequence

SEQ ID NO: 19062 - DNA, 561 bp, Artificial Sequence
  Description of Artificial Sequence: Synthetic coding sequence
atgagaccccagatcctgctgctgctggccctgctgaccctgggcctggccgcccagcaccaggacaaggtgccctgcaagatggtggacaagaaggtgagctgccaggtgctgggcctgctgcaggtgcccagcgtgctgccccccgacaccgagaccctggacctgagcggcaaccagctgagaagcatcctggccagccccctgggcttctacaccgccctgagacacctggacctgagcaccaacgagatcagcttcctgcagcccggcgccttccaggccctgacccacctggagcacctgagcctggcccacaacagactggccatggccaccgccctgagcgccggcggcctgggccccctgcccagagtgaccagcctggacctgagcggcaacagcctgtacagcggcctgctggagagactgctgggcgaggcccccagcctgcacaccctgagcctggccgagaacagcctgaccagactgaccagacacaccttcagagacatgcccgccctggagcagctggacctgcacagcaacgtgctgatgtag

SEQ ID NO: 19063 - DNA, 2079 bp, Artificial Sequence
  Description of Artificial Sequence: Synthetic coding sequence
atggagctgctgcccctgtggctgtgcctgggcttccacttcctgaccgtgggctggagaaacagaagcggcaccgccaccgccgccagccagggcgtgtgcaagctggtgggcggcgccgccgactgcagaggccagagcctggccagcgtgcccagcagcctgcccccccacgccagaatgctgaccctggacgccaaccccctgaagaccctgtggaaccacagcctgcagccctaccccctgctggagagcctgagcctgcacagctgccacctggagagaatcagcagaggcgccttccaggagcagggccacctgagaagcctggtgctgggcgacaactgcctgagcgagaactacgaggagaccgccgccgccctgcacgccctgcccggcctgagaagactggacctgagcggcaacgccctgaccgaggacatggccgccctgatgctgcagaacctgagcagcctgagaagcgtgagcctggccggcaacaccatcatgagactggacgacagcgtgttcgagggcctggagagactgagagagctggacctgcagagaaactacatcttcgagatcgagggcggcgccttcgacggcctggccgagctgagacacctgaacctggccttcaacaacctgccctgcatcgtggacttcggcctgaccagactgagagtgctgaacgtgagctacaacgtgctggagtggttcctggccaccggcggcgaggccgccttcgagctggagaccctggacctgagccacaaccagctgctgttcttccccctgctgccccagtacagcaagctgagaaccctgctgctgagagacaacaacatgggcttctacagagacctgtacaacaccagcagccccagagagatggtggcccagttcctgctggtggacggcaacgtgaccaacatcaccaccgtgagcctgtgggaggagttcagcagcagcgacctggccgacctgagattcctggacatgagccagaaccagttccagtacctgcccgacggcttcctgagaaagatgcccagcctgagccacctgaacctgcaccagaactgcctgatgaccctgcacatcagagagcacgagccccccggcgccctgaccgagctggacctgagccacaaccagctgagcgagctgcacctggcccccggcctggccagctgcctgggcagcctgagactgttcaacctgagcagcaaccagctgctgggcgtgccccccggcctgttcgccaacgccagaaacatcaccaccctggacatgagccacaaccagatcagcctgtgccccctgcccgccgccagcgacagagtgggcccccccagctgcgtggacttcagaaacatggccagcctgagaagcctgagcctggagggctgcggcctgggcgccctgcccgactgccccttccagggcaccagcctgacctacctggacctgagcagcaactggggcgtgctgaacggcagcctggcccccctgcaggacgtggcccccatgctgcaggtgctgagcctgagaaacatgggcctgcacagcagcttcatggccctggacttcagcggcttcggcaacctgagagacctggacctgagcggcaactgcctgaccaccttccccagattcggcggcagcctggccctggagaccctggacctgagaagaaacagcctgaccgccctgccccagaaggccgtgagcgagcagctgagcagaggcctgagaaccatctacctgagccagaacccctacgactgctgcggcgtggacggctggggcgccctgcagcacggccagaccgtggccgactgggccatggtgacctgcaacctgagcagcaagatcatcagagtgaccgagctgcccggcggcgtgcccagagactgcaagtgggagagactggacctgggcctgctgtacctggtgctgatcctgcccagctgcctgaccctgctggtggcctgcaccgtgatcgtgctgaccttcaagaagcccctgctgcaggtgatcaagagcagatgccactggagcagcgtgtactag

SEQ ID NO: 19064 - DNA, 4905 bp, Artificial Sequence
  Description of Artificial Sequence: Synthetic coding sequence
atgaccagcgcccagtgccccgccctggcctgcgtgatgagccccctgagattctggggcccctggcccctgctgatgtggcagctgctgtggctgctggtgaaggaggcccagcccctggagtgggtgaaggaccccctgcagctgaccagcaaccccctgggcccccccgagccctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagctgcccctggagcccgagcagttcctggccagccagcaggacctgaaggacaagctgagcccccaggagagactgcccgtgagccccaagaagctgaagaaggaccccgcccagagatggagcctggccgagatcatcggcatcatccaccagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagcagcagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcatgaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagctgcccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcgtgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcatcgagcccgaggagcccagcgacagcagcggcatcaacctgagcggcttcggcagcgagcagctggacaccaacgacgagagcgacgtgaccagcaccctgagctacatcctgccctacttcagcgccgtgaacctggacgtgaagagcctgctgctgcccttcatcaagctgcccaccaccggcaacagcctggccaagatccagaccgtgggcaagaacagacagagactgaacagagtgctgatgggccccagaagcatccagaagagacacttcaaggaggtgggcagacagagcatcagaagagagcagggcgcccaggccagcgtggagaacaccgccgaggagaagagactgggcagccccgcccccagagagctgaagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacatgaagaccagcaagcccatcgtgcacagcagaaagaagtacagattccacaagaccagaagcagaatgacccacagaacccccaaggtgaagaagagccccaaggtgagaaagaagagctacctgagcagactgatgctgagcaacagactgcccttcagcgccgccaagagcctgatcaacagccccagccagggcgccttcagcagcctgagagacctgagcccccaggagaaccccttcctggaggtgagcgcccccagcgagcacttcatcgagaacaacaacaccaaggacaccaccgccagaaacgccttcgaggagaacgtgttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcgtgatccccaacaacaacgtgagaagactgatcgcccacgtgatcagaaccctgaagatggactgcagcggcgcccacgtgcaggtgacctgcgccaagctggtgagcagaaccggccacctgatgaagctgctgagcggccagcaggaggtgaaggccagcaagatcgagtgggacaccgaccagtggaagaccgagaactacatcaacgagagcaccgaggcccagagcgagcagaaggagaagagcctggagttcaccaaggagctgcccggctacggctacaccaagaagctgatcctggccctgatcgtgaccggcatcctgaccatcctgatcatcctgctgtgcctgatcgagatctgctgccacagaagaagcctgcaggaggacgaggagggcttcagcagagacagcgaggcccccaccgaggaggagagcgaggccctgccctag

SEQ ID NO: 19065 - DNA, 4905 bp, Artificial Sequence; identical to SEQ ID NO: 19064
  Description of Artificial Sequence: Synthetic coding sequence

SEQ ID NO: 19066 - DNA, 1836 bp, Artificial Sequence
  Description of Artificial Sequence: Synthetic coding sequence
atggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcatcgagcccgaggagcccagcgacagcagcggcatcaacctgagcggcttcggcagcgagcagctggacaccaacgacgagagcgacgtgaccagcaccctgagctacatcctgccctacttcagcgccgtgaacctggacgtgaagagcctgctgctgcccttcatcaagctgcccaccaccggcaacagcctggccaagatccagaccgtgggcaagaacagacagagactgaacagagtgctgatgggccccagaagcatccagaagagacacttcaaggaggtgggcagacagagcatcagaagagagcagggcgcccaggccagcgtggagaacaccgccgaggagaagagactgggcagccccgcccccagagagctgaagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacatgaagaccagcaagcccatcgtgcacagcagaaagaagtacagattccacaagaccagaagcagaatgacccacagaacccccaaggtgaagaagagccccaaggtgagaaagaagagctacctgagcagactgatgctgagcaacagactgcccttcagcgccgccaagagcctgatcaacagccccagccagggcgccttcagcagcctgagagacctgagcccccaggagaaccccttcctggaggtgagcgcccccagcgagcacttcatcgagaacaacaacaccaaggacaccaccgccagaaacgccttcgaggagaacgtgttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcgtgatccccaacaacaacgtgagaagactgatcgcccacgtgatcagaaccctgaagatggactgcagcggcgcccacgtgcaggtgacctgcgccaagctggtgagcagaaccggccacctgatgaagctgctgagcggccagcaggaggtgaaggccagcaagatcgagtgggacaccgaccagtggaagaccgagaactacatcaacgagagcaccgaggcccagagcgagcagaaggagaagagcctggagttcaccaaggagctgcccggctacggctacaccaagaagctgatcctggccctgatcgtgaccggcatcctgaccatcctgatcatcctgctgtgcctgatcgagatctgctgccacagaagaagcctgcaggaggacgaggagggcttcagcagagacagcgaggcccccaccgaggaggagagcgaggccctgccctag

SEQ ID NO: 19067 - DNA, 2148 bp, Artificial Sequence
  Description of Artificial Sequence: Synthetic coding sequence
cacagaaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcgtgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcatcgagcccgaggagcccagcgacagcagcggcatcaacctgagcggcttcggcagcgagcagctggacaccaacgacgagagcgacgtgaccagcaccctgagctacatcctgccctacttcagcgccgtgaacctggacgtgaagagcctgctgctgcccttcatcaagctgcccaccaccggcaacagcctggccaagatccagaccgtgggcaagaacagacagagactgaacagagtgctgatgggccccagaagcatccagaagagacacttcaaggaggtgggcagacagagcatcagaagagagcagggcgcccaggccagcgtggagaacaccgccgaggagaagagactgggcagccccgcccccagagagctgaagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacatgaagaccagcaagcccatcgtgcacagcagaaagaagtacagattccacaagaccagaagcagaatgacccacagaacccccaaggtgaagaagagccccaaggtgagaaagaagagctacctgagcagactgatgctgagcaacagactgcccttcagcgccgccaagagcctgatcaacagccccagccagggcgccttcagcagcctgagagacctgagcccccaggagaaccccttcctggaggtgagcgcccccagcgagcacttcatcgagaacaacaacaccaaggacaccaccgccagaaacgccttcgaggagaacgtgttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcgtgatccccaacaacaacgtgagaagactgatcgcccacgtgatcagaaccctgaagatggactgcagcggcgcccacgtgcaggtgacctgcgccaagctggtgagcagaaccggccacctgatgaagctgctgagcggccagcaggaggtgaaggccagcaagatcgagtgggacaccgaccagtggaagaccgagaactacatcaacgagagcaccgaggcccagagcgagcagaaggagaagagcctggagttcaccaaggagctgcccggctacggctacaccaagaagctgatcctggccctgatcgtgaccggcatcctgaccatcctgatcatcctgctgtgcctgatcgagatctgctgccacagaagaagcctgcaggaggacgaggagggcttcagcagagacagcgaggcccccaccgaggaggagagcgaggccctgccctag

SEQ ID NO: 19068 - DNA, 2019 bp, Artificial Sequence
  Description of Artificial Sequence: Synthetic coding sequence
atgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcgtgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcatcgagcccgaggagcccagcgacagcagcggcatcaacctgagcggcttcggcagcgagcagctggacaccaacgacgagagcgacgtgaccagcaccctgagctacatcctgccctacttcagcgccgtgaacctggacgtgaagagcctgctgctgcccttcatcaagctgcccaccaccggcaacagcctggccaagatccagaccgtgggcaagaacagacagagactgaacagagtgctgatgggccccagaagcatccagaagagacacttcaaggaggtgggcagacagagcatcagaagagagcagggcgcccaggccagcgtggagaacaccgccgaggagaagagactgggcagccccgcccccagagagctgaagcagccccacacccagcagggccccgagaagctggccggcaacgccgtgtacaccaagcccagcttcacccaggagcacaaggccgccgtgagcgtgctgaagcccttcagcaagggcgcccccagcaccagcagccccgccaaggccctgccccaggtgagagacagatggaaggacctgacccacgccatcagcatcctggagagcgccaaggccagagtgaccaacatgaagaccagcaagcccatcgtgcacagcagaaagaagtacagattccacaagaccagaagcagaatgacccacagaacccccaaggtgaagaagagccccaaggtgagaaagaagagctacctgagcagactgatgctgagcaacagactgcccttcagcgccgccaagagcctgatcaacagccccagccagggcgccttcagcagcctgagagacctgagcccccaggagaaccccttcctggaggtgagcgcccccagcgagcacttcatcgagaacaacaacaccaaggacaccaccgccagaaacgccttcgaggagaacgtgttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcgtgatccccaacaacaacgtgagaagactgatcgcccacgtgatcagaaccctgaagatggactgcagcggcgcccacgtgcaggtgacctgcgccaagctggtgagcagaaccggccacctgatgaagctgctgagcggccagcaggaggtgaaggccagcaagatcgagtgggacaccgaccagtggaagaccgagaactacatcaacgagagcaccgaggcccagagcgagcagaaggagaagagcctggagttcaccaaggagctgcccggctacggctacaccaagaagctgatcctggccctgatcgtgaccggcatcctgaccatcctgatcatcctgctgtgcctgatcgagatctgctgccacagaagaagcctgcaggaggacgaggagggcttcagcagagacagcgaggcccccaccgaggaggagagcgaggccctgccctag

SEQ ID NO: 19069 - DNA, 5103 bp, Artificial Sequence
  Description of Artificial Sequence: Synthetic coding sequence
atgagcagcgcccagtgccccgccctggtgtgcgtgatgagcagactgagattctggggcccctggcccctgctgatgtggcagctgctgtggctgctggtgaaggaggcccagcccctggagtgggtgaaggaccccctgcagctgaccagcaaccccctgggcccccccgagagctggagcagccacagcagccacttccccagagagagcccccacgcccccaccctgcccgccgacccctgggacttcgaccacctgggccccagcgccagcagcgagatgcccgcccccccccaggagagcaccgagaacctggtgcccttcctggacacctgggacagcgccggcgagcagcccctggagcccgagcagttcctggccagccagcaggacctgaaggacaagctgagcccccaggagagactgcccgtgagccccaagaagctgaagaaggaccccgcccagagatggagcctggccgagatcatcggcatcaccagacagctgagcaccccccagagccagaagcagaccctgcagaacgagtacagcagcaccgacaccccctaccccggcagcctgccccccgagctgagagtgaagagcgacgagccccccggccccagcgagcaggtgggccccagccagttccacctggagcccgagacccagaaccccgagaccctggaggacatccagagcagcagcctgcagcaggaggcccccgcccagctgccccagctgctggaggaggagcccagcagcatgcagcaggaggcccccgccctgccccccgagagcagcatggagagcctgaccctgcccaaccacgaggtgagcgtgcagccccccggcgaggaccaggcctactaccacctgcccaacatcaccgtgaagcccgccgacgtggaggtgaccatcaccagcgagcccaccaacgagaccgagagcagccaggcccagcaggagacccccatccagttccccgaggaggtggagcccagcgccacccagcaggaggcccccatcgagccccccgtgccccccatggagcacgagctgagcatcagcgagcagcagcagcccgtgcagcccagcgagagccccagagaggtggagagcagccccacccagcaggagacccccggccagccccccgagcaccacgaggtgaccgtgagcccccccggccaccaccagacccaccacctggccagccccagcgtgagcgtgaagccccccgacgtgcagctgaccatcgccgccgagcccagcgccgaggtgggcaccagcctggtgcaccaggaggccaccaccagactgagcggcagcggcaacgacgtggagccccccgccatccagcacggcggcccccccctgctgcccgagagcagcgaggaggccggccccctggccgtgcagcaggagaccagcttccagagccccgagcccatcaacaacgagaaccccagccccacccagcaggaggccgccgccgagcacccccagaccgccgaggagggcgagagcagcctgacccaccaggaggcccccgcccagacccccgagttccccaacgtggtggtggcccagccccccgagcacagccacctgacccaggccaccgtgcagcccctggacctgggcttcaccatcacccccgagagcaagaccgaggtggagctgagccccaccatgaaggagacccccacccagccccccaagaaggtggtgccccagctgagagtgtaccagggcgtgaccaaccccacccccggccaggaccaggcccagcaccccgtgagccccagcgtgaccgtgcagctgctggacctgggcctgaccatcacccccgagcccaccaccgaggtgggccacagcaccccccccaagagaaccatcgtgagccccaagcaccccgaggtgaccctgccccaccccgaccaggtgcagacccagcacagccacctgaccagagccaccgtgcagcccctggacctgggcttcaccatcacccccaagagcatgaccgaggtggagcccagcaccgccctgatgaccaccgcccccccccccggccaccccgaggtgaccctgccccccagcgacaagggccaggcccagcacagccacctgacccaggccaccgtgcagcccctggacctggagctgaccatcaccaccaagcccaccaccgaggtgaagcccagccccaccaccgaggagaccagcacccagccccccgacctgggcctggccatcatccccgagcccaccaccgagaccggccacagcaccgccctggagaagaccaccgcccccagacccgacagagtgcagaccctgcacagaagcctgaccgaggtgaccggcccccccaccgagctggagcccgcccaggacagcctggtgcagagcgagagctacacccagaacaaggccctgaccgcccccgaggagcacaaggccagcaccagcaccaacatctgcgagctgtgcacctgcggcgacgagatgctgagctgcatcgacctgaaccccgagcagagactgagacaggtgcccgtgcccgagcccaacacccacaacggcaccttcaccatcctgaacttccagggcaactacatcagctacatcgacggcaacgtgtggaaggcctacagctggaccgagaagctgatcctgagagagaacaacctgaccgagctgcacaaggacagcttcgagggcctgctgagcctgcagtacctggacctgagctgcaacaagatccagagcatcgagagacacaccttcgagcccctgcccttcctgaagttcatcaacctgagctgcaacgtgatcaccgagctgagcttcggcaccttccaggcctggcacggcatgcagttcctgcacaagctgatcctgaaccacaaccccctgaccaccgtggaggacccctacctgttcaagctgcccgccctgaagtacctggacatgggcaccaccctggtgcccctgaccaccctgaagaacatcctgatgatgaccgtggagctggagaagctgatcctgcccagccacatggcctgctgcctgtgccagttcaagaacagcatcgaggccgtgtgcaagaccgtgaagctgcactgcaacagcgcctgcctgaccaacaccacccactgccccgaggaggccagcgtgggcaaccccgagggcgccttcatgaaggtgctgcaggccagaaagaactacaccagcaccgagctgatcgtggagcccgaggagcccagcgacagcagcggcatcaacctgagcggcttcggcagcgagcagctggacaccaacgacgagagcgacttcatcagcaccctgagctacatcctgccctacttcagcgccgtgaacctggacgtgaagagcctgctgctgcccttcatcaagctgcccaccaccggcaacagcctggccaagatccagaccgtgggccagaacagacagagagtgaagagagtgctgatgggccccagaagcatccagaagagacacttcaaggaggtgggcagacagagcatcagaagagagcagggcgcccaggccagcgtggagaacgccgccgaggagaagagactgaccagccccgcccccagagaggtggagcagccccacacccagcagggccccgagaagctggccggcaacgccgtgtacaccaagcccagcttcacccaggagcacaaggccgccgtgagcgtgctgaagcccttcagcaagggcacccccagcaccagcagccccgccaaggccctgccccaggtgagagacagaagcaaggacctgacccacgccatcagcatcctggagagcgccaaggccagagtgaccaacaccaagaccagcaagcccatcgtgcacgccagaaagaagtacagattccacaagaccagaagccacgtgacccacagaaccaccaaggtgaagaagagccccaaggtgagaaagaagagctacctgagcagactgatgctggccaacagactgcccttcagcgccgccaagagcctgatcaacagccccagccagggcgccttcagcagcctgggcgacctgagcccccaggagaaccccttcctggaggtgagcgccctgagcgagcacttcatcgagaagaacaacaccaagcacaccaccgccagaaacgccttcgaggagaacgacttcatggagaacaccaacatgcccgagggcaccatcagcgagaacaccaactacaaccacccccccgaggccgacagcgccggcaccgccttcaacctgggccccaccgtgaagcagaccgagaccaagtgggagtacaacaacgtgggcaccgacctgagccccgagcccaagagcttcaactaccccctgctgagcagccccggcgaccagttcgagatccagctgacccagcagctgcagagcctgatccccaacaacaacgtgagaagactgatcgcccacgtgatcagaaccctgaagatggactgcagcggcgcccacgtgcaggtgacctgcgccaagctgatcagcagaaccggccacctgatgaagctgctgagcggccagcaggaggtgaaggccagcaagatcgagtgggacaccgaccagtggaagatcgagaactacatcaacgagagcaccgaggcccagagcgagcagaaggagaagagcctggagctgaagaaggaggtgcccggctacggctacaccgacaagctgatcctggccctgatcgtgaccggcatcctgaccatcctgatcatcctgttctgcctgatcgtgatctgctgccacagaagaagcctgcaggaggacgaggagggcttcagcagaggcatcttcagattcctgccctggagaggctgcagcagcagaagagagagccaggacggcctgagcagcttcggccagcccctgtggttcaaggacctgtacaagcccctgagcgccaccagaatcaacaaccacgcctggaagctgcacaagaagagcagcaacgaggacaagatcctgaacagagaccccggcgacagcgaggcccccaccgaggaggaggagagcgaggccctgccctag

SEQ ID NO: 19070 - DNA, 5103 bp, Artificial Sequence; identical to SEQ ID NO: 19069
  Description of Artificial Sequence: Synthetic coding sequence

SEQ ID NO: 19071 - DNA, 2925 bp, Artificial Sequence
  Description of Artificial Sequence: Synthetic coding sequence
atggcccacgcctacaagggccacgagcacctgagagccgccagaatggccttcgccgagtgcatcgcccccgcctgcgtgatgagctggctgagattctggggcccctggcccctgctgacctggcagctgctgagcctgctggtgaaggaggcccagcccctggtgtgggtgaaggaccccctgcagctgaccagcaaccccctgggcccccccgagccctggagcagcagaagcagccacctgccctgggagagcccccacgcccccgccccccccgccgcccccggcgacttcgactacctgggccccagcgccagcagccagatgagcgccctgccccaggagcccaccgagaacctggcccccttcctgaaggagctggacagcgccggcgagctgcccctgggccccgagcccttcctggccgcccaccaggacctgaacgacaagagaacccccgaggagagactgcccgaggtggtgcccctgctgaacagagaccagaaccaggccctggtgcagctgcccagactgaagtgggtgcagaccaccgacctggacagagccgccggccaccaggccgacgagatcctggtgcccctggacagcaaggtgagcagacccaccaagttcgtggtgagccccaagaacctgaagaaggacctggccgagagatggagcctgcccgagatcgtgggcatcccccaccagctgagcaagccccagagacagaagcagaccctgcccgacgactacctgagcatggacaccctgtaccccggcagcctgccccccgagctgagagtgaacgccgacgagccccccggcccccccgagcaggtgggcctgagccagttccacctggagcccaagagccagaaccccgagaccctggaggacatccagagcagcagcctgcaggaggaggcccccgcccagctgctgcagctgccccaggaggtggagcccagcacccagcaggaggcccccgccctgccccccgagagcagcatggagagcctggcccagacccccctgaaccacgaggtgaccgtgcagccccccggcgaggaccaggcccactacaacctgcccaagttcaccgtgaagcccgccgacgtggaggtgaccatgaccagcgagcccaagaacgagaccgagagcacccaggcccagcaggaggcccccatccagccccccgaggaggccgagcccagcagcaccgccctgagaaccaccgaccccccccccgagcaccccgaggtgaccctgccccccagcgacaagggccaggcccagcacagccacctgaccgaggccaccgtgcagcccctggacctggagctgagcatcaccaccgagcccaccaccgaggtgaagcccagccccaccaccgaggagaccagcgcccagccccccgaccccggcctggccatcacccccgagcccaccaccgagatcggccacagcaccgccctggagaagaccagagccccccaccccgaccaggtgcagaccctgcacagaagcctgaccgaggtgaccggcccccccaccaagctggagagcagccaggacagcctggtgcagagcgagaccgcccccgaggagcagaaggccagcaccagcaccaacatctgcgagctgtgcacctgcggcgacgagaccctgagctgcgtgggcctgagccccaagcagagactgagacaggtgcccgtgcccgagcccgacacctacaacggcatcttcaccaccctgaacttccagggcaactacatcagctacctggacggcaacgtgtggaaggcctacagctggaccgagaagctgatcctgagcgagaactacctgaccgagctgcccaaggacagcttcgagggcctgctgtacctgcagtacctggacctgagctgcaacaagatcagatacatcgagagacagaccttcgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgttcgagctgcccgccctgaagtacctggacatgggcaccacccacatcaccctgaccaccctgaagaacatcctgaccatgaccgtggagctggagaagctgatcctgcccagccacatggcctgctgcctgtgccagttcaagaacagcatcgaggccgtgtgcaagaccgtgaagctgcactgcaacaccgcctgcctgaccaacagcatccactgccccgaggaggccagcgtgggcaaccccgagggcgccttcatgaagatgctgcaggccagaaagcagcacatgagcacccagctgaccatcgagagcgaggcccccagcgacagcagcggcatcaacctgagcggcttcggcggcgaccagctggagatccagctgaccgagcagctgagaagcctgatccccaacgaggacgtgagaaagttcatgagccacgtgatcagaaccctgaagatggagtgcagcgagacccacgtgcagggcagctgcgccaagctgatgctgagaaccggcctgctgatgaagctgctgagcgagcagcaggaggccaaggccctgaacgtggagtgggacaccgaccagcagaagaccaactacatcaacgagaacatggagcagaacgagcagaaggagcagaagagcagcgagctgatgaaggaggtgcccggcgacgactacaagaacaagctgatcttcgccatcagcgtgaccgtgatcctgatcatcctgatcatcatcttctgcctgatcgaggtgaacagccacaagagagccagcgagaagtacaaggacaaccccagcatcagcggcgcctag

SEQ ID NO: 19072 - DNA, 2844 bp, Artificial Sequence
  Description of Artificial Sequence: Synthetic coding sequence
atgagctggctgagattctggggcccctggcccctgctgacctggcagctgctgagcctgctggtgaaggaggcccagcccctggtgtgggtgaaggaccccctgcagctgaccagcaaccccctgggcccccccgagccctggagcagcagaagcagccacctgccctgggagagcccccacgcccccgccccccccgccgcccccggcgacttcgactacctgggccccagcgccagcagccagatgagcgccctgccccaggagcccaccgagaacctggcccccttcctgaaggagctggacagcgccggcgagctgcccctgggccccgagcccttcctggccgcccaccaggacctgaacgacaagagaacccccgaggagagactgcccgaggtggtgcccctgctgaacagagaccagaaccaggccctggtgcagctgcccagactgaagtgggtgcagaccaccgacctggacagagccgccggccaccaggccgacgagatcctggtgcccctggacagcaaggtgagcagacccaccaagttcgtggtgagccccaagaacctgaagaaggacctggccgagagatggagcctgcccgagatcgtgggcatcccccaccagctgagcaagccccagagacagaagcagaccctgcccgacgactacctgagcatggacaccctgtaccccggcagcctgccccccgagctgagagtgaacgccgacgagccccccggcccccccgagcaggtgggcctgagccagttccacctggagcccaagagccagaaccccgagaccctggaggacatccagagcagcagcctgcaggaggaggcccccgcccagctgctgcagctgccccaggaggtggagcccagcacccagcaggaggcccccgccctgccccccgagagcagcatggagagcctggcccagacccccctgaaccacgaggtgaccgtgcagccccccggcgaggaccaggcccactacaacctgcccaagttcaccgtgaagcccgccgacgtggaggtgaccatgaccagcgagcccaagaacgagaccgagagcacccaggcccagcaggaggcccccatccagccccccgaggaggccgagcccagcagcaccgccctgagaaccaccgaccccccccccgagcaccccgaggtgaccctgccccccagcgacaagggccaggcccagcacagccacctgaccgaggccaccgtgcagcccctggacctggagctgagcatcaccaccgagcccaccaccgaggtgaagcccagccccaccaccgaggagaccagcgcccagccccccgaccccggcctggccatcacccccgagcccaccaccgagatcggccacagcaccgccctggagaagaccagagccccccaccccgaccaggtgcagaccctgcacagaagcctgaccgaggtgaccggcccccccaccaagctggagagcagccaggacagcctggtgcagagcgagaccgcccccgaggagcagaaggccagcaccagcaccaacatctgcgagctgtgcacctgcggcgacgagaccctgagctgcgtgggcctgagccccaagcagagactgagacaggtgcccgtgcccgagcccgacacctacaacggcatcttcaccaccctgaacttccagggcaactacatcagctacctggacggcaacgtgtggaaggcctacagctggaccgagaagctgatcctgagcgagaactacctgaccgagctgcccaaggacagcttcgagggcctgctgtacctgcagtacctggacctgagctgcaacaagatcagatacatcgagagacagaccttcgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgttcgagctgcccgccctgaagtacctggacatgggcaccacccacatcaccctgaccaccctgaagaacatcctgaccatgaccgtggagctggagaagctgatcctgcccagccacatggcctgctgcctgtgccagttcaagaacagcatcgaggccgtgtgcaagaccgtgaagctgcactgcaacaccgcctgcctgaccaacagcatccactgccccgaggaggccagcgtgggcaaccccgagggcgccttcatgaagatgctgcaggccagaaagcagcacatgagcacccagctgaccatcgagagcgaggcccccagcgacagcagcggcatcaacctgagcggcttcggcggcgaccagctggagatccagctgaccgagcagctgagaagcctgatccccaacgaggacgtgagaaagttcatgagccacgtgatcagaaccctgaagatggagtgcagcgagacccacgtgcagggcagctgcgccaagctgatgctgagaaccggcctgctgatgaagctgctgagcgagcagcaggaggccaaggccctgaacgtggagtgggacaccgaccagcagaagaccaactacatcaacgagaacatggagcagaacgagcagaaggagcagaagagcagcgagctgatgaaggaggtgcccggcgacgactacaagaacaagctgatcttcgccatcagcgtgaccgtgatcctgatcatcctgatcatcatcttctgcctgatcgaggtgaacagccacaagagagccagcgagaagtacaaggacaaccccagcatcagcggcgcctag

SEQ ID NO: 19073 - DNA, 2691 bp, Artificial Sequence
  Description of Artificial Sequence: Synthetic coding sequence
atgagctggctgagattctggggcccctggcccctgctgacctggcagctgctgagcctgctggtgaaggaggcccagcccctggtgtgggtgaaggaccccctgcagctgaccagcaaccccctgggcccccccgagccctggagcagcagaagcagccacctgccctgggagagcccccacgcccccgccccccccgccgcccccggcgacttcgactacctgggccccagcgccagcagccagatgagcgccctgccccaggagcccaccgagaacctggcccccttcctgaaggagctggacagcgccggcgagctgcccctgggccccgagcccttcctggccgcccaccaggacctgaacgacaagagaacccccgaggagagactgcccgaggtggtgcccctgctgaacagagaccagaaccaggccctggtgcagctgcccagactgaagtgggtgcagaccaccgacctggacagagccgccggccaccaggccgacgagatcctggtgcccctggacagcaaggtgagcagacccaccaagttcgtggtgagccccaagaacctgaagaaggacctggccgagagatggagcctgcccgagatcgtgggcatcccccaccagctgagcaagccccagagacagaagcagaccctgcccgacgactacctgagcatggacaccctgtaccccggcagcctgccccccgagctgagagtgaacgccgacgagccccccggcccccccgagcaggtgggcctgagccagttccacctggagcccaagagccagaaccccgagaccctggaggacatccagagcagcagcctgcaggaggaggcccccgcccagctgctgcagctgccccaggaggtggagcccagcacccagcaggaggcccccgccctgccccccgagagcagcatggagagcctggcccagacccccctgaaccacgaggtgaccgtgcagccccccggcgaggaccaggcccactacaacctgcccaagttcaccgtgaagcccgccgacgtggaggtgaccatgaccagcgagcccaagaacgagaccgagagcacccaggcccagcaggaggcccccatccagccccccgaggaggccgagcccagcagcaccgccctgagaaccaccgaccccccccccgagcaccccgaggtgaccctgccccccagcgacaagggccaggcccagcacagccacctgaccgaggccaccgtgcagcccctggacctggagctgagcatcaccaccgagcccaccaccgaggtgaagcccagccccaccaccgaggagaccagcgcccagccccccgaccccggcctggccatcacccccgagcccaccaccgagatcggccacagcaccgccctggagaagaccagagccccccaccccgaccaggtgcagaccctgcacagaagcctgaccgaggtgaccggcccccccaccaagctggagagcagccaggacagcctggtgcagagcgagaccgcccccgaggagcagaaggccagcaccagcaccaacatctgcgagctgtgcacctgcggcgacgagaccctgagctgcgtgggcctgagccccaagcagagactgagacaggtgcccgtgcccgagcccgacacctacaacggcatcttcaccaccctgaacttccagggcaactacatcagctacctggacggcaacgtgtggaaggcctacagctggaccgagaagctgatcctgagcgagaactacctgaccgagctgcccaaggacagcttcgagggcctgctgtacctgcagtacctgatcctgaacagaaaccccctgaccaccgtggaggacccctacctgttcgagctgcccgccctgaagtacctggacatgggcaccacccacatcaccctgaccaccctgaagaacatcctgaccatgaccgtggagctggagaagctgatcctgcccagccacatggcctgctgcctgtgccagttcaagaacagcatcgaggccgtgtgcaagaccgtgaagctgcactgcaacaccgcctgcctgaccaacagcatccactgccccgaggaggccagcgtgggcaaccccgagggcgccttcatgaagatgctgcaggccagaaagcagcacatgagcacccagctgaccatcgagagcgaggcccccagcgacagcagcggcatcaacctgagcggcttcggcggcgaccagctggagatccagctgaccgagcagctgagaagcctgatccccaacgaggacgtgagaaagttcatgagccacgtgatcagaaccctgaagatggagtgcagcgagacccacgtgcagggcagctgcgccaagctgatgctgagaaccggcctgctgatgaagctgctgagcgagcagcaggaggccaaggccctgaacgtggagtgggacaccgaccagcagaagaccaactacatcaacgagaacatggagcagaacgagcagaaggagcagaagagcagcgagctgatgaaggaggtgcccggcgacgactacaagaacaagctgatcttcgccatcagcgtgaccgtgatcctgatcatcctgatcatcatcttctgcctgatcgaggtgaacagccacaagagagccagcgagaagtacaaggacaaccccagcatcagcggcgcctag

SEQ ID NO: 19074 - DNA, 2598 bp, Artificial Sequence
  Description of Artificial Sequence: Synthetic coding sequence
atgagcgccctgccccaggagcccaccgagaacctggcccccttcctgaaggagctggacagcgccggcgagctgcccctgggccccgagcccttcctggccgcccaccaggacctgaacgacaagagaacccccgaggagagactgcccgaggtggtgcccctgctgaacagagaccagaaccaggccctggtgcagctgcccagactgaagtgggtgcagaccaccgacctggacagagccgccggccaccaggccgacgagatcctggtgcccctggacagcaaggtgagcagacccaccaagttcgtggtgagccccaagaacctgaagaaggacctggccgagagatggagcctgcccgagatcgtgggcatcccccaccagctgagcaagccccagagacagaagcagaccctgcccgacgactacctgagcatggacaccctgtaccccggcagcctgccccccgagctgagagtgaacgccgacgagccccccggcccccccgagcaggtgggcctgagccagttccacctggagcccaagagccagaaccccgagaccctggaggacatccagagcagcagcctgcaggaggaggcccccgcccagctgctgcagctgccccaggaggtggagcccagcacccagcaggaggcccccgccctgccccccgagagcagcatggagagcctggcccagacccccctgaaccacgaggtgaccgtgcagccccccggcgaggaccaggcccactacaacctgcccaagttcaccgtgaagcccgccgacgtggaggtgaccatgaccagcgagcccaagaacgagaccgagagcacccaggcccagcaggaggcccccatccagccccccgaggaggccgagcccagcagcaccgccctgagaaccaccgaccccccccccgagcaccccgaggtgaccctgccccccagcgacaagggccaggcccagcacagccacctgaccgaggccaccgtgcagcccctggacctggagctgagcatcaccaccgagcccaccaccgaggtgaagcccagccccaccaccgaggagaccagcgcccagccccccgaccccggcctggccatcacccccgagcccaccaccgagatcggccacagcaccgccctggagaagaccagagccccccaccccgaccaggtgcagaccctgcacagaagcctgaccgaggtgaccggcccccccaccaagctggagagcagccaggacagcctggtgcagagcgagaccgcccccgaggagcagaaggccagcaccagcaccaacatctgcgagctgtgcacctgcggcgacgagaccctgagctgcgtgggcctgagccccaagcagagactgagacaggtgcccgtgcccgagcccgacacctacaacggcatcttcaccaccctgaacttccagggcaactacatcagctacctggacggcaacgtgtggaaggcctacagctggaccgagaagctgatcctgagcgagaactacctgaccgagctgcccaaggacagcttcgagggcctgctgtacctgcagtacctggacctgagctgcaacaagatcagatacatcgagagacagaccttcgagagcctgcccttcctgcagtacatcaacctgggctgcaacctgatcaccaagctgagcctgggcaccttccaggcctggcacggcatgcagttcctgcacaacctgatcctgaacagaaaccccctgaccaccgtggaggacccctacctgttcgagctgcccgccctgaagtacctggacatgggcaccacccacatcaccctgaccaccctgaagaacatcctgaccatgaccgtggagctggagaagctgatcctgcccagccacatggcctgctgcctgtgccagttcaagaacagcatcgaggccgtgtgcaagaccgtgaagctgcactgcaacaccgcctgcctgaccaacagcatccactgccccgaggaggccagcgtgggcaaccccgagggcgccttcatgaagatgctgcaggccagaaagcagcacatgagcacccagctgaccatcgagagcgaggcccccagcgacagcagcggcatcaacctgagcggcttcggcggcgaccagctggagatccagctgaccgagcagctgagaagcctgatccccaacgaggacgtgagaaagttcatgagccacgtgatcagaaccctgaagatggagtgcagcgagacccacgtgcagggcagctgcgccaagctgatgctgagaaccggcctgctgatgaagctgctgagcgagcagcaggaggccaaggccctgaacgtggagtgggacaccgaccagcagaagaccaactacatcaacgagaacatggagcagaacgagcagaaggagcagaagagcagcgagctgatgaaggaggtgcccggcgacgactacaagaacaagctgatcttcgccatcagcgtgaccgtgatcctgatcatcctgatcatcatcttctgcctgatcgaggtgaacagccacaagagagccagcgagaagtacaaggacaaccccagcatcagcggcgcctag

SEQ ID NO: 19075 - DNA, 885 bp, Artificial Sequence
  Description of Artificial Sequence: Synthetic coding sequence
atgagacccagagcccccgcctgcgccgccgccgccctgggcctgtgcagcctgctgctgctgctggcccccggccacgcctgccccgccggctgcgcctgcaccgacccccacaccgtggactgcagagacagaggcctgcccagcgtgcccgaccccttccccctggacgtgagaaagctgctggtggccggcaacagaatccagagaatccccgaggacttcttcatcttctacggcgacctggtgtacctggacttcagaaacaacagcctgagaagcctggaggagggcaccttcagcggcagcgccaagctggtgttcctggacctgagctacaacaacctgacccagctgggcgccggcgccttcagaagcgccggcagactggtgaagctgagcctggccaacaacaacctggtgggcgtgcacgaggacgccttcgagaccctggagagcctgcaggtgctggagctgaacgacaacaacctgagaagcctgagcgtggccgccctggccgccctgcccgccctgagaagcctgagactggacggcaacccctggctgtgcgactgcgacttcgcccacctgttcagctggatccaggagaacgccagcaagctgcccaagggcctggacgagatccagtgcagcctgcccatggagagcagaagaatcagcctgagagagctgagcgaggccagcttcagcgagtgcagattcagcctgagcctgaccgacctgtgcatcatcatcttcagcggcgtggccgtgagcatcgccgccatcatcagcagcttcttcctggccaccgtggtgcagtgcctgcagagatgcgcccccaacaaggacgccgaggacgaggacgaggacaaggacgactag

SEQ ID NO: 19076 - DNA, 780 bp, Artificial Sequence
  Description of Artificial Sequence: Synthetic coding sequence
atgaacctggtggacctgtggctgaccagaagcctgagcatgtgcctgctgctgcagagcttcgtgctgatgatcctgtgcttccacagcgccagcatgtgccccaagggctgcctgtgcagcagcagcggcggcctgaacgtgacctgcagcaacgccaacctgaaggagatccccagagacctgccccccgagaccgtgctgctgtacctggacagcaaccagatcaccagcatccccaacgagatcttcaaggacctgcaccagctgagagtgctgaacctgagcaagaacggcatcgagttcatcgacgagcacgccttcaagggcgtggccgagaccctgcagaccctggacctgagcgacaacagaatccagagcgtgcacaagaacgccttcaacaacctgaaggccagagccagaatcgccaacaacccctggcactgcgactgcaccctgcagcaggtgctgagaagcatggccagcaaccacgagaccgcccacaacgtgatctgcaagaccagcgtgctggacgagcacgccggcagacccttcctgaacgccgccaacgacgccgacctgtgcaacctgcccaagaagaccaccgactacgccatgctggtgaccatgttcggctggttcaccatggtgatcagctacgtggtgtactacgtgagacagaaccaggaggacgccagaagacacctggagtacctgaagagcctgcccagcagacagaagaaggccgacgagcccgacgacatcagcaccgtggtgtag

SEQ ID NO: 19077 - DNA, 168 bp, Artificial Sequence
  Description of Artificial Sequence: Synthetic coding sequence
atgaacctggtggacctgtggctgaccagaagcctgagcatgtgcctgctgctgcagagcttcgtgctgatgatcctgtgcttccacagcgccagcatgtgccccaagggctgcctgtgcagcagcagcggcggcctgaacgtgacctgcagcaacgccaacctgtag

SEQ ID NO: 19078 - DNA, 780 bp, Artificial Sequence; identical to SEQ ID NO: 19076
  Description of Artificial Sequence: Synthetic coding sequence

SEQ ID NO: 19079 - DNA, 492 bp, Artificial Sequence
  Description of Artificial Sequence: Synthetic coding sequence
atgaacctggtggacctgtggctgaccagaagcctgagcatgtgcctgctgctgcagagcttcgtgctgatgatcctgtgcttccacagcgccagcatgtgccccaagggctgcctgtgcagcagcagcggcggcctgaacgtgacctgcagcaacgccaacctgaaggagatccccagagacctgccccccgagaccgtgctgctgtacctggacagcaaccagatcaccagcatccccaacgagatcttcaaggacctgcaccagctgagagtgctgaacctgagcaagaacggcatcgagttcatcgacgagcacgccttcaagggcgtggccgagaccctgcagaccctggacctgagcgacaacagaatccagagcgtgcacaagaacgccttcaacaacctgaaggccagagccagaatcgccaacaacccctggcactgcgactgcaccctgcagcaggtgctgagaagcatggccagcaactag

SEQ ID NO: 19080 - DNA, 780 bp, Artificial Sequence; identical to SEQ ID NO: 19076
  Description of Artificial Sequence: Synthetic coding sequence

SEQ ID NO: 19081 - DNA, 828 bp, Artificial Sequence
  Description of Artificial Sequence: Synthetic coding sequence
atgagaatgaccagcagcagcttcgtgagctactgcacccccggcctgtgccagttcatggccatgctgcccaccgccggccacctgctgcccctgctgctggtgatcggcaccggcggcaccgtgcccagcccccaggtgccccccagaggctgctacgtggccaaggaggccggcgagagaaccttcagatgcagccaggccggcctgagcgccgtgcccagcggcatccccaacgacaccagaaagctgtacctggacgccaaccagctggccagcgtgcccgccggcgccttccagcacctgcccgtgctggaggagctggacctgagccacaacgccctggcccacctgagcggcgccgccttccagggcctggagggcaccctgagacacctggacctgagcgccaaccagctggccagcgtgcccgtggaggccttcgtgggcctgcagatccaggtgaacctgagcgccaacccctggcactgcgactgcgccctgcaggaggtgctgagacaggtgagactggtgcccggcaccggcaccggcatcgtgtgcggcagcggcgccagacccgacctggtgggccaggagttcctgctgctggccggcgaggaggagctgtgcggcagcggctggggcggcgccagaagaagcaccgacgtggccctgctggtgaccatgggcggctggctgaccctgatggtggcctacctggtgcactacgtgtggcagaacagagacgagaccagaagaagcctgaagagagcccccgtgctgcccgtgagaagcgaggacagcagcatcctgagcaccgtggtgtag

SEQ ID NO: 19082 - DNA, 1962 bp, Artificial Sequence
  Description of Artificial Sequence: Synthetic coding sequence
atgaagctgctgtggcaggtgaccgtgcaccaccacacctggaacgccatcctgctgcccttcgtgtacctgaccgcccaggtgtggatcctgtgcgccgccatcgccgccgccgccagcgccggcccccagaactgccccagcgtgtgcagctgcagcaaccagttcagcaaggtggtgtgcaccagaagaggcctgagcgaggtgccccagggcatccccagcaacaccagatacctgaacctgatggagaacaacatccagatgatccaggccgacaccttcagacacctgcaccacctggaggtgctgcagctgggcagaaacagcatcagacagatcgaggtgggcgccttcaacggcctggccagcctgaacaccctggagctgttcgacaactggctgaccgtgatccccagcggcgccttcgagtacctgagcaagctgagagagctgtggctgagaaacaaccccatcgagagcatccccagctacgccttcaacagagtgcccagcctgatgagactggacctgggcgagctgaagaagctggagtacatcagcgagggcgccttcgagggcctgttcaacctgaagtacctgaacctgggcatgtgcaacatcaaggacatgcccaacctgacccccctggtgggcctggaggagctggagatgagcggcaaccacttccccgagatcagacccggcagcttccacggcctgagcagcctgaagaagctgtgggtgatgaacagccaggtgagcctgatcgagagaaacgccttcgacggcctggccagcctggtggagctgaacctggcccacaacaacctgagcagcctgccccacgacctgttcacccccctgagatacctggtggagctgcacctgcaccacaacccctggaactgcgactgcgacatcctgtggctggcctggtggctgagagagtacatccccaccaacagcacctgctgcggcagatgccacgcccccatgcacatgagaggcagatacctggtggaggtggaccaggccagcttccagtgcagcgcccccttcatcatggacgcccccagagacctgaacatcagcgagggcagaatggccgagctgaagtgcagaaccccccccatgagcagcgtgaagtggctgctgcccaacggcaccgtgctgagccacgccagcagacaccccagaatcagcgtgctgaacgacggcaccctgaacttcagccacgtgctgctgagcgacaccggcgtgtacacctgcatggtgaccaacgtggccggcaacagcaacgccagcgcctacctgaacgtgagcaccgccgagctgaacaccagcaactacagcttcttcaccaccgtgaccgtggagaccaccgagatcagccccgaggacaccaccagaaagtacaagcccgtgcccaccaccagcaccggctaccagcccgcctacaccaccagcaccaccgtgctgatccagaccaccagagtgcccaagcaggtggccgtgcccgccaccgacaccaccgacaagatgcagaccagcctggacgaggtgatgaagaccaccaagatcatcatcggctgcttcgtggccgtgaccctgctggccgccgccatgctgatcgtgttctacaagctgagaaagagacaccagcagagaagcaccgtgaccgccgccagaaccgtggagatcatccaggtggacgaggacatccccgccgccaccagcgccgccgccaccgccgcccccagcggcgtgagcggcgagggcgccgtggtgctgcccaccatccacgaccacatcaactacaacacctacaagcccgcccacggcgcccactggaccgagaacagcctgggcaacagcctgcaccccaccgtgaccaccatcagcgagccctacatcatccagacccacaccaaggacaaggtgcaggagacccagatctag

SEQ ID NO: 19083 - DNA, 285 bp, Artificial Sequence
  Description of Artificial Sequence: Synthetic coding sequence
atgaagctgctgtggcaggtgaccgtgcaccaccacacctggaacgccatcctgctgcccttcgtgtacctgaccgcccaggtgtggatcctgtgcgccgccatcgccgccgccgccagcgccggcccccagaactgccccagcgtgtgcagctgcagcaaccagttcagcaaggtggtgtgcaccagaagaggcctgagcgaggtgccccagggcatccccagcaacaccagatacctgaacctgatggagaacaacatccagatgatccaggccgacacctag

SEQ ID NO: 19084 - DNA, 156 bp, Artificial Sequence
  Description of Artificial Sequence: Synthetic coding sequence
atgaagctgctgtggcaggtgaccgtgcaccaccacacctggaacgccatcctgctgcccttcgtgtacctgaccgcccaggtgtggatcctgtgcgccgccatcgccgccgccgccagcgccggcccccagaactgccccagcgtgtgcagctag

SEQ ID NO: 19085 - DNA, 2142 bp, Artificial Sequence
  Description of Artificial Sequence: Synthetic coding sequence
atggccagagccagaggcagcccctgcccccccctgccccccggcagaatgagctggccccacggcgccctgctgttcctgtggctgttcagcccccccctgggcgccggcggcggcggcgtggccgtgaccagcgccgccggcggcggcagcccccccgccaccagctgccccgtggcctgcagctgcagcaaccaggccagcagagtgatctgcaccagaagagacctggccgaggtgcccgccagcatccccgtgaacaccagatacctgaacctgcaggagaacggcatccaggtgatcagaaccgacaccttcaagcacctgagacacctggagatcctgcagctgagcaagaacctggtgagaaagatcgaggtgggcgccttcaacggcctgcccagcctgaacaccctggagctgttcgacaacagactgaccaccgtgcccacccaggccttcgagtacctgagcaagctgagagagctgtggctgagaaacaaccccatcgagagcatccccagctacgccttcaacagagtgcccagcctgagaagactggacctgggcgagctgaagagactggagtacatcagcgaggccgccttcgagggcctggtgaacctgagatacctgaacctgggcatgtgcaacctgaaggacatccccaacctgaccgccctggtgagactggaggagctggagctgagcggcaacagactggacctgatcagacccggcagcttccagggcctgaccagcctgagaaagctgtggctgatgcacgcccaggtggccaccatcgagagaaacgccttcgacgacctgaagagcctggaggagctgaacctgagccacaacaacctgatgagcctgccccacgacctgttcacccccctgcacagactggagagagtgcacctgaaccacaacccctggcactgcaactgcgacgtgctgtggctgagctggtggctgaaggagaccgtgcccagcaacaccacctgctgcgccagatgccacgcccccgccggcctgaagggcagatacatcggcgagctggaccagagccacttcacctgctacgcccccgtgatcgtggagccccccaccgacctgaacgtgaccgagggcatggccgccgagctgaagtgcagaaccggcaccagcatgaccagcgtgaactggctgacccccaacggcaccctgatgacccacggcagctacagagtgagaatcagcgtgctgcacgacggcaccctgaacttcaccaacgtgaccgtgcaggacaccggccagtacacctgcatggtgaccaacagcgccggcaacaccaccgccagcgccaccctgaacgtgagcgccgtggaccccgtggccgccggcggcaccggcagcggcggcggcggccccggcggcagcggcggcgtgggcggcggcagcggcggctacacctacttcaccaccgtgaccgtggagaccctggagacccagcccggcgaggaggccctgcagcccagaggcaccgagaaggagccccccggccccaccaccgacggcgtgtggggcggcggcagacccggcgacgccgccggccccgccagcagcagcaccaccgcccccgcccccagaagcagcagacccaccgagaaggccttcaccgtgcccatcaccgacgtgaccgagaacgccctgaaggacctggacgacgtgatgaagaccaccaagatcatcatcggctgcttcgtggccatcaccttcatggccgccgtgatgctggtggccttctacaagctgagaaagcagcaccagctgcacaagcaccacggccccaccagaaccgtggagatcatcaacgtggaggacgagctgcccgccgccagcgccgtgagcgtggccgccgccgccgccgtggccagcggcggcggcgtgggcggcgacagccacctggccctgcccgccctggagagagaccacctgaaccaccaccactacgtggccgccgccttcaaggcccactacagcagcaaccccagcggcggcggctgcggcggcaagggcccccccggcctgaacagcatccacgagcccctgctgttcaagagcggcagcaaggagaacgtgcaggagacccagatctag

SEQ ID NO: 19086 - DNA, 1266 bp, Artificial Sequence
  Description of Artificial Sequence: Synthetic coding sequence
atggccagagccagaggcagcccctgcccccccctgccccccggcagaatgagctggccccacggcgccctgctgttcctgtggctgttcagcccccccctgggcgccggcggcggcggcgtggccgtgaccagcgccgccggcggcggcagcccccccgccaccagctgccccgtggcctgcagctgcagcaaccaggccagcagagtgatctgcaccagaagagacctggccgaggtgcccgccagcatccccgtgaacaccagatacctgaacctgcaggagaacggcatccaggtgatcagaaccgacaccttcaagcacctgagacacctggagatcctgcagctgagcaagaacctggtgagaaagatcgaggtgggcgccttcaacggcctgcccagcctgaacaccctggagctgttcgacaacagactgaccaccgtgcccacccaggccttcgagtacctgagcaagctgagagagctgtggctgagaaacaaccccatcgagagcatccccagctacgccttcaacagagtgcccagcctgagaagactggacctgggcgagctgaagagactggagtacatcagcgaggccgccttcgagggcctggtgaacctgagatacctgaacctgggcatgtgcaacctgaaggacatccccaacctgaccgccctggtgagactggaggagctggagctgagcggcaacagactggacctgatcagacccggcagcttccagggcctgaccagcctgagaaagctgtggctgatgcacgcccaggtggccaccatcgagagaaacgccttcgacgacctgaagagcctggaggagctgaacctgagccacaacaacctgatgagcctgccccacgacctgttcacccccctgcacagactggagagagtgcacctgaaccacaacccctggcactgcaactgcgacgtgctgtggctgagctggtggctgaaggagaccgtgcccagcaacaccacctgctgcgccagatgccacgcccccgccggcctgaagggcagatacatcggcgagctggaccagagccacttcacctgctacgcccccgtgatcgtggagccccccaccgacctgaacgtgaccgagggcatggccgccgagctgaagtgcagaaccggcaccagcatgaccagcgtgaactggtggccccagctgcaccccagaaccagcgccctgcaggagagactgcagggcgagagagccagagacgccgacctgtag

SEQ ID NO: 19087 - DNA, 942 bp, Artificial Sequence
  Description of Artificial Sequence: Synthetic coding sequence
atgagcctggccagcggccccggccccggctggctgctgttcagcttcggcatgggcctggtgagcggcagcaagtgccccaacaactgcctgtgccaggcccaggaggtgatctgcaccggcaagcagctgaccgagtaccccctggacatccccctgaacaccagaagactgttcctgaacgagaacagaatcaccagcctgcccgccatgcacctgggcctgctgagcgacctggtgtacctggactgccagaacaacagaatcagagaggtgatggactacaccttcatcggcgtgttcaagctgatctacctggacctgagcagcaacaacctgaccagcatcagccccttcaccttcagcgtgctgagcaacctggtgcagctgaacatcgccaacaacccccacctgctgagcctgcacaagttcaccttcgccaacaccaccagcctgagatacctggacctgagaaacaccggcctgcagaccctggacagcgccgccctgtaccacctgaccaccctggagaccctgttcctgagcggcaacccctggaagtgcaactgcagcttcctggacttcgccatcttcctgatcgtgttccacatggaccccagcgacgacctgaacgccacctgcgtggagcccaccgagctgaccggctggcccatcaccagagtgggcaaccccctgagatacatgtgcatcacccacctggaccacaaggactacatcttcctgctgctgatcggcttctgcatcttcgccgccggcaccgtggccgcctggctgaccggcgtgtgcgccgtgctgtaccagaacaccagacacaagagcagcgaggaggacgaggacgaggccggcaccagagtggaggtgagcagaagaatcttccagacccagaccagcagcgtgcaggagttcccccagctgatctag

SEQ ID NO: 19088 - DNA, 1026 bp, Artificial Sequence
  Description of Artificial Sequence: Synthetic coding sequence
atgctgagaagccccaccttcaccgacgccggccccagatgcagctgcctgcccgtgagccagaccctggacagcatggacaccgtgctgatgggcagcctgcagcactgctgctgcctgctgcccaagatgggcgacacctgggcccagctgccctggcccggccccccccaccccgccatgctgctgatcagcctgctgctggccgccggcctgatgcacagcgacgccggcaccagctgccccgtgctgtgcacctgcagaaaccaggtggtggactgcagcagccagagactgttcagcgtgccccccgacctgcccatggacaccagaaacctgagcctggcccacaacagaatcaccgccgtgccccccggctacctgacctgctacatggagctgcaggtgctggacctgcacaacaacagcctgatggagctgcccagaggcctgttcctgcacgccaagagactggcccacctggacctgagctacaacaacttcagccacgtgcccgccgacatgttccaggaggcccacggcctggtgcacatcgacctgagccacaacccctggctgagaagagtgcacccccaggccttccagggcctgatgcagctgagagacctggacctgagctacggcggcctggccttcctgagcctggaggccctggagggcctgcccggcctggtgaccctgcagatcggcggcaacccctgggtgtgcggctgcaccatggagcccctgctgaagtggctgagaaacagaatccagagatgcaccgccgacagccagctggccgagtgcagaggcccccccgaggtggagggcgcccccctgttcagcctgaccgaggagagcttcaaggcctgccacctgaccctgaccctggacgactacctgttcatcgccttcgtgggcttcgtggtgagcatcgccagcgtggccaccaacttcctgctgggcatcaccgccaactgctgccacagatggagcaaggccagcgaggaggaggagatctag

SEQ ID NO: 19089 - DNA, 447 bp, Artificial Sequence
  Description of Artificial Sequence: Synthetic coding sequence
atggccagcgtggtgctggccctgagaaccagaaccgccgtgaccagcctgctgagccccacccccgccaccgccctggccgtgagatacgccagcaagaagagcggcggcagcagcaagaacctgggcggcaagagcagcggcagaagacagggcatcaagaagatggagggccactacgtgcacgccggcaacatcatcgccacccagagacacttcagatggcaccccggcgcccacgtgggcgtgggcaagaacaagtgcctgtacgccctggaggagggcatcgtgagatacaccaaggaggtgtacgtgccccaccccagaaacaccgaggccgtggacctgatcaccagactgcccaagggcgccgtgctgtacaagaccttcgtgcacgtggtgcccgccaagcccgagggcaccttcaagctggtggccatgctgtag

SEQ ID NO: 19090 - DNA, 2643 bp, Artificial Sequence
  Description of Artificial Sequence: Synthetic coding sequence
atgaagaacctgtacttcagagtgatcaccatcgtgatcggcctgtacttcaccggcatcatgaccaacgccagcagaaagagcaacatcctgttcaacagcgagtgccagtggaacgagtacatcctgaccaactgcagcttcaccggcaagtgcgacatccccgtggacatcagccagaccgccgccaccgtggacgtgagcttcaacttcttcagagtgctgctgcagagccacaccaagaaggaggagtggaagatcaagcacctggacctgagcaacaacctgatcagcaagatcaccctgagccccttcgcctacctgcacgccctggaggtgctgaacctgagcaacaacgccatccacagcctgagcctggacctgctgagccccaagagcagctgggtgaagagacacagaagcagcttcagaaacagattccccctgctgaaggtgctgatcctgcagagaaacaagctgagcgacacccccaagggcctgtggaagctgaagagcctgcagagcctggacctgagcttcaacggcatcctgcagatcggctggagcgacttccacaactgcctgcagctggagaacctgtgcctgaagagcaacaagatcttcaagatccccccccaggccttcaaggacctgaagaagctgcaggtgatcgacctgagcaacaacgccctgatcaccatcctgcccatgatgatcatcgccctggagttcccccacctggtggtggacctggccgacaacaactggcagtgcgacgacagcgtggccgtgttccagaacttcatcagcgagagctggagaaagaagtggaacgtgatctgcaacagaagcatcggcagcgaggaggccaacggcggcaccccccagagcagaatcagcagagagaccagactgccccccatccacctgcacagaatgaagagcctgatcagaagcaaggccgagagaccccagggcggcagacacaccggcatcagcaccctgggcaagaaggccaaggccggcagcggcctgagaaagaagcagagaagactgcccagaagcgtgagaagcaccagagacgtgcaggccgccggcaagaaggaggacgccccccaggacctggccctggccgtgtgcctgagcgtgttcatcaccttcctggtggccttcagcctgggcgccttcaccagaccctacgtggacagactgtggcagaagaagtgccagagcaagagccccggcctggacaacgcctacagcaacgagggcttctacgacgacatggaggccgccggccacaccccccaccccgagacccacctgagacaggtgttcccccacctgagcctgtacgagaaccagacccccttctgggtgacccagccccacccccacgccaccgtgatccccgacagaaccctgggcagaagcagaaaggaccccggcagcagccagagccccggccagtgcggcgacaacaccggcgccggcagcggcaacgacggcgccgtgtacagcatcctgcagagacacccccacgccggcaacagagagctgatgagcgccgcccaggaccacatccacagaaacgacatcctgggcgagtggacctacgagaccgtggcccaggaggagcccctgagcgcccacagcgtgggcgtgagcagcgtggccggcaccagccacgccgtgagcggcagcagcagatacgacagcaacgagctggaccccagcctgagcggcgagatcaccgccagcctgtgcaagatgctgacccacgccgaggcccagagaaccggcgacagcaaggagagaggcggcaccgagcagagcctgtgggacagccagatggagttcagcaaggagagacaggtgagcagcagcatcgacctgctgagcatccagcagcccagactgagcggcgccagagccgaggaggccctgagcgcccactacagcgaggtgccctacggcgaccccagagacaccggccccagcgtgttcccccccagatgggacagcggcctggacgtgacccccgccaacaaggagcccgtgcagaagagcacccccagcgacacctgctgcgagctggagagcgactgcgacagcgacgagggcagcctgttcaccctgagcagcatcagcagcgagagcgccagaagcaagaccgaggaggccgtgcccgacgaggagagcctgcaggacgagagcagcggcgccagcaaggacaacgtgaccgccgtggacagcctggaggagaacgtgaccttccagaccatccccggcaagtgcaagaaccaggaggaccccttcgagaagcccctgatcagcgcccccgacagcggcatgtacaagacccacctggagaacgccagcgacaccgacagaagcgagggcctgagcccctggcccagaagccccggcaacagccccctgggcgacgagttccccggcatgttcacctacgactacgacaccgccctgcagagcaaggccgccgagtggcactgcagcctgagagacctggagttcagcaacgtggacgtgctgcagcagacccccccctgcagcgccgaggtgcccagcgaccccgacaaggccgccttccacgagagagacagcgacatcctgaagtag

SEQ ID NO: 19091 - DNA, 1869 bp, Artificial Sequence
  Description of Artificial Sequence: Synthetic coding sequence
atgtgcggcctgcagttcagcctgccctgcctgagactgttcctggtggtgacctgctacctgctgctgctgctgcacaaggagatcctgggctgcagcagcgtgtgccagctgtgcaccggcagacagatcaactgcagaaacctgggcctgagcagcatccccaagaacttccccgagagcaccgtgttcctgtacctgaccggcaacaacatcagctacatcaacgagagcgagctgaccggcctgcacagcctggtggccctgtacctggacaacagcaacatcctgtacgtgtaccccaaggccttcgtgcagctgagacacctgtacttcctgttcctgaacaacaacttcatcaagagactggaccccggcatcttcaagggcctgctgaacctgagaaacctgtacctgcagtacaaccaggtgagcttcgtgcccagaggcgtgttcaacgacctggtgagcgtgcagtacctgaacctgcagagaaacagactgaccgtgctgggcagcggcaccttcgtgggcatggtggccctgagaatcctggacctgagcaacaacaacatcctgagaatcagcgagagcggcttccagcacctggagaacctggcctgcctgtacctgggcagcaacaacctgaccaaggtgcccagcaacgccttcgaggtgctgaagagcctgagaagactgagcctgagccacaaccccatcgaggccatccagcccttcgccttcaagggcctggccaacctggagtacctgctgctgaagaacagcagaatcagaaacgtgaccagagacggcttcagcggcatcaacaacctgaagcacctgatcctgagccacaacgacctggagaacctgaacagcgacaccttcagcctgctgaagaacctgatctacctgaagctggacagaaacagaatcatcagcatcgacaacgacaccttcgagaacatgggcgccagcctgaagatcctgaacctgagcttcaacaacctgaccgccctgcaccccagagtgctgaagcccctgagcagcctgatccacctgcaggccaacagcaacccctgggagtgcaactgcaagctgctgggcctgagagactggctggccagcagcgccatcaccctgaacatctactgccagaacccccccagcatgagaggcagagccctgagatacatcaacatcaccaactgcgtgaccagcagcatcaacgtgagcagagcctgggccgtggtgaagagcccccacatccaccacaagaccaccgccctgatgatggcctggcacaaggtgaccaccaacggcagccccctggagaacaccgagaccgagaacatcaccttctgggagagaatccccaccagccccgccggcagattcttccaggagaacgccttcggcaaccccctggagaccaccgccgtgctgcccgtgcagatccagctgaccaccagcgtgaccctgaacctggagaagaacagcgccctgcccaacgacgccgccagcatgagcggcaagaccagcctgatctgcacccaggaggtggagaagctgaacgaggccttcgacatcctgctggccttcttcatcctggcctgcgtgctgatcatcttcctgatctacaaggtggtgcagttcaagcagaagctgaaggccagcgagaacagcagagagaacagactggagtactacagcttctaccagagcgccagatacaacgtgaccgccagcatctgcaacaccagccccaacagcctggagagccccggcctggagcagatcagactgcacaagcagatcgtgcccgagaacgaggcccaggtgatcctgttcgagcacagcgccctgtag

SEQ ID NO: 19092 - DNA, 2151 bp, Artificial Sequence
  Description of Artificial Sequence: Synthetic coding sequence
atggccagaatgagcttcgtgatcgccgcctgccagctggtgctgggcctgctgatgaccagcctgaccgagagcagcatccagaacagcgagtgcccccagctgtgcgtgtgcgagatcagaccctggttcaccccccagagcacctacagagaggccaccaccgtggactgcaacgacctgagactgaccagaatccccagcaacctgagcagcgacacccaggtgctgctgctgcagagcaacaacatcgccaagaccgtggacgagctgcagcagctgttcaacctgaccgagctggacttcagccagaacaacttcaccaacatcaaggaggtgggcctggccaacctgacccagctgaccaccctgcacctggaggagaaccagatcaccgagatgaccgactactgcctgcaggacctgagcaacctgcaggagctgtacatcaaccacaaccagatcagcaccatcagcgcccacgccttcgccggcctgaagaacctgctgagactgcacctgaacagcaacaagctgaaggtgatcgacagcagatggttcgacagcacccccaacctggagatcctgatgatcggcgagaaccccgtgatcggcatcctggacatgaacttcaagcccctggccaacctgagaagcctggtgctggccggcatgtacctgaccgacatccccggcaacgccctggtgggcctggacagcctggagagcctgagcttctacgacaacaagctggtgaaggtgccccagctggccctgcagaaggtgcccaacctgaagttcctggacctgaacaagaaccccatccacaagatccaggagggcgacttcaagaacatgctgagactgaaggagctgggcatcaacaacatgggcgagctggtgagcgtggacagatacgccctggacaacctgcccgagctgaccaagctggaggccaccaacaaccccaagctgagctacatccacagactggccttcagaagcgtgcccgccctggagagcctgatgctgaacaacaacgccctgaacgccatctaccagaagaccgtggagagcctgcccaacctgagagagatcagcatccacagcaaccccctgagatgcgactgcgtgatccactggatcaacagcaacaagaccaacatcagattcatggagcccctgagcatgttctgcgccatgccccccgagtacaagggccaccaggtgaaggaggtgctgatccaggacagcagcgagcagtgcctgcccatgatcagccacgacagcttccccaacagactgaacgtggacatcggcaccaccgtgttcctggactgcagagccatggccgagcccgagcccgagatctactgggtgacccccatcggcaacaagatcaccgtggagaccctgagcgacaagtacaagctgagcagcgagggcaccctggagatcagcaacatccagatcgaggacagcggcagatacacctgcgtggcccagaacgtgcagggcgccgacaccagagtggccaccatcaaggtgaacggcaccctgctggacggcacccaggtgctgaagatctacgtgaagcagaccgagagccacagcatcctggtgagctggaaggtgaacagcaacgtgatgaccagcaacctgaagtggagcagcgccaccatgaagatcgacaacccccacatcacctacaccgccagagtgcccgtggacgtgcacgagtacaacctgacccacctgcagcccagcaccgactacgaggtgtgcctgaccgtgagcaacatccaccagcagacccagaagagctgcgtgaacgtgaccaccaagaacgccgccttcgccgtggacatcagcgaccaggagaccagcaccgccctggccgccgtgatgggcagcatgttcgccgtgatcagcctggccagcatcgccgtgtacttcgccaagagattcaagagaaagaactaccaccacagcctgaagaagtacatgcagaagaccagcagcatccccctgaacgagctgtacccccccctgatcaacctgtgggagggcgacagcgagaaggacaaggacggcagcgccgacaccaagcccacccaggtggacaccagcagaagctactacatgtggtag

SEQ ID NO: 19093 - DNA, 2142 bp, Artificial Sequence
  Description of Artificial Sequence: Synthetic coding sequence
atgagactgctggtggcccccctgctgctggcctgggtggccggcgccaccgccgccgtgcccgtggtgccctggcacgtgccctgccccccccagtgcgcctgccagatcagaccctggtacacccccagaagcagctacagagaggccaccaccgtggactgcaacgacctgttcctgaccgccgtgccccccgccctgcccgccggcacccagaccctgctgctgcagagcaacagcatcgtgagagtggaccagagcgagctgggctacctggccaacctgaccgagctggacctgagccagaacagcttcagcgacgccagagactgcgacttccacgccctgccccagctgctgagcctgcacctggaggagaaccagctgaccagactggaggaccacagcttcgccggcctggccagcctgcaggagctgtacctgaaccacaaccagctgtacagaatcgcccccagagccttcagcggcctgagcaacctgctgagactgcacctgaacagcaacctgctgagagccatcgacagcagatggttcgagatgctgcccaacctggagatcctgatgatcggcggcaacaaggtggacgccatcctggacatgaacttcagacccctggccaacctgagaagcctggtgctggccggcatgaacctgagagagatcagcgactacgccctggagggcctgcagagcctggagagcctgagcttctacgacaaccagctggccagagtgcccagaagagccctggagcaggtgcccggcctgaagttcctggacctgaacaagaaccccctgcagagagtgggccccggcgacttcgccaacatgctgcacctgaaggagctgggcctgaacaacatggaggagctggtgagcatcgacaagttcgccctggtgaacctgcccgagctgaccaagctggacatcaccaacaaccccagactgagcttcatccaccccagagccttccaccacctgccccagatggagaccctgatgctgaacaacaacgccctgagcgccctgcaccagcagaccgtggagagcctgcccaacctgcaggaggtgggcctgcacggcaaccccatcagatgcgactgcgtgatcagatgggccaacgccaccggcaccagagtgagattcatcgagccccagagcaccctgtgcgccgagccccccgacctgcagagactgcccgtgagagaggtgcccttcagagagatgaccgaccactgcctgcccctgatcagccccagaagcttcccccccagcctgcaggtggccagcggcgagagcatggtgctgcactgcagagccctggccgagcccgagcccgagatctactgggtgacccccgccggcctgagactgacccccgcccacgccggcagaagatacagagtgtaccccgagggcaccctggagctgagaagagtgaccgccgaggaggccggcctgtacacctgcgtggcccagaacctggtgggcgccgacaccaagaccgtgagcgtggtggtgggcagagccctgctgcagcccggcagagacgagggccagggcctggagctgagagtgcaggagacccacccctaccacatcctgctgagctgggtgaccccccccaacaccgtgagcaccaacctgacctggagcagcgccagcagcctgagaggccagggcgccaccgccctggccagactgcccagaggcacccacagctacaacatcaccagactgctgcaggccaccgagtactgggcctgcctgcaggtggccttcgccgacgcccacacccagctggcctgcgtgtgggccagaaccaaggaggccaccagctgccacagagccctgggcgacagacccggcctgatcgccatcctggccctggccgtgctgctgctggccgccggcctggccgcccacctgggcaccggccagcccagaaagggcgtgggcggcagaagacccctgccccccgcctgggccttctggggctggagcgcccccagcgtgagagtggtgagcgcccccctggtgctgccctggaaccccggcagaaagctgcccagaagcagcgagggcgagaccctgctgccccccctgagccagaacagctag

SEQ ID NO: 19094 - DNA, 2142 bp, Artificial Sequence; identical to SEQ ID NO: 19093
  Description of Artificial Sequence: Synthetic coding sequence

SEQ ID NO: 19095 - DNA, 2142 bp, Artificial Sequence; identical to SEQ ID NO: 19093
  Description of Artificial Sequence: Synthetic coding sequence

SEQ ID NO: 19096 - DNA, 2127 bp, Artificial Sequence
  Description of Artificial Sequence: Synthetic coding sequence
atgaaggacatgcccctgagaatccacgtgctgctgggcctggccatcaccaccctggtgcaggccgtggacaagaaggtggactgccccagactgtgcacctgcgagatcagaccctggttcacccccagaagcatctacatggaggccagcaccgtggactgcaacgacctgggcctgctgaccttccccgccagactgcccgccaacacccagatcctgctgctgcagaccaacaacatcgccaagatcgagtacagcaccgacttccccgtgaacctgaccggcctggacctgagccagaacaacctgagcagcgtgaccaacatcaacgtgaagaagatgccccagctgctgagcgtgtacctggaggagaacaagctgaccgagctgcccgagaagtgcctgagcgagctgagcaacctgcaggagctgtacatcaaccacaacctgctgagcaccatcagccccggcgccttcatcggcctgcacaacctgctgagactgcacctgaacagcaacagactgcagatgatcaacagcaagtggttcgacgccctgcccaacctggagatcctgatgatcggcgagaaccccatcatcagaatcaaggacatgaacttcaagcccctgatcaacctgagaagcctggtgatcgccggcatcaacctgaccgagatccccgacaacgccctggtgggcctggagaacctggagagcatcagcttctacgacaacagactgatcaaggtgccccacgtggccctgcagaaggtggtgaacctgaagttcctggacctgaacaagaaccccatcaacagaatcagaagaggcgacttcagcaacatgctgcacctgaaggagctgggcatcaacaacatgcccgagctgatcagcatcgacagcctggccgtggacaacctgcccgacctgagaaagatcgaggccaccaacaaccccagactgagctacatccaccccaacgccttcttcagactgcccaagctggagagcctgatgctgaacagcaacgccctgagcgccctgtaccacggcaccatcgagagcctgcccaacctgaaggagatcagcatccacagcaaccccatcagatgcgactgcgtgatcagatggatgaacatgaacaagaccaacatcagattcatggagcccgacagcctgttctgcgtggacccccccgagttccagggccagaacgtgagacaggtgcacttcagagacatgatggagatctgcctgcccctgatcgcccccgagagcttccccagcaacctgaacgtggaggccggcagctacgtgagcttccactgcagagccaccgccgagccccagcccgagatctactggatcacccccagcggccagaagctgctgcccaacaccctgaccgacaagttctacgtgcacagcgagggcaccctggacatcaacggcgtgacccccaaggagggcggcctgtacacctgcatcgccaccaacctggtgggcgccgacctgaagagcgtgatgatcaaggtggacggcagcttcccccaggacaacaacggcagcctgaacatcaagatcagagacatccaggccaacagcgtgctggtgagctggaaggccagcagcaagatcctgaagagcagcgtgaagtggaccgccttcgtgaagaccgagaacagccacgccgcccagagcgccagaatccccagcgacgtgaaggtgtacaacctgacccacctgaaccccagcaccgagtacaagatctgcatcgacatccccaccatctaccagaagaacagaaagaagtgcgtgaacgtgaccaccaagggcctgcaccccgaccagaaggagtacgagaagaacaacaccaccaccctgatggcctgcctgggcggcctgctgggcatcatcggcgtgatctgcctgatcagctgcctgagccccgagatgaactgcgacggcggccacagctacgtgagaaactacctgcagaagcccaccttcgccctgggcgagctgtacccccccctgatcaacctgtgggaggccggcaaggagaagagcaccagcctgaaggtgaaggccaccgtgatcggcctgcccaccaacatgagctag

SEQ ID NO: 19097 - DNA, 2127 bp, Artificial Sequence; identical to SEQ ID NO: 19096
  Description of Artificial Sequence: Synthetic coding sequence

SEQ ID NO: 19098 - DNA, 2127 bp, Artificial Sequence; identical to SEQ ID NO: 19096
  Description of Artificial Sequence: Synthetic coding sequence

SEQ ID NO: 19099 - DNA, 2223 bp, Artificial Sequence
  Description of Artificial Sequence: Synthetic coding sequence
atgagacagaccctgcccctgctgctgctgaccgtgctgagacccagctgggccgaccccccccaggagaaggtgcccctgttcagagtgacccagcagggcccctggggcagcagcggcagcaacgccaccgacagcccctgcgagggcctgcccgccgccgacgccaccgccctgaccctggccaacagaaacctggagagactgcccggctgcctgcccagaaccctgagaagcctggacgccagccacaacctgctgagagccctgagcaccagcgagctgggccacctggagcagctgcaggtgctgaccctgagacacaacagaatcgccgccctgagatggggccccggcggccccgccggcctgcacaccctggacctgagctacaaccagctggccgccctgcccccctgcaccggccccgccctgagcagcctgagagccctggccctggccggcaaccccctgagagccctgcagcccagagccttcgcctgcttccccgccctgcagctgctgaacctgagctgcaccgccctgggcagaggcgcccagggcggcatcgccgaggccgccttcgccggcgaggacggcgcccccctggtgaccctggaggtgctggacctgagcggcaccttcctggagagagtggagagcggctggatcagagacctgcccaagctgaccagcctgtacctgagaaagatgcccagactgaccaccctggagggcgacatcttcaagatgacccccaacctgcagcagctggactgccaggacagccccgccctggccagcgtggccacccacatcttccaggacaccccccacctgcaggtgctgctgttccagaactgcaacctgagcagcttccccccctggaccctggacagcagccaggtgctgagcatcaacctgttcggcaaccccctgacctgcagctgcgacctgagctggctgctgaccgacgccaagagaaccgtgctgagcagagccgccgacaccatgtgcgcccccgccgccggcagcagcggccccttcagcgccagcctgagcctgagccagctgcccggcgtgtgccagagcgaccagagcaccaccctgggcgccagccaccccccctgcttcaacagaagcacctacgcccagggcaccaccgtggcccccagcgccgcccccgccaccagacccgccggcgaccagcagagcgtgagcaaggcccccaacgtgggcagcagaaccatcgccgcctggccccacagcgacgccagagagggcaccgcccccagcaccaccaacagcgtggccggccacagcaacagcagcgtgttccccagagccgccagcaccaccagaacccagcacagaggcgagcacgcccccgagctggtgctggagcccgacatcagcgccgccagcacccccctggccagcaagctgctgggccccttccccaccagctgggacagaagcatcagcagcccccagcccggccagagaacccacgccaccccccaggcccccaaccccagcctgagcgagggcgagatccccgtgctgctgctggacgactacagcgaggaggaggagggcagaaaggaggaggtgggcaccccccaccaggacgtgccctgcgactaccacccctgcaagcacctgcagaccccctgcgccgagctgcagagaagatggagatgcagatgccccggcctgagcggcgaggacaccatccccgacccccccagactgcagggcgtgaccgagaccaccgacaccagcgccctggtgcactggtgcgcccccaacagcgtggtgcacggctaccagatcagatacagcgccgagggctgggccggcaaccagagcgtggtgggcgtgatctacgccaccgccagacagcaccccctgtacggcctgagccccggcaccacctacagagtgtgcgtgctggccgccaacagagccggcctgagccagcccagaagcagcggctggagaagcccctgcgccgccttcaccaccaagcccagcttcgccctgctgctgagcggcctgtgcgccgccagcggcctgctgctggccagcaccgtggtgctgagcgcctgcctgtgcagaagaggccagaccctgggcctgcagagatgcgacacccacctggtggcctacaagaaccccgccttcgacgactaccccctgggcctgcagaccgtgagctag

SEQ ID NO: 19100 - DNA, 1191 bp, Artificial Sequence
  Description of Artificial Sequence: Synthetic coding sequence
atgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatcgacgccaaggtggccgccagaatggtgtggagactgctgcacggccaggtgctgaccagaagagagagaagaagagaggagaagcagaagaagaagatggccgtgaagctggagctggccaagttcctgcaggagaccatgaccgagatggccagaagaaacagagccaagatgggcgacgccagcacccagctgagcagctacgtgaagcaggtgcagaccggccacaagcccagcaccaaggagatcgtgagattcagcaagctgttcgaggaccagctggccctggagcacctggacagaccccagctggtggccctgtgcaagctgctggagctgcagaccttcggcaccaacaacctgctgagattccagctgctgatgaagctgaagagcatcaaggccgacgacgagatcatcgccaaggagggcgtgaccgccctgagcgtgagcgagctgcaggccgcctgcagagccagaggcatgagaagcctgggcctgaccgaggagcagctgagacagcagctgaccgagtggcaggacctgcacctgaaggagaacgtgccccccagcctgctgctgctgagcagaaccttctacctgatcgacgtgaagcccaagcccatcgagatccccctgagcggcgaggcccccaagaccgacatcctggtggagctgcccaccttcaccgagagcaaggagaacatggtggacctggccccccagctgaagggcaccaaggacgaggacttcatccagcccccccccgtgaccagcagccccatcacccccagcacccccatcagcctgcccaagggccccatcaccagcagcgaggagcccaccctgcaggccaagagccagatgaccgcccagaacagcaaggccagcagcaagggcgcctag

SEQ ID NO: 19101 - DNA, 1476 bp, Artificial Sequence
  Description of Artificial Sequence: Synthetic coding sequence
atggccttctacagctacaacagcgtgctggccatcgccagaaccagattccccagccacttcgtgcaccccacctgcagcagctacagccccagctgcgccttcctgcacctgcccgacagccacctgaacaagacctgcatgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatcgacgccaaggtggccgccagaatggtgtggagactgctgcacggccaggtgctgaccagaagagagagaagaagactgctgagaacctgcgtggacttcttcagactggtgcccttcatggtgttcctgatcgtgcccttcatggagttcctgctgcccgtgttcctgaagctgttccccgagatgctgcccagcaccttcgagagcgagagcaagaaggaggagaagcagaagaagaagatggccgtgaagctggagctggccaagttcctgcaggagaccatgaccgagatggccagaagaaacagagccaagatgggcgacgccagcacccagctgagcagctacgtgaagcaggtgcagaccggccacaagcccagcaccaaggagatcgtgagattcagcaagctgttcgaggaccagctggccctggagcacctggacagaccccagctggtggccctgtgcaagctgctggagctgcagaccttcggcaccaacaacctgctgagattccagctgctgatgaagctgaagagcatcaaggccgacgacgagatcatcgccaaggagggcgtgaccgccctgagcgtgagcgagctgcaggccgcctgcagagccagaggcatgagaagcctgggcctgaccgaggagcagctgagacagcagctgaccgagtggcaggacctgcacctgaaggagaacgtgccccccagcctgctgctgctgagcagaaccttctacctgatcgacgtgaagcccaagcccatcgagatccccctgagcggcgaggcccccaagaccgacatcctggtggagctgcccaccttcaccgagagcaaggagaacatggtggacctggccccccagctgaagggcaccaaggacgaggacttcatccagcccccccccgtgaccagcagccccatcacccccagcacccccatcagcctgcccaagggccccatcaccagcagcgaggagcccaccctgcaggccaagagccagatgaccgcccagaacagcaaggccagcagcaagggcgcctag

SEQ ID NO: 19102 - DNA, 1332 bp, Artificial Sequence
  Description of Artificial Sequence: Synthetic coding sequence
atggccttctacagctacaacagcgtgctggccatcgccagaaccagattccccagccacttcgtgcaccccacctgcagcagctacagccccagctgcgccttcctgcacctgcccgacagccacctgaacaagacctgcatgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatcgacgccaaggtggccgccagaatggtgtggagactgctgcacggccaggtgctgaccagaagagagagaagaagagaggagaagcagaagaagaagatggccgtgaagctggagctggccaagttcctgcaggagaccatgaccgagatggccagaagaaacagagccaagatgggcgacgccagcacccagctgagcagctacgtgaagcaggtgcagaccggccacaagcccagcaccaaggagatcgtgagattcagcaagctgttcgaggaccagctggccctggagcacctggacagaccccagctggtggccctgtgcaagctgctggagctgcagaccttcggcaccaacaacctgctgagattccagctgctgatgaagctgaagagcatcaaggccgacgacgagatcatcgccaaggagggcgtgaccgccctgagcgtgagcgagctgcaggccgcctgcagagccagaggcatgagaagcctgggcctgaccgaggagcagctgagacagcagctgaccgagtggcaggacctgcacctgaaggagaacgtgccccccagcctgctgctgctgagcagaaccttctacctgatcgacgtgaagcccaagcccatcgagatccccctgagcggcgaggcccccaagaccgacatcctggtggagctgcccaccttcaccgagagcaaggagaacatggtggacctggccccccagctgaagggcaccaaggacgaggacttcatccagcccccccccgtgaccagcagccccatcacccccagcacccccatcagcctgcccaagggccccatcaccagcagcgaggagcccaccctgcaggccaagagccagatgaccgcccagaacagcaaggccagcagcaagggcgcctag

SEQ ID NO: 19103 - DNA, 429 bp, Artificial Sequence
  Description of Artificial Sequence: Synthetic coding sequence
atggccttctacagctacaacagcgtgctggccatcgccagaaccagattccccagccacttcgtgcaccccacctgcagcagctacagccccagctgcgccttcctgcacctgcccgacagccacctgaacaagacctgcatgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatctag

SEQ ID NO: 19104 - DNA, 351 bp, Artificial Sequence
  Description of Artificial Sequence: Synthetic coding sequence
atggccttctacagctacaacagcgtgctggccatcgccagaaccagattccccagccacttcgtgcaccccacctgcagcagctacagccccagctgcgccttcctgcacctgcccgacagccacctgaacaagacctgcatgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaagtag

SEQ ID NO: 19105 - DNA, 834 bp, Artificial Sequence
  Description of Artificial Sequence: Synthetic coding sequence
atggaggagaagcagaagaagaagatggccgtgaagctggagctggccaagttcctgcaggagaccatgaccgagatggccagaagaaacagagccaagatgggcgacgccagcacccagctgagcagctacgtgaagcaggtgcagaccggccacaagcccagcaccaaggagatcgtgagattcagcaagctgttcgaggaccagctggccctggagcacctggacagaccccagctggtggccctgtgcaagctgctggagctgcagaccttcggcaccaacaacctgctgagattccagctgctgatgaagctgaagagcatcaaggccgacgacgagatcatcgccaaggagggcgtgaccgccctgagcgtgagcgagctgcaggccgcctgcagagccagaggcatgagaagcctgggcctgaccgaggagcagctgagacagcagctgaccgagtggcaggacctgcacctgaaggagaacgtgccccccagcctgctgctgctgagcagaaccttctacctgatcgacgtgaagcccaagcccatcgagatccccctgagcggcgaggcccccaagaccgacatcctggtggagctgcccaccttcaccgagagcaaggagaacatggtggacctggccccccagctgaagggcaccaaggacgaggacttcatccagcccccccccgtgaccagcagccccatcacccccagcacccccatcagcctgcccaagggccccatcaccagcagcgaggagcccaccctgcaggccaagagccagatgaccgcccagaacagcaaggccagcagcaagggcgcctag

SEQ ID NO: 19106 - DNA, 369 bp, Artificial Sequence
  Description of Artificial Sequence: Synthetic coding sequence
atgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatcgacgccaaggtggccgccagaatggtgtggagactgctgcacggccaggtgctgaccagaagagagagaagaagatgcttctag

SEQ ID NO: 19107 - DNA, 1335 bp, Artificial Sequence
  Description of Artificial Sequence: Synthetic coding sequence
atgaagaactacgagagcaagaagtacagcgaccccagccagcccggcaacaccgtgctgcaccccggcaccagactgatccagaagctgcacaccagcacctgctggctgcaggaggtgcccggcaagccccagctggagcaggccaccaagcacccccaggtgaccagcccccaggccaccaaggagaccggcatggagatcaaggagggcaagcagagctacagacagaagatcatggacgagctgaagtactactacaacggcttctacctgctgtggatcgacgccaaggtggccgccagaatggtgtggagactgctgcacggccaggtgctgaccagaagagagagaagaagactgctgagaacctgcgtggacttcttcagactggtgcccttcatggtgttcctgatcgtgcccttcatggagttcctgctgcccgtgttcctgaagctgttccccgagatgctgcccagcaccttcgagagcgagagcaagaaggaggagaagcagaagaagaagatggccgtgaagctggagctggccaagttcctgcaggagaccatgaccgagatggccagaagaaacagagccaagatgggcgacgccagcacccagctgagcagctacgtgaagcaggtgcagaccggccacaagcccagcaccaaggagatcgtgagattcagcaagctgttcgaggaccagctggccctggagcacctggacagaccccagctggtggccctgtgcaagctgctggagctgcagaccttcggcaccaacaacctgctgagattccagctgctgatgaagctgaagagcatcaaggccgacgacgagatcatcgccaaggagggcgtgaccgccctgagcgtgagcgagctgcaggccgcctgcagagccagaggcatgagaagcctgggcctgaccgaggagcagctgagacagcagctgaccgagtggcaggacctgcacctgaaggagaacgtgccccccagcctgctgctgctgagcagaaccttctacctgatcgacgtgaagcccaagcccatcgagatccccctgagcggcgaggcccccaagaccgacatcctggtggagctgcccaccttcaccgagagcaaggagaacatggtggacctggccccccagctgaagggcaccaaggacgaggacttcatccagcccccccccgtgaccagcagccccatcacccccagcacccccatcagcctgcccaagggccccatcaccagcagcgaggagcccaccctgcaggccaagagccagatgaccgcccagaacagcaaggccagcagcaagggcgcctag

SEQ ID NO: 19108 - DNA, 1872 bp, Artificial Sequence
  Description of Artificial Sequence: Synthetic coding sequence
atgagagtggccctgggcatgctgtggctgctggccctggcctggcccccccaggccagaggcttctgccccagccagtgcagctgcagcctgcacatcatgggcgacggcagcaaggccagaaccgtggtgtgcaacgaccccgacatgaccctgccccccgccagcatcccccccgacaccagcagactgagactggagagaaccgccatcagaagagtgcccggcgaggccttcagacccctgggcagactggagcagctgtggctgccctacaacgccctgagcgagctgaacgccctgatgctgagaggcctgagaagactgagagagctgagactgcccggcaacagactggccgccttcccctgggccgccctgagagacgcccccaagctgagactgctggacctgcaggccaacagactgagcgccgtgcccgccgaggccgccagattcctggagaacctgaccttcctggacctgagcagcaaccagctgatgagactgccccaggagctgatcgtgagctgggcccacctggagaccggcatcttcccccccggccaccaccccagaagagtgctgggcctgcaggacaacccctgggcctgcgactgcagactgtacgacctggtgcacctgctggacggctgggcccccaacctggccttcatcgagaccgagctgagatgcgccagccccagaagcctggccggcgtggccttcagccagctggagctgagaaagtgccagggccccgagctgcaccccggcgtggccagcatcagaagcctgctgggcggcaccgccctgctgagatgcggcgccaccggcgtgcccggccccgagatgagctggagaagagccaacggcagacccctgaacggcaccgtgcaccaggaggtgagcagcgacggcaccagctggaccctgctgggcctgcccgccgtgagccacctggacagcggcgactacatctgccaggccaagaacttcctgggcgccagcgagaccgtgatcagcctgatcgtgaccgagccccccaccagcaccgagcacagcggcagccccggcgccctgtgggccagaaccggcggcggcggcgaggccgccgcctacaacaacaagctggtggccagacacgtgccccagatccccaagcccgccgtgctggccaccggccccagcgtgcccagcaccaaggaggagctgaccctggagcacttccagatggacgccctgggcgagctgagcgacggcagagccggccccagcgaggccagaatggtgagaagcgtgaaggtggtgggcgacacctaccacagcgtgagcctggtgtggaaggccccccaggccaagaacaccaccgccttcagcgtgctgtacgccgtgttcggccagcacagcatgagaagagtgatcgtgcagcccggcaagaccagagtgaccatcaccggcctgctgcccaagaccaagtacgtggcctgcgtgtgcgtgcagggcctggtgcccagaaaggagcagtgcgtgatcttcagcaccaacgaggtggtggacgccgagaacacccagcagctgatcaacgtggtggtgatcagcgtggccatcgtgatcgccctgcccctgaccctgctggtgtgctgcagcgccctgcagaagagatgcagaaagtgcttcaacaaggacagcaccgaggccaccgtgacctacgtgaacctggagagactgggctacagcgaggacggcctggaggagctgagcagacacagcgtgagcgaggccgacagactgctgagcgccagaagcagcgtggacttccaggccttcggcgtgaagggcggcagaagaatcaacgagtacttctgctag

SEQ ID NO: 19109 - DNA, 1491 bp, Artificial Sequence
  Description of Artificial Sequence: Synthetic coding sequence
atggtggagccccaccaggagcccagacacagcaaggtgggcctgcaggacaacccctggttctgcgactgccacatcagcaagatgatcgagctgagcaaggtggtggaccccgccatcgtgctgctggaccccctgatgacctgcagcgagcccgagagactgaccggcatcctgttccagagagccgagctggagcactgcctgaagcccagcgtgatgaccagcgccaccaagatcatgagcgccctgggcagcaacgtgctgctgagatgcgacgccaccggcttccccaccccccagatcacctggaccagaagcgacagcagccccgtgaactacaccgtgatccaggagagccccgaggagggcgtgagatggagcatcatgagcctgaccggcatcagcagcaaggacgccggcgactacaagtgcaaggccaagaacctggccggcatgagcgaggccgtggtgaccgtgaccgtgctgggcatcaccaccacccccatcccccccgacaccagcgagagaaccggcgaccaccccgagtgggacgtgcagcccggcagcggcagaagcaccagcgtgagcagcgccagcagctacctgtggagcagcagcttcagccccaccagcagcttcagcgccagcaccctgagcccccccagcaccgccagcttcagcctgagccccttcagcagcagcaccgtgagcagcaccaccaccctgagcaccagcatcagcgccagcaccaccatggccaacaagagaagcttccagctgcaccagggcggcaagagaaacctgaaggtggccaagaacggcagcaagctgccccccgccagcaccagcaagaaggaggagctggccctgctggaccagaccatgctgaccgagaccaacgccgccatcgagaacctgagagtggtgagcgagaccaaggagagcgtgaccctgacctggaacatgatcaacaccacccacaacagcgccgtgaccgtgctgtacagcaagtacggcggcaaggacctgctgctgctgaacgccgacagcagcaagaaccaggtgaccatcgacggcctggagcccggcggccagtacatggcctgcgtgtgccccaagggcgtgcccccccagaaggaccagtgcatcaccttcagcaccgagagagtggagggcgacgacagccagtggagcctgctgctggtggtgaccagcaccgcctgcgtggtgatcctgcccctgatctgcttcctgctgtacaaggtgtgcaagctgcagtgcaagagcgagcccttctgggaggacgacctggccaaggagacctacatccagttcgagaccctgttccccagaagccagagcgtgggcgagctgtggaccagaagccacagagacgacagcgagaagctgctgctgtgcagcagaagcagcgtggagagccaggtgaccttcaagagcgagggcagcagacccgagtactactgctag

SEQ ID NO: 19110 - DNA, 1905 bp, Artificial Sequence
  Description of Artificial Sequence: Synthetic coding sequence
atggacatgaacgagctgcccaccaacctgcccgtggacaccgtgaagctgagaatcgagaagaccgtgatcagaagaatcagcgccgaggccttctactacctggtggagctgcagtacctgtgggtgacctacaacagcgtggccagcatcgaccccagcagcttctacaacctgaagcagctgcacgagctgagactggacggcaacagcctggccgccttcccctgggccagcctgctggacatgcccctgctgagaaccctggacctgcacaacaacaagatcaccagcgtgcccaacgaggccctgagatacctgaagaacctggcctacctggacctgagcagcaacagactgaccaccctgccccccgacttcctggagagctggacccacctggtgagcacccccagcggcgtgctggacctgagccccagcagaatcatcctgggcctgcaggacaacccctggttctgcgactgccacatcagcaagatgatcgagctgagcaaggtggtggaccccgccatcgtgctgctggaccccctgatgacctgcagcgagcccgagagactgaccggcatcctgttccagagagccgagctggagcactgcctgaagcccagcgtgatgaccagcgccaccaagatcatgagcgccctgggcagcaacgtgctgctgagatgcgacgccaccggcttccccaccccccagatcacctggaccagaagcgacagcagccccgtgaactacaccgtgatccaggagagccccgaggagggcgtgagatggagcatcatgagcctgaccggcatcagcagcaaggacgccggcgactacaagtgcaaggccaagaacctggccggcatgagcgaggccgtggtgaccgtgaccgtgctgggcatcaccaccacccccatcccccccgacaccagcgagagaaccggcgaccaccccgagtgggacgtgcagcccggcagcggcagaagcaccagcgtgagcagcgccagcagctacctgtggagcagcagcttcagccccaccagcagcttcagcgccagcaccctgagcccccccagcaccgccagcttcagcctgagccccttcagcagcagcaccgtgagcagcaccaccaccctgagcaccagcatcagcgccagcaccaccatggccaacaagagaagcttccagctgcaccagggcggcaagagaaacctgaaggtggccaagaacggcagcaagctgccccccgccagcaccagcaagaaggaggagctggccctgctggaccagaccatgctgaccgagaccaacgccgccatcgagaacctgagagtggtgagcgagaccaaggagagcgtgaccctgacctggaacatgatcaacaccacccacaacagcgccgtgaccgtgctgtacagcaagtacggcggcaaggacctgctgctgctgaacgccgacagcagcaagaaccaggtgaccatcgacggcctggagcccggcggccagtacatggcctgcgtgtgccccaagggcgtgcccccccagaaggaccagtgcatcaccttcagcaccgagagagtggagggcgacgacagccagtggagcctgctgctggtggtgaccagcaccgcctgcgtggtgatcctgcccctgatctgcttcctgctgtacaaggtgtgcaagctgcagtgcaagagcgagcccttctgggaggacgacctggccaaggagacctacatccagttcgagaccctgttccccagaagccagagcgtgggcgagctgtggaccagaagccacagagacgacagcgagaagctgctgctgtgcagcagaagcagcgtggagagccaggtgaccttcaagagcgagggcagcagacccgagtactactgctag

SEQ ID NO: 19111 - DNA, 1491 bp, Artificial Sequence; identical to SEQ ID NO: 19109
  Description of Artificial Sequence: Synthetic coding sequence

SEQ ID NO: 19112 - DNA, 3360 bp, Artificial Sequence
  Description of Artificial Sequence: Synthetic coding sequence
atgagcgcccccagcctgagagccagagccgccggcctgggcctgctgctgtgcgccgtgctgggcagagccggcagaagcgacagcggcggcagaggcgagctgggccagcccagcggcgtggccgccgagagaccctgccccaccacctgcagatgcctgggcgacctgctggactgcagcagaaagagactggccagactgcccgagcccctgcccagctgggtggccagactggacctgagccacaacagactgagcttcatcaaggccagcagcatgagccacctgcagagcctgagagaggtgaagctgaacaacaacgagctggagaccatccccaacctgggccccgtgagcgccaacatcaccctgctgagcctggccggcaacagaatcgtggagatcctgcccgagcacctgaaggagttccagagcctggagaccctggacctgagcagcaacaacatcagcgagctgcagaccgccttccccgccctgcagctgaagtacctgtacctgaacagcaacagagtgaccagcatggagcccggctacttcgacaacctggccaacaccctgctggtgctgaagctgaacagaaacagaatcagcgccatcccccccaagatgttcaagctgccccagctgcagcacctggagctgaacagaaacaagatcaagaacgtggacggcctgaccttccagggcctgggcgccctgaagagcctgaagatgcagagaaacggcgtgaccaagctgatggacggcgccttctggggcctgagcaacatggagatcctgcagctggaccacaacaacctgaccgagatcaccaagggctggctgtacggcctgctgatgctgcaggagctgcacctgagccagaacgccatcaacagaatcagccccgacgcctgggagttctgccagaagctgagcgagctggacctgaccttcaaccacctgagcagactggacgacagcagcttcctgggcctgagcctgctgaacaccctgcacatcggcaacaacagagtgagctacatcgccgactgcgccttcagaggcctgagcagcctgaagaccctggacctgaagaacaacgagatcagctggaccatcgaggacatgaacggcgccttcagcggcctggacaagctgagaagactgatcctgcagggcaacagaatcagaagcatcaccaagaaggccttcaccggcctggacgccctggagcacctggacctgagcgacaacgccatcatgagcctgcagggcaacgccttcagccagatgaagaagctgcagcagctgcacctgaacaccagcagcctgctgtgcgactgccagctgaagtggctgccccagtgggtggccgagaacaacttccagagcttcgtgaacgccagctgcgcccacccccagctgctgaagggcagaagcatcttcgccgtgagccccgacggcttcgtgtgcgacgacttccccaagccccagatcaccgtgcagcccgagacccagagcgccatcaagggcagcaacctgagcttcatctgcagcgccgccagcagcagcgacagccccatgaccttcgcctggaagaaggacaacgagctgctgcacgacgccgagatggagaactacgcccacctgagagcccagggcggcgaggtgatggagtacaccaccatcctgagactgagagaggtggagttcgccagcgagggcaagtaccagtgcgtgatcagcaaccacttcggcagcagctacagcgtgaaggccaagctgaccgtgaacatgctgcccagcttcaccaagacccccatggacctgaccatcagagccggcgccatggccagactggagtgcgccgccgtgggccaccccgccccccagatcgcctggcagaaggacggcggcaccgacttccccgccgccagagagagaagaatgcacgtgatgcccgaggacgacgtgttcttcatcgtggacgtgaagatcgaggacatcggcgtgtacagctgcaccgcccagaacagcgccggcagcatcagcgccaacgccaccctgaccgtgctggagacccccagcttcctgagacccctgctggacagaaccgtgaccaagggcgagaccgccgtgctgcagtgcatcgccggcggcagccccccccccaagctgaactggaccaaggacgacagccccctggtggtgaccgagagacacttcttcgccgccggcaaccagctgctgatcatcgtggacagcgacgtgagcgacgccggcaagtacacctgcgagatgagcaacaccctgggcaccgagagaggcaacgtgagactgagcgtgatccccacccccacctgcgacagcccccagatgaccgcccccagcctggacgacgacggctgggccaccgtgggcgtggtgatcatcgccgtggtgtgctgcgtggtgggcaccagcctggtgtgggtggtgatcatctaccacaccagaagaagaaacgaggactgcagcatcaccaacaccgacgagaccaacctgcccgccgacatccccagctacctgagcagccagggcaccctggccgacagacaggacggctacgtgagcagcgagagcggcagccaccaccagttcgtgaccagcagcggcgccggcttcttcctgccccagcacgacagcagcggcacctgccacatcgacaacagcagcgaggccgacgtggaggccgccaccgacctgttcctgtgccccttcctgggcagcaccggccccatgtacctgaagggcaacgtgtacggcagcgaccccttcgagacctaccacaccggctgcagccccgaccccagaaccgtgctgatggaccactacgagcccagctacatcaagaagaaggagtgctacccctgcagccaccccagcgaggagagctgcgagagaagcttcagcaacatcagctggcccagccacgtgagaaagctgctgaacaccagctacagccacaacgagggccccggcatgaagaacctgtgcctgaacaagagcagcctggacttcagcgccaaccccgagcccgccagcgtggccagcagcaacagcttcatgggcaccttcggcaaggccctgagaagaccccacctggacgcctacagcagcttcggccagcccagcgactgccagcccagagccttctacctgaaggcccacagcagccccgacctggacagcggcagcgaggaggacggcaaggagagaaccgacttccaggaggagaaccacatctgcaccttcaagcagaccctggagaactacagaacccccaacttccagagctacgacctggacacctag

SEQ ID NO: 19113 - DNA, 3180 bp, Artificial Sequence
  Description of Artificial Sequence: Synthetic coding sequence
atggtggacgtgctgctgctgttcagcctgtgcctgctgttccacatcagcagacccgacctgagccacaacagactgagcttcatcaaggccagcagcatgagccacctgcagagcctgagagaggtgaagctgaacaacaacgagctggagaccatccccaacctgggccccgtgagcgccaacatcaccctgctgagcctggccggcaacagaatcgtggagatcctgcccgagcacctgaaggagttccagagcctggagaccctggacctgagcagcaacaacatcagcgagctgcagaccgccttccccgccctgcagctgaagtacctgtacctgaacagcaacagagtgaccagcatggagcccggctacttcgacaacctggccaacaccctgctggtgctgaagctgaacagaaacagaatcagcgccatcccccccaagatgttcaagctgccccagctgcagcacctggagctgaacagaaacaagatcaagaacgtggacggcctgaccttccagggcctgggcgccctgaagagcctgaagatgcagagaaacggcgtgaccaagctgatggacggcgccttctggggcctgagcaacatggagatcctgcagctggaccacaacaacctgaccgagatcaccaagggctggctgtacggcctgctgatgctgcaggagctgcacctgagccagaacgccatcaacagaatcagccccgacgcctgggagttctgccagaagctgagcgagctggacctgaccttcaaccacctgagcagactggacgacagcagcttcctgggcctgagcctgctgaacaccctgcacatcggcaacaacagagtgagctacatcgccgactgcgccttcagaggcctgagcagcctgaagaccctggacctgaagaacaacgagatcagctggaccatcgaggacatgaacggcgccttcagcggcctggacaagctgagaagactgatcctgcagggcaacagaatcagaagcatcaccaagaaggccttcaccggcctggacgccctggagcacctggacctgagcgacaacgccatcatgagcctgcagggcaacgccttcagccagatgaagaagctgcagcagctgcacctgaacaccagcagcctgctgtgcgactgccagctgaagtggctgccccagtgggtggccgagaacaacttccagagcttcgtgaacgccagctgcgcccacccccagctgctgaagggcagaagcatcttcgccgtgagccccgacggcttcgtgtgcgacgacttccccaagccccagatcaccgtgcagcccgagacccagagcgccatcaagggcagcaacctgagcttcatctgcagcgccgccagcagcagcgacagccccatgaccttcgcctggaagaaggacaacgagctgctgcacgacgccgagatggagaactacgcccacctgagagcccagggcggcgaggtgatggagtacaccaccatcctgagactgagagaggtggagttcgccagcgagggcaagtaccagtgcgtgatcagcaaccacttcggcagcagctacagcgtgaaggccaagctgaccgtgaacatgctgcccagcttcaccaagacccccatggacctgaccatcagagccggcgccatggccagactggagtgcgccgccgtgggccaccccgccccccagatcgcctggcagaaggacggcggcaccgacttccccgccgccagagagagaagaatgcacgtgatgcccgaggacgacgtgttcttcatcgtggacgtgaagatcgaggacatcggcgtgtacagctgcaccgcccagaacagcgccggcagcatcagcgccaacgccaccctgaccgtgctggagacccccagcttcctgagacccctgctggacagaaccgtgaccaagggcgagaccgccgtgctgcagtgcatcgccggcggcagccccccccccaagctgaactggaccaaggacgacagccccctggtggtgaccgagagacacttcttcgccgccggcaaccagctgctgatcatcgtggacagcgacgtgagcgacgccggcaagtacacctgcgagatgagcaacaccctgggcaccgagagaggcaacgtgagactgagcgtgatccccacccccacctgcgacagcccccagatgaccgcccccagcctggacgacgacggctgggccaccgtgggcgtggtgatcatcgccgtggtgtgctgcgtggtgggcaccagcctggtgtgggtggtgatcatctaccacaccagaagaagaaacgaggactgcagcatcaccaacaccgacgagaccaacctgcccgccgacatccccagctacctgagcagccagggcaccctggccgacagacaggacggctacgtgagcagcgagagcggcagccaccaccagttcgtgaccagcagcggcgccggcttcttcctgccccagcacgacagcagcggcacctgccacatcgacaacagcagcgaggccgacgtggaggccgccaccgacctgttcctgtgccccttcctgggcagcaccggccccatgtacctgaagggcaacgtgtacggcagcgaccccttcgagacctaccacaccggctgcagccccgaccccagaaccgtgctgatggaccactacgagcccagctacatcaagaagaaggagtgctacccctgcagccaccccagcgaggagagctgcgagagaagcttcagcaacatcagctggcccagccacgtgagaaagctgctgaacaccagctacagccacaacgagggccccggcatgaagaacctgtgcctgaacaagagcagcctggacttcagcgccaaccccgagcccgccagcgtggccagcagcaacagcttcatgggcaccttcggcaaggccctgagaagaccccacctggacgcctacagcagcttcggccagcccagcgactgccagcccagagccttctacctgaaggcccacagcagccccgacctggacagcggcagcgaggaggacggcaaggagagaaccgacttccaggaggagaaccacatctgcaccttcaagcagaccctggagaactacagaacccccaacttccagagctacgacctggacacctag

SEQ ID NO: 19114 - DNA, 1038 bp, Artificial Sequence
  Description of Artificial Sequence: Synthetic coding sequence
atgaagggcgagctgctgctgttcagcagcgtgatcgtgctgctgcaggtggtgtgcagctgccccgacaagtgctactgccagagcagcaccaacttcgtggactgcagccagcagggcctggccgagatccccagccacctgcccccccagaccagaaccctgcacctgcaggacaaccagatccaccacctgcccgccttcgccttcagaagcgtgccctggctgatgaccctgaacctgagcaacaacagcctgagcaacctggcccccggcgccttccacggcctgcagcacctgcaggtgctgaacctgacccagaacagcctgctgagcctggagagcagactgttccacagcctgccccagctgagagagctggacctgagcagcaacaacatcagccacctgcccaccagcctgggcgagacctgggagaacctgaccatcctggccgtgcagcagaaccagctgcagcagctggacagagccctgctggagagcatgcccagcgtgagactgctgctgctgaaggacaacctgtggaagtgcaactgccacctgctgggcctgaagctgtggctggagaagttcgtgtacaagggcggcctgaccgacggcatcatctgcgagagccccgacacctggaagggcaaggacctgctgagaatcccccacgagctgtaccagccctgccccctgcccgcccccgaccccgtgagcagccaggcccagtggcccggcagcgcccacggcgtggtgctgagaccccccgagaaccacaacgccggcgagagagagctgctggagtgcgagctgaagcccaagcccagacccgccaacctgagacacgccatcgccaccgtgatcatcaccggcgtggtgtgcggcatcgtgtgcctgatgatgctggccgccgccatctacggctgcacctacgccgccatcaccgcccagtaccacggcggccccctggcccagaccaacgaccccggcaaggtggaggagaaggagagattcgacagcagccccgcctag

SEQ ID NO: 19115 - DNA, 810 bp, Artificial Sequence
  Description of Artificial Sequence: Synthetic coding sequence
atgaccctgaacctgagcaacaacagcctgagcaacctggcccccggcgccttccacggcctgcagcacctgcaggtgctgaacctgacccagaacagcctgctgagcctggagagcagactgttccacagcctgccccagctgagagagctggacctgagcagcaacaacatcagccacctgcccaccagcctgggcgagacctgggagaacctgaccatcctggccgtgcagcagaaccagctgcagcagctggacagagccctgctggagagcatgcccagcgtgagactgctgctgctgaaggacaacctgtggaagtgcaactgccacctgctgggcctgaagctgtggctggagaagttcgtgtacaagggcggcctgaccgacggcatcatctgcgagagccccgacacctggaagggcaaggacctgctgagaatcccccacgagctgtaccagccctgccccctgcccgcccccgaccccgtgagcagccaggcccagtggcccggcagcgcccacggcgtggtgctgagaccccccgagaaccacaacgccggcgagagagagctgctggagtgcgagctgaagcccaagcccagacccgccaacctgagacacgccatcgccaccgtgatcatcaccggcgtggtgtgcggcatcgtgtgcctgatgatgctggccgccgccatctacggctgcacctacgccgccatcaccgcccagtaccacggcggccccctggcccagaccaacgaccccggcaaggtggaggagaaggagagattcgacagcagccccgcctag

SEQ ID NO: 19116 - DNA, 1113 bp, Artificial Sequence
  Description of Artificial Sequence: Synthetic coding sequence
atgctggcccccggcagcagccccggccagagaggcagactggccctgcagtggagacaggtgagctggatcacctgctggatcgccctgtacgccgtggaggccctgcccacctgccccttcagctgcaagtgcgacagcagaagcctggaggtggactgcagcggcctgggcctgaccaccgtgccccccgacgtgcccgccgccaccagaaccctgctgctgctgaacaacaagctgagcgccctgcccagctgggccttcgccaacctgagcagcctgcagagactggacctgagcaacaacttcctggacagactgcccagaagcatcttcggcgacctgaccaacctgaccgagctgcagctgagaaacaacagcatcagaaccctggacagagacctgctgagacacagccccctgctgagacacctggacctgagcatcaacggcctggcccagctgccccccggcctgttcgacggcctgctggccctgagaagcctgagcctgagaagcaacagactgcagaacctggacagactgaccttcgagcccctggccaacctgcagctgctgcaggtgggcgacaacccctgggagtgcgactgcaacctgagagagttcaagcactggatggagtggttcagctacagaggcggcagactggaccagctggcctgcaccctgcccaaggagctgagaggcaaggacatgagaatggtgcccatggagatgttcaactactgcagccagctggaggacgagaacagcagcgccggcctggacatccccggccccccctgcaccaaggccagccccgagcccgccaagcccaagcccggcgccgagcccgagcccgagcccagcaccgcctgcccccagaagcagagacacagacccgccagcgtgagaagagccatgggcaccgtgatcatcgccggcgtggtgtgcggcgtggtgtgcatcatgatggtggtggccgccgcctacggctgcatctacgccagcctgatggccaagtaccacagagagctgaagaagagacagcccctgatgggcgaccccgagggcgagcacgaggaccagaagcagatcagcagcgtggcctag

SEQ ID NO: 19117 - DNA, 408 bp, Artificial Sequence
  Description of Artificial Sequence: Synthetic coding sequence
atgagaatggtgcccatggagatgttcaactactgcagccagctggaggacgagaacagcagcgccggcctggacatccccggccccccctgcaccaaggccagccccgagcccgccaagcccaagcccggcgcccagcacagcctgcccaccgaggccgaggcccccgccggcgagagagaggccagccacggccacggcgaccactgcagaggcagagtgagaagaagactgcaccacgacggcggcggcagatgcctgtggctgcacctgagactgccccacggccaggtgccccccggcgcccagaaggcccccgcccccgacggcggccccagaggcagagccagaggccccgaggccgacctgttctgcggcctgagcgcccacccccaccccgccagatag

SEQ ID NO: 19118 - DNA, 1113 bp, Artificial Sequence; identical to SEQ ID NO: 19116
  Description of Artificial Sequence: Synthetic coding sequence

SEQ ID NO: 19119 - DNA, 1113 bp, Artificial Sequence; identical to SEQ ID NO: 19116
  Description of Artificial Sequence: Synthetic coding sequence

SEQ ID NO: 19120 - DNA, 1500 bp, Artificial Sequence
  Description of Artificial Sequence: Synthetic coding sequence
atgaccctgatcctgaccagcctgctgttcttcggcctgagcctgggccccagaaccagagtgcaggccgagaacctgcccaagcccatcctgtgggccgagcccggccccgtgatcacctggcacaaccccgtgaccatctggtgccagggcaccctggaggcccagggctacagactggacaaggagggcaacagcatgagcagacacatcctgaagaccctggagagcgagaacaaggtgaagctgagcatccccagcatgatgtgggagcacgccggcagataccactgctactaccagagccccgccggctggagcgagcccagcgaccccctggagctggtggtgaccgcctacagcagacccaccctgagcgccctgcccagccccgtggtgaccagcggcgtgaacgtgaccctgagatgcgccagcagactgggcctgggcagattcaccctgatcgaggagggcgaccacagactgagctggaccctgaacagccaccagcacaaccacggcaagttccaggccctgttccccatgggccccctgaccttcagcaacagaggcaccttcagatgctacggctacgagaacaacaccccctacgtgtggagcgagcccagcgaccccctgcagctgctggtgagcggcgtgagcagaaagcccagcctgctgaccctgcagggccccgtggtgacccccggcgagaacctgaccctgcagtgcggcagcgacgtgggctacatcagatacaccctgtacaaggagggcgccgacggcctgccccagagacccggcagacagccccaggccggcctgagccaggccaacttcaccctgagccccgtgagcagaagctacggcggccagtacagatgctacggcgcccacaacgtgagcagcgagtggagcgcccccagcgaccccctggacatcctgatcgccggccagatcagcgacagacccagcctgagcgtgcagcccggccccaccgtgaccagcggcgagaaggtgaccctgctgtgccagagctgggaccccatgttcaccttcctgctgaccaaggagggcgccgcccacccccccctgagactgagaagcatgtacggcgcccacaagtaccaggccgagttccccatgagccccgtgaccagcgcccacgccggcacctacagatgctacggcagcagaagcagcaacccctacctgctgagccaccccagcgagcccctggagctggtggtgagcggcgccaccgagaccctgaaccccgcccagaagaagagcgacagcaagaccgccccccacctgcaggactacaccgtggagaacctgatcagaatgggcgtggccggcctggtgctgctgttcctgggcatcctgctgttcgaggcccagcacagccagagaagcccccccagatgcagccaggaggccaacagcagaaaggacaacgcccccttcagagtggtggagccctgggagcagatctag

SEQ ID NO: 19121 - DNA, 978 bp, Artificial Sequence
  Description of Artificial Sequence: Synthetic coding sequence
atggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggcaaggagctgaccgccgacgccagagagctgaagggcgagctgtactgcctgccctgccacgacaagatgggcgtgcccatctgcggcgcctgcagaagacccatcgagggcagagtggtgaacgccatgggcaagcagtggcacgtggagcacttcgtgtgcgccaagtgcgagaagcccttcctgggccacagacactacgagagaaagggcctggcctactgcgagacccactacaaccagctgttcggcgacgtgtgcttccactgcaacagagtgatcgagggcgacgtggtgagcgccctgaacaaggcctggtgcgtgaactgcttcgcctgcagcacctgcaacaccaagctgaccctgaagaacaagttcgtggagttcgacatgaagcccgtgtgcaagaagtgctacgagaagttccccctggagctgaagaagagactgaagaagctggccgagaccctgggcagaaagtag

SEQ ID NO: 19122 - DNA, 978 bp, Artificial Sequence; identical to SEQ ID NO: 19121
  Description of Artificial Sequence: Synthetic coding sequence

SEQ ID NO: 19123 - DNA, 978 bp, Artificial Sequence; identical to SEQ ID NO: 19121
  Description of Artificial Sequence: Synthetic coding sequence

SEQ ID NO: 19124 - DNA, 354 bp, Artificial Sequence
  Description of Artificial Sequence: Synthetic coding sequence
atggccttcagcggcagagccagaccctgcatcatccccgagaacgaggagatccccagagccgccctgaacaccgtgcacgaggccaacggcaccgaggacgagagagccgtgagcaagctgcagagaagacacagcgacgtgaaggtgtacaaggagttctgcgacttctacgccaagttcaacatggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgaggagagaacctag

SEQ ID NO: 19125 - DNA, 1089 bp, Artificial Sequence
  Description of Artificial Sequence: Synthetic coding sequence
atgaccgccctgcagctgaaggagctgagccacagcggcctgtacagaagaagaagagacagacccgacagcctgagagtgaacggcctgcccgaggaggagctgagcaacatggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggcaaggagctgaccgccgacgccagagagctgaagggcgagctgtactgcctgccctgccacgacaagatgggcgtgcccatctgcggcgcctgcagaagacccatcgagggcagagtggtgaacgccatgggcaagcagtggcacgtggagcacttcgtgtgcgccaagtgcgagaagcccttcctgggccacagacactacgagagaaagggcctggcctactgcgagacccactacaaccagctgttcggcgacgtgtgcttccactgcaacagagtgatcgagggcgacgtggtgagcgccctgaacaaggcctggtgcgtgaactgcttcgcctgcagcacctgcaacaccaagctgaccctgaagaacaagttcgtggagttcgacatgaagcccgtgtgcaagaagtgctacgagaagttccccctggagctgaagaagagactgaagaagctggccgagaccctgggcagaaagtag

SEQ ID NO: 19126 - DNA, 990 bp, Artificial Sequence
  Description of Artificial Sequence: Synthetic coding sequence
atgacctgcaacatggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggcaaggagctgaccgccgacgccagagagctgaagggcgagctgtactgcctgccctgccacgacaagatgggcgtgcccatctgcggcgcctgcagaagacccatcgagggcagagtggtgaacgccatgggcaagcagtggcacgtggagcacttcgtgtgcgccaagtgcgagaagcccttcctgggccacagacactacgagagaaagggcctggcctactgcgagacccactacaaccagctgttcggcgacgtgtgcttccactgcaacagagtgatcgagggcgacgtggtgagcgccctgaacaaggcctggtgcgtgaactgcttcgcctgcagcacctgcaacaccaagctgaccctgaagaacaagttcgtggagttcgacatgaagcccgtgtgcaagaagtgctacgagaagttccccctggagctgaagaagagactgaagaagctggccgagaccctgggcagaaagtag

SEQ ID NO: 19127 - DNA, 1164 bp, Artificial Sequence
  Description of Artificial Sequence: Synthetic coding sequence
atggccttcagcggcagagccagaccctgcatcatccccgagaacgaggagatccccagagccgccctgaacaccgtgcacgaggccaacggcaccgaggacgagagagccgtgagcaagctgcagagaagacacagcgacgtgaaggtgtacaaggagttctgcgacttctacgccaagttcaacatggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggcaaggagctgaccgccgacgccagagagctgaagggcgagctgtactgcctgccctgccacgacaagatgggcgtgcccatctgcggcgcctgcagaagacccatcgagggcagagtggtgaacgccatgggcaagcagtggcacgtggagcacttcgtgtgcgccaagtgcgagaagcccttcctgggccacagacactacgagagaaagggcctggcctactgcgagacccactacaaccagctgttcggcgacgtgtgcttccactgcaacagagtgatcgagggcgacgtggtgagcgccctgaacaaggcctggtgcgtgaactgcttcgcctgcagcacctgcaacaccaagctgaccctgaagaacaagttcgtggagttcgacatgaagcccgtgtgcaagaagtgctacgagaagttccccctggagctgaagaagagactgaagaagctggccgagaccctgggcagaaagtag

SEQ ID NO: 19128 - DNA, 1014 bp, Artificial Sequence
  Description of Artificial Sequence: Synthetic coding sequence
atgctgggcgtggccgccggcatgacccacagcaacatggccaacgccctggccagcgccacctgcgagagatgcaagggcggcttcgcccccgccgagaagatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggcaaggagctgaccgccgacgccagagagctgaagggcgagctgtactgcctgccctgccacgacaagatgggcgtgcccatctgcggcgcctgcagaagacccatcgagggcagagtggtgaacgccatgggcaagcagtggcacgtggagcacttcgtgtgcgccaagtgcgagaagcccttcctgggccacagacactacgagagaaagggcctggcctactgcgagacccactacaaccagctgttcggcgacgtgtgcttccactgcaacagagtgatcgagggcgacgtggtgagcgccctgaacaaggcctggtgcgtgaactgcttcgcctgcagcacctgcaacaccaagctgaccctgaagaacaagttcgtggagttcgacatgaagcccgtgtgcaagaagtgctacgagaagttccccctggagctgaagaagagactgaagaagctggccgagaccctgggcagaaagtag

SEQ ID NO: 19129 - DNA, 1098 bp, Artificial Sequence
  Description of Artificial Sequence: Synthetic coding sequence
atggccgccagactgggcgccctggccgccagcggcctgtacagaagaagacagcacagacagagccccccccccgccaccggcaacatgagcgacgccctggccaacgccgtgtgccagagatgccaggccagattcagccccgccgagagaatcgtgaacagcaacggcgagctgtaccacgagcactgcttcgtgtgcgcccagtgcttcagacccttccccgagggcctgttctacgagttcgagggcagaaagtactgcgagcacgacttccagatgctgttcgccccctgctgcggcagctgcggcgagttcatcatcggcagagtgatcaaggccatgaacaacaactggcaccccggctgcttcagatgcgagctgtgcgacgtggagctggccgacctgggcttcgtgaagaacgccggcagacacctgtgcagaccctgccacaacagagagaaggccaagggcctgggcaagtacatctgccagagatgccacctggtgatcgacgagcagcccctgatgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19130 - DNA, 750 bp, Artificial Sequence
  Description of Artificial Sequence: Synthetic coding sequence
atggagagcagacaccccgccgtggccgagatcgcctgcacctgctgggccctgctgcacctggccaaccccgagggcagaggccacctgtgcagaccctgccacaacagagagaaggccaagggcctgggcaagtacatctgccagagatgccacctggtgatcgacgagcagcccctgatgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19131 - DNA, 1026 bp, Artificial Sequence
  Description of Artificial Sequence: Synthetic coding sequence
atgaccggcagcaacatgagcgacgccctggccaacgccgtgtgccagagatgccaggccagattcagccccgccgagagaatcgtgaacagcaacggcgagctgtaccacgagcactgcttcgtgtgcgcccagtgcttcagacccttccccgagggcctgttctacgagttcgagggcagaaagtactgcgagcacgacttccagatgctgttcgccccctgctgcggcagctgcggcgagttcatcatcggcagagtgatcaaggccatgaacaacaactggcaccccggctgcttcagatgcgagctgtgcgacgtggagctggccgacctgggcttcgtgaagaacgccggcagacacctgtgcagaccctgccacaacagagagaaggccaagggcctgggcaagtacatctgccagagatgccacctggtgatcgacgagcagcccctgatgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19132 - DNA, 570 bp, Artificial Sequence
  Description of Artificial Sequence: Synthetic coding sequence
atgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19133 - DNA, 570 bp, Artificial Sequence; identical to SEQ ID NO: 19132
  Description of Artificial Sequence: Synthetic coding sequence

SEQ ID NO: 19134 - DNA, 1011 bp, Artificial Sequence
  Description of Artificial Sequence: Synthetic coding sequence
atgagcgacgccctggccaacgccgtgtgccagagatgccaggccagattcagccccgccgagagaatcgtgaacagcaacggcgagctgtaccacgagcactgcttcgtgtgcgcccagtgcttcagacccttccccgagggcctgttctacgagttcgagggcagaaagtactgcgagcacgacttccagatgctgttcgccccctgctgcggcagctgcggcgagttcatcatcggcagagtgatcaaggccatgaacaacaactggcaccccggctgcttcagatgcgagctgtgcgacgtggagctggccgacctgggcttcgtgaagaacgccggcagacacctgtgcagaccctgccacaacagagagaaggccaagggcctgggcaagtacatctgccagagatgccacctggtgatcgacgagcagcccctgatgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19135 - DNA, 570 bp, Artificial Sequence; identical to SEQ ID NO: 19132
  Description of Artificial Sequence: Synthetic coding sequence

SEQ ID NO: 19136 - DNA, 1011 bp, Artificial Sequence; identical to SEQ ID NO: 19134
  Description of Artificial Sequence: Synthetic coding sequence

SEQ ID NO: 19137 - DNA, 1011 bp, Artificial Sequence; identical to SEQ ID NO: 19134
  Description of Artificial Sequence: Synthetic coding sequence

SEQ ID NO: 19138 - DNA, 570 bp, Artificial Sequence; identical to SEQ ID NO: 19132
  Description of Artificial Sequence: Synthetic coding sequence

SEQ ID NO: 19139 - DNA, 1011 bp, Artificial Sequence; identical to SEQ ID NO: 19134
  Description of Artificial Sequence: Synthetic coding sequence

SEQ ID NO: 19140 - DNA, 441 bp, Artificial Sequence
  Description of Artificial Sequence: Synthetic coding sequence
atgagcgacgccctggccaacgccgtgtgccagagatgccaggccagattcagccccgccgagagaatcgtgaacagcaacggcgagctgtaccacgagcactgcttcgtgtgcgcccagtgcttcagacccttccccgagggcctgttctacgagttcgagggcagaaagtactgcgagcacgacttccagatgctgttcgccccctgctgcggcagctgcggcgagttcatcatcggcagagtgatcaaggccatgaacaacaactggcaccccggctgcttcagatgcgagctgtgcgacgtggagctggccgacctgggcttcgtgaagaacgccggcagacacctgtgcagaccctgccacaacagagagaaggccaagggcctgggcaagtacatctgccagagatgccacctggtgatcgacgagcagccctag

SEQ ID NO: 19141 - DNA, 570 bp, Artificial Sequence; identical to SEQ ID NO: 19132
  Description of Artificial Sequence: Synthetic coding sequence

SEQ ID NO: 19142 - DNA, 1092 bp, Artificial Sequence
  Description of Artificial Sequence: Synthetic coding sequence
atgaccggcagaaagagaaagtggggcgagaccggcaccggcagcggcgccgcccccgccgccgccctgagatggagcaacatgagcgacgccctggccaacgccgtgtgccagagatgccaggccagattcagccccgccgagagaatcgtgaacagcaacggcgagctgtaccacgagcactgcttcgtgtgcgcccagtgcttcagacccttccccgagggcctgttctacgagttcgagggcagaaagtactgcgagcacgacttccagatgctgttcgccccctgctgcggcagctgcggcgagttcatcatcggcagagtgatcaaggccatgaacaacaactggcaccccggctgcttcagatgcgagctgtgcgacgtggagctggccgacctgggcttcgtgaagaacgccggcagacacctgtgcagaccctgccacaacagagagaaggccaagggcctgggcaagtacatctgccagagatgccacctggtgatcgacgagcagcccctgatgttcagaagcgacgcctaccaccccgaccacttcaactgcacccactgcggcaaggagctgaccgccgaggccagagagctgaagggcgagctgtactgcctgccctgccacgacaagatgggcgtgcccatctgcggcgcctgcagaagacccatcgagggcagagtggtgaacgccctgggcaagcagtggcacgtggagcacttcgtgtgcgccaagtgcgagaagcccttcctgggccacagacactacgagaagaagggcctggcctactgcgagacccactacaaccagctgttcggcgacgtgtgctacaactgcagccacgtgatcgagggcgacgtggtgagcgccctgaacaaggcctggtgcgtgagctgcttcagctgcagcacctgcaacagcaagctgaccctgaagaacaagttcgtggagttcgacatgaagcccgtgtgcaagagatgctacgagaagttccccctggagctgaagaagagactgaagaagctgagcgagctgaccagcagaaaggcccagcccaaggccaccgacctgaacagcgcctag

SEQ ID NO: 19143 - DNA, 1092 bp, Artificial Sequence; identical to SEQ ID NO: 19142
  Description of Artificial Sequence: Synthetic coding sequence

SEQ ID NO: 19144 - DNA, 702 bp, Artificial Sequence
  Description of Artificial Sequence: Synthetic coding sequence
atgctgaagcccagcgtgaccagcgcccccaccgccgacatggccaccctgaccgtggtgcagcccctgaccctggacagagacgtggccagagccatcgagctgctggagaagctgcaggagagcggcgaggtgcccgtgcacaagctgcagagcctgaagaaggtgctgcagagcgagttctgcaccgccatcagagaggtgtaccagtacatgcacgagaccatcaccgtgaacggctgccccgagttcagagccagagccaccgccaaggccaccgtggccgccttcgccgccagcgagggccacagccaccccagagtggtggagctgcccaagaccgacgagggcctgggcttcaacgtgatgggcggcaaggagcagaacagccccatctacatcagcagaatcatccccggcggcgtggccgagagacacggcggcctgaagagaggcgaccagctgctgagcgtgaacggcgtgagcgtggagggcgagcaccacgagaaggccgtggagctgctgaaggccgccaaggacagcgtgaagctggtggtgagatacacccccaaggtgctggaggagatggaggccagattcgagaagctgagaaccgccagaagaagacagcagcagcagctgctgatccagcagcagcagcagcagcagcagcagcagacccagcagaaccacatgagctag

SEQ ID NO: 19145 - DNA, 858 bp, Artificial Sequence
  Description of Artificial Sequence: Synthetic coding sequence
atgaaggtgaccgtgggccccgaccccagcctggtgtacagacccgacgtggaccccgaggtggccaaggacaaggccagcttcagaaactacaccagcggccccctgctggacagagtgttcaccacctacaagctgatgcacacccaccagaccgtggacttcgtgagaagcaagcacgcccagttcggcggcttcagctacaagaagatgaccgtgatggaggccgtggacctgctggacggcctggtggacgagagcgaccccgacgtggacttccccaacagcttccacgccttccagaccgccgagggcatcagaaaggcccaccccgacaaggactggttccacctggtgggcctgctgcacgacctgggcaaggtgctggccctgttcggcgagccccagtgggccgtggtgggcgacaccttccccgtgggctgcagaccccaggccagcgtggtgttctgcgacagcaccttccaggacaaccccgacctgcaggaccccagatacagcaccgagctgggcatgtaccagccccactgcggcctggacagagtgctgatgagctggggccacgacgagtacatgtaccaggtgatgaagttcaacaagttcagcctgccccccgaggccttctacatgatcagattccacagcttctacccctggcacaccggcagagactaccagcagctgtgcagccagcaggacctggccatgctgccctgggtgagagagttcaacaagttcgacctgtacaccaagtgccccgacctgcccgacgtggacaagctgagaccctactaccagggcctgatcgacaagtactgccccggcatcctgagctggtag

SEQ ID NO: 19146 - DNA, 1785 bp, Artificial Sequence
  Description of Artificial Sequence: Synthetic coding sequence
atggccggcagcagactgcccagacagctgttcctgcagggcgtggccgccgtgttcatgttcgccttcgccagcctgtacacccagatccccggcctgtacggccccgagggcatcctgcccgccagaagaaccctgagaccccagggcaagggcagatggcagcagctgtgggagacccccaccctgctgtgggaggcccccagactgggcctggacaccgcccagggcctggagctgctgagcctgctgggcgccctggtggccctgggcgccctgctgctgagccccctgagacaccccgtgatctacctgctgctgtgggccgcctacctgagcgcctgccaggtgggccaggtgttcctgtacttccagtgggacagcctgctgctggagaccggcttcctggccgtgctggtggcccccctgagacccgccagccacagaaaggaggccccccagggcagacaggccggcgccctgccccacgaggacctgcccttctggctggtgagatggctgctgttcagactgatgttcgccagcggcgtggtgaagctgaccagcagatgccccgcctggtggggcctgaccgccctgacctaccactacgagacccagtgcctgcccacccccgccgcctggttcgcccaccacctgcccgtgtggctgcacaagctgagcgtggtggccaccttcctgatcgagatcgccgtgccccccctgttcttcgcccccatcagaagactgagactggccgccttctacagccaggtgctgctgcaggtgctgatcatcatcaccggcaactacaacttcttcaacctgatgaccctggtgctgaccaccgccctgctggacgaccagcacctggccgccgagcccggccacggcagcagaaagaagaccgccaccagctggcccaaggccctgctggccaccctgagcctgctgctggagctggccgtgtacggcctgctggcctacggcaccgtgcactacttcggcctggaggtggactggcagcagagaaccatccacagcagaaccaccttcaccttccaccagttcagccagtggctgaagaccctgaccctgcccaccgtgtggctgggcgtggccagcctggtgtgggagctgctgagcgccctgtggagatggacccaggtgagagactggcagatgtggttcgccgccctgggcccccacacccacagcccctggttcaccagcctggtgctgagactgctgcagggcaaggagcccgtgatcagactggtgcagagccaggtggccagataccccttccacaagcagccccccacctacgtgagagcccagagatacaagtactggttcagccagcccggcgagcagggccagtggtggagaagacagtgggtggaggagttcttccccagcgtgagcctgggcgaccccaccctggagaccctgctgagacagttcggcctgcaggagaagagcccccccagaaccagaagcgccaacagcaccctggcccaggccctgcactggaccagaagccagctgagccccctggaggcccccgccctgctgtggggcctgctgatggccgtgggcgccgtgagattcgtgcaggccctgctggccccctgcagcctgagaagcagccccctggcccccgtgagcggcgagaagagaagacccgccagccagaaggacagcggcgccgccagcgagcaggccaccgccgcccccaacccctgcagcagcagcagcagaaccaccagaagaaagaagtag

SEQ ID NO: 19147 - DNA, 2124 bp, Artificial Sequence
  Description of Artificial Sequence: Synthetic coding sequence
atggccggcagcagactgcccagacagctgttcctgcagggcgtggccgccgtgttcatgttcgccttcgccagcctgtacacccagatccccggcctgtacggccccgagggcatcctgcccgccagaagaaccctgagaccccagggcaagggcagatggcagcagctgtgggagacccccaccctgctgtgggaggcccccagactgggcctggacaccgcccagggcctggagctgctgagcctgctgggcgccctggtggccctgggcgccctgctgctgagccccctgagacaccccgtgatctacctgctgctgtgggccgcctacctgagcgcctgccaggtgggccaggtgttcctgtacttccagtgggacagcctgctgctggagaccggcttcctggccgtgctggtggcccccctgagacccgccagccacagaaaggaggccccccagggcagacaggccggcgccctgccccacgaggacctgcccttctggctggtgagatggctgctgttcagactgatgttcgccagcggcgtggtgaagctgaccagcagatgccccgcctggtggggcctgaccgccctgacctaccactacgagacccagtgcctgcccacccccgccgcctggttcgcccaccacctgcccgtgtggctgcacaagctgagcgtggtggccaccttcctgatcgagatcgccgtgccccccctgttcttcgcccccatcagaagactgagactggccgccttctacagccaggtgctgctgcaggtgctgatcatcatcaccggcaactacaacttcttcaacctgatgaccctggtgctgaccaccgccctgctggacgaccagcacctggccgccgagcccggccacggcagcagaaagaagaccgccaccagctggcccaaggccctgctggccaccctgagcctgctgctggagctggccgtgtacggcctgctggcctacggcaccgtgcactacttcggcctggaggtggactggcagcagagaaccatccacagcagaaccaccttcaccttccaccagttcagccagtggctgaagaccctgaccctgcccaccgtgtggctgggcgtggccagcctggtgtgggagctgctgagcgccctgtggagatggacccaggtgagaggctggctgagaaagctgagcgccgtggtgcagctgagcctggtgggcaccgccaccgtggccctgttcctgatcagcctggtgccctacagctacgtggagcccggcacccacggcagactgtggaccggcgcccacagactgttcggcgccgtggagcacctgcagctggccaacagctacggcctgttcagaagaatgaccggcctgggcggcagacccgaggtggtgctggagggcagctacgacggccaccactggaccgagatcgagttcatgtacaagcccggcaacctgagcagacccccccccgtggtggtgccccaccagcccagactggactggcagatgtggttcgccgccctgggcccccacacccacagcccctggttcaccagcctggtgctgagactgctgcagggcaaggagcccgtgatcagactggtgcagagccaggtggccagataccccttccacaagcagccccccacctacgtgagagcccagagatacaagtactggttcagccagcccggcgagcagggccagtggtggagaagacagtgggtggaggagttcttccccagcgtgagcctgggcgaccccaccctggagaccctgctgagacagttcggcctgcaggagaagagcccccccagaaccagaagcgccaacagcaccctggcccaggccctgcactggaccagaagccagctgagccccctggaggcccccgccctgctgtggggcctgctgatggccgtgggcgccgtgagattcgtgcaggccctgctggccccctgcagcctgagaagcagccccctggcccccgtgagcggcgagaagagaagacccgccagccagaaggacagcggcgccgccagcgagcaggccaccgccgcccccaacccctgcagcagcagcagcagaaccaccagaagaaagaagtag

SEQ ID NO: 19148 - DNA, 978 bp, Artificial Sequence
  Description of Artificial Sequence: Synthetic coding sequence
atggccgtgggcaacaacacccagagaagctacagcatcatcccctgcttcatcttcgtggagctggtgatcatggccggcaccgtgctgctggcctactacttcgagtgcaccgacaccttccaggtgcacatccagggcttcttctgccaggacggcgacctgatgaagccctaccccggcaccgaggaggagagcttcatcacccccctggtgctgtactgcgtgctggccgccacccccaccgccatcatcttcatcggcgagatcagcatgtacttcatcaagagcaccagagagagcctgatcgcccaggagaagaccatcctgaccggcgagtgctgctacctgaaccccctgctgagaagaatcatcagattcaccggcgtgttcgccttcggcctgttcgccaccgacatcttcgtgaacgccggccaggtggtgaccggccacctgaccccctacttcctgaccgtgtgcaagcccaactacaccagcgccgactgccaggcccaccaccagttcatcaacaacggcaacatctgcaccggcgacctggaggtgatcgagaaggccagaagaagcttccccagcaagcacgccgccctgagcatctacagcgccctgtacgccaccatgtacatcaccagcaccatcaagaccaagagcagcagactggccaagcccgtgctgtgcctgggcaccctgtgcaccgccttcctgaccggcctgaacagagtgagcgagtacagaaaccactgcagcgacgtgatcgccggcttcatcctgggcaccgccgtggccctgttcctgggcatgtgcgtggtgcacaacttcaagggcacccagggcagccccagcaagcccaagcccgaggaccccagaggcgtgcccctgatggccttccccagaatcgagagccccctggagaccctgagcgcccagaaccacagcgccagcatgaccgaggtgacctag

SEQ ID NO: 19149 - DNA, 978 bp, Artificial Sequence; identical to SEQ ID NO: 19148
  Description of Artificial Sequence: Synthetic coding sequence

SEQ ID NO: 19150 - DNA, 978 bp, Artificial Sequence; identical to SEQ ID NO: 19148
  Description of Artificial Sequence: Synthetic coding sequence

SEQ ID NO: 19151 - DNA, 312 bp, Artificial Sequence
  Description of Artificial Sequence: Synthetic coding sequence
atggccgtgggcaacaacacccagagaagctacagcatcatcccctgcttcatcttcgtggagctggtgatcatggccggcaccgtgctgctggcctactacttcgagtgcaccgacaccttccaggtgcacatccagggcttcttctgccaggacggcgacctgatgaagccctaccccggcaccgaggaggagagcttcatcacccccctggtgctgtactgcgtgctggccgccacccccaccgccatcatcttcatcggcgagatcagcatgtacttcatcaagagcaccagagagagcctgatctag

SEQ ID NO: 19152 - DNA, 1032 bp, Artificial Sequence
  Description of Artificial Sequence: Synthetic coding sequence
atggccggcggcagaccccacctgaagagaagcttcagcatcatcccctgcttcgtgttcgtggagagcgtgctgctgggcatcgtgatcctgctggcctacagactggagttcaccgacaccttccccgtgcacacccagggcttcttctgctacgacagcacctacgccaagccctaccccggccccgaggccgccagcagagtgccccccgccctggtgtacgccctggtgaccgccggccccaccctgaccatcctgctgggcgagctggccagagccttcttccccgccccccccagcgccgtgcccgtgatcggcgagagcaccatcgtgagcggcgcctgctgcagattcagcccccccgtgagaagactggtgagattcctgggcgtgtacagcttcggcctgttcaccaccaccatcttcgccaacgccggccaggtggtgaccggcaaccccaccccccacttcctgagcgtgtgcagacccaactacaccgccctgggctgcctgccccccagccccgacagacccggccccgacagattcgtgaccgaccagggcgcctgcgccggcagccccagcctggtggccgccgccagaagagccttcccctgcaaggacgccgccctgtgcgcctacgccgtgacctacaccgccatgtacgtgaccctggtgttcagagtgaagggcagcagactggtgaagcccagcctgtgcctggccctgctgtgccccgccttcctggtgggcgtggtgagagtggccgagtacagaaaccactggagcgacgtgctggccggcttcctgaccggcgccgccatcgccaccttcctggtgacctgcgtggtgcacaacttccagagcagaccccccagcggcagaagactgagcccctgggaggacctgggccaggcccccaccatggacagccccctggagaagaaccccagaagcgccggcagaatcagacacagacacggcagcccccaccccagcagaagaaccgcccccgccgtggccacctag

SEQ ID NO: 19153 - DNA, 1284 bp, Artificial Sequence
  Description of Artificial Sequence: Synthetic coding sequence
atggccggcggcagaccccacctgaagagaagcttcagcatcatcccctgcttcgtgttcgtggagggcttcttctgctacgacagcacctacgccaagccctaccccggccccgaggccgccagcagagtgccccccgccctggtgtacgccctggtgaccgccggccccaccctgaccatcctgctgggcgagctggccagagccttcttccccgccccccccagcgccgtgcccgtgatcggcgagagcaccatcgtgagcggcgcctgctgcagattcagcccccccgtgagaagactggtgagattcctgggcgtgtacagcttcggcctgttcaccaccaccatcttcgccaacgccggccaggtggtgaccggcaaccccaccccccacttcctgagcgtgtgcagacccaactacaccgccctgggctgcctgccccccagccccgacagacccggccccgacagattcgtgaccgaccagggcgcctgcgccggcagccccagcctggtggccgccgccagaagagccttcccctgcaaggacgccgccctgtgcgcctacgccgtgacctacaccgccatgtacgtgaccctggtgttcagagtgaagggcagcagactggtgaagcccagcctgtgcctggccctgctgtgccccgccttcctggtgggcgtggtgagagtggccgagtacagaaaccactggagcgacgtgctggccggcttcctgaccggcgccgccatcgccaccttcctggtgacctgcgtggtgcacaacttccagagcagaccccccagcggcagaagactgagcccctgggaggacctgggccaggcccccaccatggacagccccctggagaagctgagcgtggcccaggagcccgaggtgtgcagaccccacagcacccccgccagactgacccccagcaagagccagaactgcgccagaagaggccacctgatccccagctgcgtgagcagcagagcccccgccatgtgcagcagccccagagtgcccagacccagactgagaagcgagcccacccccctgcccctgcccctgcccctgcccgcccccacccccagccagggccccagccccagcagccccggccccggcggccccggcggcggcggcggcagaggcagaaagctgctgctgcccacccccctgctgagagacctgtacaccctgagcggcctgtaccccagccccttccacagagacaacttcagcccctacctgttcgccagcagagaccacctgctgtag

SEQ ID NO: 19154 - DNA, 2160 bp, Artificial Sequence
  Description of Artificial Sequence: Synthetic coding sequence
atgatcagcaccaaggagaagaacaagatccccaaggacagcatgaccctgctgccctgcttctacttcgtggagctgcccatcgtggccagcagcatcgtgagcctgtacttcctggagctgaccgacctgttcaagcccgccaaggtgggcttccagtgctacgacagaaccctgagcatgccctacgtggagaccaacgaggagctgatccccctgctgatgctgctgagcctggccttcgccgcccccgccgccagcatcatggtggccgagggcatgctgtactgcctgcagagcagactgtggggcagagccggcggccccgccggcgccgagggcagcatcaacgccggcggctgcaacttcaacagcttcctgagaagaaccgtgagattcgtggccggcgtgcacgtgttcggcctgtgcgccaccgccctggtgaccgacgtgatccagctggccaccggctaccacacccccttcttcctgaccgtgtgcaagcccaactacaccctgctgggcaccagctgcgaggtgaacccctacatcacccaggacatctgcagcggccacgacatccacgccatcctgagcgccagaaagaccttccccagccagcacgccaccctgagcgccttcgccgccgtgtacgtgagcatgtacttcaacagcgtgatcagcgacaccaccaagctgctgaagcccatcctggtgttcgccttcgccatcgccgccggcgtgtgcggcctgacccagatcacccagtacagaagccaccccgtggacgtgtacgccggcttcctgatcggcgccggcatcgccgcctacctggcctgccacgccgtgggcaacttccaggccccccccgccgagaagcccgccgcccccgcccccgccaaggacgccctgagagccctgacccagagaggccacgacagcgtgtaccagcagaacaagagcgtgagcaccgacgagctgggcccccccggcagactggagggcgcccccagacccgtggccagagagaagaccagcctgggcagcctgaagagagccagcgtggacgtggacctgctggcccccagaagccccatggccaaggagaacatggtgaccttcagccacaccctgcccagagccagcgcccccagcctggacgaccccgccagaagacacatgaccatccacgtgcccctggacgccagcagaagcaagcagctgatcagcgagtggaagcagaagagcctggagggcagaggcctgggcctgcccgacgacgccagccccggccacctgagagcccccgccgagcccatggccgaggaggaggaggaggaggaggacgaggaggaggaggaggaggaggaggaggaggaggacgagggccccgccccccccagcctgtaccccaccgtgcaggccagacccggcctgggccccagagtgatcctgccccccagagccggccccccccccctggtgcacatccccgaggagggcgcccagaccggcgccggcctgagccccaagagcggcgccggcgtgagagccaagtggctgatgatggccgagaagagcggcgccgccgtggccaacccccccagactgctgcaggtgatcgccatgagcaaggcccccggcgcccccggccccaaggccgccgagaccgccagcagcagcagcgccagcagcgacagcagccagtacagaagccccagcgacagagacagcgccagcatcgtgaccatcgacgcccacgccccccaccaccccgtggtgcacctgagcgccggcggcgccccctgggagtggaaggccgccggcggcggcgccaaggccgaggccgacggcggctacgagctgggcgacctggccagaggcttcagaggcggcgccaagccccccggcgtgagccccggcagcagcgtgagcgacgtggaccaggaggagcccagattcggcgccgtggccaccgtgaacctggccaccggcgagggcctgccccccctgggcgccgccgacggcgccctgggccccggcagcagagagagcaccctgagaagacacgccggcggcctgggcctggccgagagagaggccgaggccgaggccgagggctacttcagaaagatgcaggccagaagattccccgactag

SEQ ID NO: 19155 - DNA, 2241 bp, Artificial Sequence
  Description of Artificial Sequence: Synthetic coding sequence
atgatcagcaccaaggagaagaacaagatccccaaggacagcatgaccctgctgccctgcttctacttcgtggagctgcccatcgtggccagcagcatcgtgagcctgtacttcctggagctgaccgacctgttcaagcccgccaaggtgggcttccagtgctacgacagaaccctgagcatgccctacgtggagaccaacgaggagctgatccccctgctgatgctgctgagcctggccttcgccgcccccgccgccagcatcatggtggccgagggcatgctgtactgcctgcagagcagactgtggggcagagccggcggccccgccggcgccgagggcagcatcaacgccggcggctgcaacttcaacagcttcctgagaagaaccgtgagattcgtgggcgtgcacgtgttcggcctgtgcgccaccgccctggtgaccgacgtgatccagctggccaccggctaccacacccccttcttcctgaccgtgtgcaagcccaactacaccctgctgggcaccagctgcgaggtgaacccctacatcacccaggacatctgcagcggccacgacatccacgccatcctgagcgccagaaagaccttccccagccagcacgccaccctgagcgccttcgccgccgtgtacgtgagcgtgagccccgccccccactgccccagccaggccctgctgctgaccagaggcgagcccagcctgacccccacccccatgccccagatgtacttcaacagcgtgatcagcgacaccaccaagctgctgaagcccatcctggtgttcgccttcgccatcgccgccggcgtgtgcggcctgacccagatcacccagtacagaagccaccccgtggacgtgtacgccggcttcctgatcggcgccggcatcgccgcctacctggcctgccacgccgtgggcaacttccaggccccccccgccgagaagcccgccgcccccgcccccgccaaggacgccctgagagccctgacccagagaggccacgacagcgtgtaccagcagaacaagagcgtgagcaccgacgagctgggcccccccggcagactggagggcgcccccagacccgtggccagagagaagaccagcctgggcagcctgaagagagccagcgtggacgtggacctgctggcccccagaagccccatggccaaggagaacatggtgaccttcagccacaccctgcccagagccagcgcccccagcctggacgaccccgccagaagacacatgaccatccacgtgcccctggacgccagcagaagcaagcagctgatcagcgagtggaagcagaagagcctggagggcagaggcctgggcctgcccgacgacgccagccccggccacctgagagcccccgccgagcccatggccgaggaggaggaggaggaggaggacgaggaggaggaggaggaggaggaggaggaggaggacgagggccccgccccccccagcctgtaccccaccgtgcaggccagacccggcctgggccccagagtgatcctgccccccagagccggccccccccccctggtgcacatccccgaggagggcgcccagaccggcgccggcctgagccccaagagcggcgccggcgtgagagccaagtggctgatgatggccgagaagagcggcgccgccgtggccaacccccccagactgctgcaggtgatcgccatgagcaaggcccccggcgcccccggccccaaggccgccgagaccgccagcagcagcagcgccagcagcgacagcagccagtacagaagccccagcgacagagacagcgccagcatcgtgaccatcgacgcccacgccccccaccaccccgtggtgcacctgagcgccggcggcgccccctgggagtggaaggccgccggcggcggcgccaaggccgaggccgacggcggctacgagctgggcgacctggccagaggcttcagaggcggcgccaagccccccggcgtgagccccggcagcagcgtgagcgacgtggaccaggaggagcccagattcggcgccgtggccaccgtgaacctggccaccggcgagggcctgccccccctgggcgccgccgacggcgccctgggccccggcagcagagagagcaccctgagaagacacgccggcggcctgggcctggccgagagagaggccgaggccgaggccgagggctacttcagaaagatgcaggccagaagattccccgactag

SEQ ID NO: 19156 - DNA, 2157 bp, Artificial Sequence
  Description of Artificial Sequence: Synthetic coding sequence
atgatcagcaccaaggagaagaacaagatccccaaggacagcatgaccctgctgccctgcttctacttcgtggagctgcccatcgtggccagcagcatcgtgagcctgtacttcctggagctgaccgacctgttcaagcccgccaaggtgggcttccagtgctacgacagaaccctgagcatgccctacgtggagaccaacgaggagctgatccccctgctgatgctgctgagcctggccttcgccgcccccgccgccagcatcatggtggccgagggcatgctgtactgcctgcagagcagactgtggggcagagccggcggccccgccggcgccgagggcagcatcaacgccggcggctgcaacttcaacagcttcctgagaagaaccgtgagattcgtgggcgtgcacgtgttcggcctgtgcgccaccgccctggtgaccgacgtgatccagctggccaccggctaccacacccccttcttcctgaccgtgtgcaagcccaactacaccctgctgggcaccagctgcgaggtgaacccctacatcacccaggacatctgcagcggccacgacatccacgccatcctgagcgccagaaagaccttccccagccagcacgccaccctgagcgccttcgccgccgtgtacgtgagcatgtacttcaacagcgtgatcagcgacaccaccaagctgctgaagcccatcctggtgttcgccttcgccatcgccgccggcgtgtgcggcctgacccagatcacccagtacagaagccaccccgtggacgtgtacgccggcttcctgatcggcgccggcatcgccgcctacctggcctgccacgccgtgggcaacttccaggccccccccgccgagaagcccgccgcccccgcccccgccaaggacgccctgagagccctgacccagagaggccacgacagcgtgtaccagcagaacaagagcgtgagcaccgacgagctgggcccccccggcagactggagggcgcccccagacccgtggccagagagaagaccagcctgggcagcctgaagagagccagcgtggacgtggacctgctggcccccagaagccccatggccaaggagaacatggtgaccttcagccacaccctgcccagagccagcgcccccagcctggacgaccccgccagaagacacatgaccatccacgtgcccctggacgccagcagaagcaagcagctgatcagcgagtggaagcagaagagcctggagggcagaggcctgggcctgcccgacgacgccagccccggccacctgagagcccccgccgagcccatggccgaggaggaggaggaggaggaggacgaggaggaggaggaggaggaggaggaggaggaggacgagggccccgccccccccagcctgtaccccaccgtgcaggccagacccggcctgggccccagagtgatcctgccccccagagccggccccccccccctggtgcacatccccgaggagggcgcccagaccggcgccggcctgagccccaagagcggcgccggcgtgagagccaagtggctgatgatggccgagaagagcggcgccgccgtggccaacccccccagactgctgcaggtgatcgccatgagcaaggcccccggcgcccccggccccaaggccgccgagaccgccagcagcagcagcgccagcagcgacagcagccagtacagaagccccagcgacagagacagcgccagcatcgtgaccatcgacgcccacgccccccaccaccccgtggtgcacctgagcgccggcggcgccccctgggagtggaaggccgccggcggcggcgccaaggccgaggccgacggcggctacgagctgggcgacctggccagaggcttcagaggcggcgccaagccccccggcgtgagccccggcagcagcgtgagcgacgtggaccaggaggagcccagattcggcgccgtggccaccgtgaacctggccaccggcgagggcctgccccccctgggcgccgccgacggcgccctgggccccggcagcagagagagcaccctgagaagacacgccggcggcctgggcctggccgagagagaggccgaggccgaggccgagggctacttcagaaagatgcaggccagaagattccccgactag

SEQ ID NO: 19157 - DNA, 1734 bp, Artificial Sequence
  Description of Artificial Sequence: Synthetic coding sequence
atgcagagagccggcagcagcggcggcagaggcgagtgcgacatcagcggcgccggcagactgggcctggaggaggccgccagactgagctgcgccgtgcacaccagccccggcggcggcagaagacccggccaggccgccggcatgagcgccaaggagagacccaagggcaaggtgatcaaggacagcgtgaccctgctgccctgcttctacttcgtggagctgcccatcctggccagcagcgtggtgagcctgtacttcctggagctgaccgacgtgttcaagcccgtgcacagcggcttcagctgctacgacagaagcctgagcatgccctacatcgagcccacccaggaggccatccccttcctgatgctgctgagcctggccttcgccggccccgccatcaccatcatggtgggcgagggcatcctgtactgctgcctgagcaagagaagaaacggcgtgggcctggagcccaacatcaacgccggcggctgcaacttcaacagcttcctgagaagagccgtgagattcgtgggcgtgcacgtgttcggcctgtgcagcaccgccctgatcaccgacatcatccagctgagcaccggctaccaggccccctacttcctgaccgtgtgcaagcccaactacaccagcctgaacgtgagctgcaaggagaacagctacatcgtggaggacatctgcagcggcagcgacctgaccgtgatcaacagcggcagaaagagcttccccagccagcacgccaccctggccgccttcgccgccgtgtacgtgagcatgtacttcaacagcaccctgaccgacagcagcaagctgctgaagcccctgctggtgttcaccttcatcatctgcggcatcatctgcggcctgaccagaatcacccagtacaagaaccaccccgtggacgtgtactgcggcttcctgatcggcggcggcatcgccctgtacctgggcctgtacgccgtgggcaacttcctgcccagcgacgagagcatgttccagcacagagacgccctgagaagcctgaccgacctgaaccaggaccccaacagactgctgagcgccaagaacggcagcagcagcgacggcatcgcccacaccgagggcatcctgaacagaaaccacagagacgccagcagcctgaccaacctgaagagagccaacgccgacgtggagatcatcacccccagaagccccatgggcaaggagaacatggtgaccttcagcaacaccctgcccagagccaacacccccagcgtggaggaccccgtgagaagaaacgccagcatccacgccagcatggacagcgccagaagcaagcagctgctgacccagtggaagaacaagaacgagagcagaaagctgagcctgcaggtgatcgagcccgagcccggccagagcccccccagaagcatcgagatgagaagcagcagcgagcccagcagagtgggcgtgaacggcgaccaccacggccccggcaaccagtacctgaagatccagcccggcgccgtgcccggctgcaacaacagcatgcccggcggccccagagtgagcatccagagcagacccggcagcagccagctggtgcacatccccgaggagacccaggagaacatcagcaccagccccaagagcagcagagtgagcagcaaggccgcccccagaaccctgaaggccgccagaagccccgccctggcccccagcgccatcaagccctag

SEQ ID NO: 19158 - DNA, 1818 bp, Artificial Sequence
  Description of Artificial Sequence: Synthetic coding sequence
atgaacatgttcgacgccgacaccaccaccaacctggtgaccatcagcttcatcctgcccatcggcgtgcacgtgttcggcctgtgcagcaccgccctgatcaccgacatcatccagctgagcaccggctaccaggccccctacttcctgaccgtgtgcaagcccaactacaccagcctgaacgtgagctgcaaggagaacagctacatcgtggaggacatctgcagcggcagcgacctgaccgtgatcaacagcggcagaaagagcttccccagccagcacgccaccctggccgccttcgccgccgtgtacgtgagcatgtacttcaacagcaccctgaccgacagcagcaagctgctgaagcccctgctggtgttcaccttcatcatctgcggcatcatctgcggcctgaccagaatcacccagtacaagaaccaccccgtggacgtgtactgcggcttcctgatcggcggcggcatcgccctgtacctgggcctgtacgccgtgggcaacttcctgcccagcgacgagagcatgttccagcacagagacgccctgagaagcctgaccgacctgaaccaggaccccaacagactgctgagcgccaagaacggcagcagcagcgacggcatcgcccacaccgagggcatcctgaacagaaaccacagagacgccagcagcctgaccaacctgaagagagccaacgccgacgtggagatcatcacccccagaagccccatgggcaaggagaacatggtgaccttcagcaacaccctgcccagagccaacacccccagcgtggaggaccccgtgagaagaaacgccagcatccacgccagcatggacagcgccagaagcaagcagctgctgacccagtggaagaacaagaacgagagcagaaagctgagcctgcaggtgatcgagcccgagcccggccagagcccccccagaagcatcgagatgagaagcagcagcgagcccagcagagtgggcgtgaacggcgaccaccacggccccggcaaccagtacctgaagatccagcccggcgccgtgcccggctgcaacaacagcatgcccggcggccccagagtgagcatccagagcagacccggcagcagccagctggtgcacatccccgaggagacccaggagaacatcagcaccagccccaagagcagcagcgccagagccaagtggctgaaggccgccgagaagaccgtggcctgcaacagaagcaacagccagcccagaatcatgcaggtgatcgccatgagcaagcagcagggcgtgctgcagagcagccccaagaacaccgagggcagcaccgtgagctgcaccggcagcatcagatacaagaccctgaccgaccacgagcccagcggcatcgtgagagtggaggcccaccccgagaacaacagacccatcatccagatccccagcaccgagggcgagggcagcggcagctggaagtggaaggcccccgagaagggcagcctgagacagacctacgagctgaacgacctgaacagagacagcgagagctgcgagagcctgaaggacagcttcggcagcggcgacagaaagagaagcaacatcgacagcaacgagcaccaccaccacggcatcaccaccatcagagtgacccccgtggagggcagcgagatcggcagcgagaccctgagcatcagcagcagcagagacagcaccctgagaagaaagggcaacatcatcctgatccccgagagaagcaacagccccgagaacaccagaaacatcttctacaagggcaccagccccaccagagcctacaaggactag

SEQ ID NO: 19159 - DNA, 2292 bp, Artificial Sequence
  Description of Artificial Sequence: Synthetic coding sequence
atgcagagagccggcagcagcggcggcagaggcgagtgcgacatcagcggcgccggcagactgggcctggaggaggccgccagactgagctgcgccgtgcacaccagccccggcggcggcagaagacccggccaggccgccggcatgagcgccaaggagagacccaagggcaaggtgatcaaggacagcgtgaccctgctgccctgcttctacttcgtggagctgcccatcctggccagcagcgtggtgagcctgtacttcctggagctgaccgacgtgttcaagcccgtgcacagcggcttcagctgctacgacagaagcctgagcatgccctacatcgagcccacccaggaggccatccccttcctgatgctgctgagcctggccttcgccggccccgccatcaccatcatggtgggcgagggcatcctgtactgctgcctgagcaagagaagaaacggcgtgggcctggagcccaacatcaacgccggcggctgcaacttcaacagcttcctgagaagagccgtgagattcgtgggcgtgcacgtgttcggcctgtgcagcaccgccctgatcaccgacatcatccagctgagcaccggctaccaggccccctacttcctgaccgtgtgcaagcccaactacaccagcctgaacgtgagctgcaaggagaacagctacatcgtggaggacatctgcagcggcagcgacctgaccgtgatcaacagcggcagaaagagcttccccagccagcacgccaccctggccgccttcgccgccgtgtacgtgagcatgtacttcaacagcaccctgaccgacagcagcaagctgctgaagcccctgctggtgttcaccttcatcatctgcggcatcatctgcggcctgaccagaatcacccagtacaagaaccaccccgtggacgtgtactgcggcttcctgatcggcggcggcatcgccctgtacctgggcctgtacgccgtgggcaacttcctgcccagcgacgagagcatgttccagcacagagacgccctgagaagcctgaccgacctgaaccaggaccccaacagactgctgagcgccaagaacggcagcagcagcgacggcatcgcccacaccgagggcatcctgaacagaaaccacagagacgccagcagcctgaccaacctgaagagagccaacgccgacgtggagatcatcacccccagaagccccatgggcaaggagaacatggtgaccttcagcaacaccctgcccagagccaacacccccagcgtggaggaccccgtgagaagaaacgccagcatccacgccagcatggacagcgccagaagcaagcagctgctgacccagtggaagaacaagaacgagagcagaaagctgagcctgcaggtgatcgagcccgagcccggccagagcccccccagaagcatcgagatgagaagcagcagcgagcccagcagagtgggcgtgaacggcgaccaccacggccccggcaaccagtacctgaagatccagcccggcgccgtgcccggctgcaacaacagcatgcccggcggccccagagtgagcatccagagcagacccggcagcagccagctggtgcacatccccgaggagacccaggagaacatcagcaccagccccaagagcagcagcgccagagccaagtggctgaaggccgccgagaagaccgtggcctgcaacagaagcaacagccagcccagaatcatgcaggtgatcgccatgagcaagcagcagggcgtgctgcagagcagccccaagaacaccgagggcagcaccgtgagctgcaccggcagcatcagatacaagaccctgaccgaccacgagcccagcggcatcgtgagagtggaggcccaccccgagaacaacagacccatcatccagatccccagcaccgagggcgagggcagcggcagctggaagtggaaggcccccgagaagggcagcctgagacagacctacgagctgaacgacctgaacagagacagcgagagctgcgagagcctgaaggacagcttcggcagcggcgacagaaagagaagcaacatcgacagcaacgagcaccaccaccacggcatcaccaccatcagagtgacccccgtggagggcagcgagatcggcagcgagaccctgagcatcagcagcagcagagacagcaccctgagaagaaagggcaacatcatcctgatccccgagagaagcaacagccccgagaacaccagaaacatcttctacaagggcaccagccccaccagagcctacaaggactag

SEQ ID NO: 19160 - DNA, 2118 bp, Artificial Sequence
  Description of Artificial Sequence: Synthetic coding sequence
atgcagagagccggcagcagcggcggcagaggcgagtgcgacatcagcggcgccggcagactgggcctggaggaggccgccagactgagctgcgccgtgcacaccagccccggcggcggcagaagacccggccaggccgccggcatgagcgccaaggagagacccaagggcaaggtgatcaaggacagcgtgaccctgctgccctgcttctacttcgtggagctgcccatcctggccagcagcgtggtgagcctgtacttcctggagctgaccgacgtgttcaagcccgtgcacagcggcttcagctgctacgacagaagcctgagcatgccctacatcgagcccacccaggaggccatccccttcctgatgctgctgagcctggccttcgccggccccgccatcaccatcatggtgggcgagggcatcctgtactgctgcctgagcaagagaagaaacggcgtgggcctggagcccaacatcaacgccggcggctgcaacttcaacagcttcctgagaagagccgtgagattcgtgggcgtgcacgtgttcggcctgtgcagcaccgccctgatcaccgacatcatccagctgagcaccggctaccaggccccctacttcctgaccgtgtgcaagcccaactacaccagcctgaacgtgagctgcaaggagaacagctacatcgtggaggacatctgcagcggcagcgacctgaccgtgatcaacagcggcagaaagagcttccccagccagcacgccaccctggccgccttcgccgccgtgtacgtgagcggcctgtacgccgtgggcaacttcctgcccagcgacgagagcatgttccagcacagagacgccctgagaagcctgaccgacctgaaccaggaccccaacagactgctgagcgccaagaacggcagcagcagcgacggcatcgcccacaccgagggcatcctgaacagaaaccacagagacgccagcagcctgaccaacctgaagagagccaacgccgacgtggagatcatcacccccagaagccccatgggcaaggagaacatggtgaccttcagcaacaccctgcccagagccaacacccccagcgtggaggaccccgtgagaagaaacgccagcatccacgccagcatggacagcgccagaagcaagcagctgctgacccagtggaagaacaagaacgagagcagaaagctgagcctgcaggtgatcgagcccgagcccggccagagcccccccagaagcatcgagatgagaagcagcagcgagcccagcagagtgggcgtgaacggcgaccaccacggccccggcaaccagtacctgaagatccagcccggcgccgtgcccggctgcaacaacagcatgcccggcggccccagagtgagcatccagagcagacccggcagcagccagctggtgcacatccccgaggagacccaggagaacatcagcaccagccccaagagcagcagcgccagagccaagtggctgaaggccgccgagaagaccgtggcctgcaacagaagcaacagccagcccagaatcatgcaggtgatcgccatgagcaagcagcagggcgtgctgcagagcagccccaagaacaccgagggcagcaccgtgagctgcaccggcagcatcagatacaagaccctgaccgaccacgagcccagcggcatcgtgagagtggaggcccaccccgagaacaacagacccatcatccagatccccagcaccgagggcgagggcagcggcagctggaagtggaaggcccccgagaagggcagcctgagacagacctacgagctgaacgacctgaacagagacagcgagagctgcgagagcctgaaggacagcttcggcagcggcgacagaaagagaagcaacatcgacagcaacgagcaccaccaccacggcatcaccaccatcagagtgacccccgtggagggcagcgagatcggcagcgagaccctgagcatcagcagcagcagagacagcaccctgagaagaaagggcaacatcatcctgatccccgagagaagcaacagccccgagaacaccagaaacatcttctacaagggcaccagccccaccagagcctacaaggactag

SEQ ID NO: 19161 - DNA, 966 bp, Artificial Sequence
  Description of Artificial Sequence: Synthetic coding sequence
atgcccctgctgcccgccgccctgaccagcagcatgctgtacttccagatggtgatcatggccggcaccgtgatgctggcctactacttcgagtacaccgacaccttcaccgtgaacgtgcagggcttcttctgccacgacagcgcctacagaaagccctaccccggccccgaggacagcagcgccgtgccccccgtgctgctgtacagcctggccgccggcgtgcccgtgctggtgatcatcgtgggcgagaccgccgtgttctgcctgcagctggccaccagagacttcgagaaccaggagaagaccatcctgaccggcgactgctgctacatcaaccccctggtgagaagaaccgtgagattcctgggcatctacaccttcggcctgttcgccaccgacatcttcgtgaacgccggccaggtggtgaccggcaacctggccccccacttcctggccctgtgcaagcccaactacaccgccctgggctgccagcagtacacccagttcatcagcggcgaggaggcctgcaccggcaaccccgacctgatcatgagagccagaaagaccttccccagcaaggaggccgccctgagcgtgtacgccgccatgtacctgaccatgtacatcaccaacaccatcaaggccaagggcaccagactggccaagcccgtgctgtgcctgggcctgatgtgcctggccttcctgaccggcctgaacagagtggccgagtacagaaaccactggagcgacgtgatcgccggcttcctggtgggcatcagcatcgccgtgttcctggtggtgtgcgtggtgaacaacttcaagggcagacaggccgagaacgagcacatccacatggacaacctggcccagatgcccatgatcagcatccccagagtggagagccccctggagaaggtgaccagcgtgcagaaccacatcaccgccttcgccgaggtgacctag

SEQ ID NO: 19162 - DNA, 951 bp, Artificial Sequence
  Description of Artificial Sequence: Synthetic coding sequence
atgcccctgctgcccgccgccctgaccagcagcatgctgtacttccagatggtgatcatggccggcaccgtgatgctggcctactacttcgagtacaccgacaccttcaccgtgaacgtgcagggcttcttctgccacgacagcgcctacagaaagccctaccccggccccgaggacagcagcgccgtgccccccgtgctgctgtacagcctggccgccggcgtgcccgtgctggtgatcatcgtgggcgagaccgccgtgttctgcctgcagctggccaccagagacttcgagaaccaggagaagaccatcctgaccggcgactgctgctacatcaaccccctggtgagaagaaccgtgagattcctgggcatctacaccttcggcctgttcgccaccgacatcttcgtgaacgccggccaggtggtgaccggcaacctggccccccacttcctggccctgtgcaagcccaactacaccgccctgggctgccagcagtacacccagttcatcagcggcgaggaggcctgcaccggcaaccccgacctgatcatgagagccagaaagaccttccccagcaaggaggccgccctgagcgtgtacgccgccatgtacctgaccatgtacatcaccaacaccatcaaggccaagggcaccagactggccaagcccgtgctgtgcctgggcctgatgtgcctggccttcctgaccggcctgaacagagtggccgagtacagaaaccactggagcgacgtgatcgccggcttcctggtgggcatcagcatcgccgtgttcctggtggtgtgcgtggtgaacaacttcaagggcagacaggccgagaacgagcacatccacatggacaacctggcccagatgcccatgatcagcatccccagagtggagagccccctggagaagaaccacatcaccgccttcgccgaggtgacctag

SEQ ID NO: 19163 - DNA, 744 bp, Artificial Sequence
  Description of Artificial Sequence: Synthetic coding sequence
atgctgcccagccaggaggccagcaagctgtaccacgagcactacatgagaaacagcagagccatcggcgtgctgtgggccatcttcaccatctgcttcgccatcatcaacgtggtggtgttcatccagccctactgggtgggcgacagcgtgagcacccccaagcccggctacttcggcctgttccactactgcgtgggcagcggcctggccggcagagagctgacctgcagaggcagcttcaccgacttcagcaccatccccagcagcgccttcaaggccgccgccttcttcgtgctgctgagcatggtgctgatcctgggctgcatcacctgcttcagcctgttcttcttctgcaacaccgccaccgtgtacaagatctgcgcctggatgcagctgctggccgccctgtgcctggtgctgggctgcatgatcttccccgacggctgggacgccgagaccatcagagacatgtgcggcgccaagaccggcaagtacagcctgggcgactgcagcgtgagatgggcctacatcctggccatcatcggcatcctgaacgccctgatcctgagcttcctggccttcgtgctgggcaacagacagaccgacctgctgcaggaggagctgaagcccgagaacaaggacttcgtgggcagcaccgtgagcagcgtgctgagacccggcggcgacgtgagcggctggggcgtgctgccctgccccgtggcccacagccagggcccctag

SEQ ID NO: 19164 - DNA, 2088 bp, Artificial Sequence
  Description of Artificial Sequence: Synthetic coding sequence
atgagcggcgccgccctgggcctggagatcgtgttcgtgttcttcctggccctgttcctgctgcacagatacggcgacttcaagaagcagcacagactggtgatcatcggcaccctgctggcctggtacctgtgcttcctgatcgtgttcatcctgcccctggacgtgagcaccaccatctacaacagatgcaagcacgccgccgccaacagcagcccccccgagaacagcaacatcaccggcctgtacgccaccgccaaccccgtgcccagccagcacccctgcttcaagccctggagctacatccccgacggcatcatgcccatcttctggagagtggtgtactggaccagccagttcctgacctggatcctgctgcccttcatgcagagctacgccagaagcggcggcttcagcatcaccggcaagatcaagaccgccctgatcgagaacgccatctactacggcacctacctgctgatcttcggcgccttcctgatctacgtggccgtgaacccccacctgcacctggagtggaaccagctgcagaccatcggcatcgccgccgccaacacctggggcctgttcctgctggtgctgctgctgggctacggcctggtggagatccccagaagctactggaacggcgccaagagaggctacctgctgatgaagacctacttcaaggccgccaagctgatgaccgagaaggccgacgccgaggagaacctggaggacgccatggaggaggtgagaaaggtgaacgagagcatcaagtacaaccaccccctgagaaagtgcgtggacaccatcctgaagaagtgccccaccgagtaccaggagaagatgggcagaaacatggacgactacgaggacttcgacgagaagcacagcatctaccccagcgagaagagcctggtgaagctgcacaagcaggtgatctacagcgtgcagagacacagaagaacccaggtgcagtggcagatcctgctggagcaggccttctacctggaggacgtggccaagaacgagaccagcgccacccaccagttcgtgcacaccttccagagccccgagcccgagaacagattcatccagtacttctacaaccccaccttcgagtggtactgggagtgcctgctgagaccctggttctacaagatcctggccgtggtgctgagcatcttcagcgtgatcgtggtgtggagcgagtgcaccttcttcagcaccacccccgtgctgagcctgttcgccgtgttcatccagctggccgagaagacctacaactacatctacatcgagatcgcctgcttcctgagcatcttcttcctgagcatctgcgtgtacagcaccgtgttcagaatcagagtgttcaactactactacctggccagccaccaccagaccgacgcctacagcctgctgttcagcggcatgctgttctgcagactgaccccccccctgtgcctgaacttcctgggcctgacccacatggacagcagcatcagccacaagaacacccagcccaccgcctacaccagcatcatgggcagcatgaaggtgctgagcttcatcgccgacggcttctacatctactaccccatgctggtggtgatcctgtgcatcgccacctacttcagcctgggcaccagatgcctgaacctgctgggcttccagcagttcatgggcgacgacgacatgaccagcgacctggtgaacgagggcaaggagctgatcagaaaggagaagagaaagagacagagacaggaggagggcgagaacagaagaagagagtggaaggagagatacggccacaacagagaggacagcaccagaaacagaaacatccacaccgaccccaaggagagcaacttcagcgacgtgaacaccaacagaagcgccttcaagtacaccagagccaacaacagaaccgagagagacagaatcgagctgctgcaggacgccgagcccctggacttcaacgccgagaccttcaccgacgaccccctggagagcgagagcggcagataccagcccggcggcagatacctgagcatgagcagaagcgacatcttcaacgacgtgtag

SEQ ID NO: 19165 - DNA, 1770 bp, Artificial Sequence
  Description of Artificial Sequence: Synthetic coding sequence
atgcccatcttctggagagtggtgtactggaccagccagttcctgacctggatcctgctgcccttcatgcagagctacgccagaagcggcggcttcagcatcaccggcaagatcaagaccgccctgatcgagaacgccatctactacggcacctacctgctgatcttcggcgccttcctgatctacgtggccgtgaacccccacctgcacctggagtggaaccagctgcagaccatcggcatcgccgccgccaacacctggggcctgttcctgctggtgctgctgctgggctacggcctggtggagatccccagaagctactggaacggcgccaagagaggctacctgctgatgaagacctacttcaaggccgccaagctgatgaccgagaaggccgacgccgaggagaacctggaggacgccatggaggaggtgagaaaggtgaacgagagcatcaagtacaaccaccccctgagaaagtgcgtggacaccatcctgaagaagtgccccaccgagtaccaggagaagatgggcagaaacatggacgactacgaggacttcgacgagaagcacagcatctaccccagcgagaagagcctggtgaagctgcacaagcaggtgatctacagcgtgcagagacacagaagaacccaggtgcagtggcagatcctgctggagcaggccttctacctggaggacgtggccaagaacgagaccagcgccacccaccagttcgtgcacaccttccagagccccgagcccgagaacagattcatccagtacttctacaaccccaccttcgagtggtactgggagtgcctgctgagaccctggttctacaagatcctggccgtggtgctgagcatcttcagcgtgatcgtggtgtggagcgagtgcaccttcttcagcaccacccccgtgctgagcctgttcgccgtgttcatccagctggccgagaagacctacaactacatctacatcgagatcgcctgcttcctgagcatcttcttcctgagcatctgcgtgtacagcaccgtgttcagaatcagagtgttcaactactactacctggccagccaccaccagaccgacgcctacagcctgctgttcagcggcatgctgttctgcagactgaccccccccctgtgcctgaacttcctgggcctgacccacatggacagcagcatcagccacaagaacacccagcccaccgcctacaccagcatcatgggcagcatgaaggtgctgagcttcatcgccgacggcttctacatctactaccccatgctggtggtgatcctgtgcatcgccacctacttcagcctgggcaccagatgcctgaacctgctgggcttccagcagttcatgggcgacgacgacatgaccagcgacctggtgaacgagggcaaggagctgatcagaaaggagaagagaaagagacagagacaggaggagggcgagaacagaagaagagagtggaaggagagatacggccacaacagagaggacagcaccagaaacagaaacatccacaccgaccccaaggagagcaacttcagcgacgtgaacaccaacagaagcgccttcaagtacaccagagccaacaacagaaccgagagagacagaatcgagctgctgcaggacgccgagcccctggacttcaacgccgagaccttcaccgacgaccccctggagagcgagagcggcagataccagcccggcggcagatacctgagcatgagcagaagcgacatcttcaacgacgtgtag

SEQ ID NO: 19166 - DNA, 618 bp, Artificial Sequence
  Description of Artificial Sequence: Synthetic coding sequence
atgaacaaggtgttcccccagggcgagaacggctacaccgccgccgagagcaaggcccaccccggcggcgaggccggcggcggccacctgtgctgcagcagaagaggcgcctgcctgagcgccagcctgctgctgctgctggccaccgtggccgccctgatcgccctggtgaccatcctgggcctgcccagctgcacccccggcgcccaggcctgcatcaccctgaccaacagaaccggcttcctgtgccacgaccagagaagctgcatccccgccagcggcgtgtgcgacggcgtgagaacctgcacccacggcgaggacgaggacgagagcctgtgcagagacgtgccccagagcctgccccacttcctggtggcccactgcggcgaccccgccagctggatctacagcgaccagaagtgcgacggcaccaacaactgcggcgactgcagcgacgagctgagccccgtgaccgtgtgccccccctgcggccccggctggtggagatgccccagcaccttcttcaagtactgcgactgcatccccagacacctgtgcagagaccacgtgcagcactgcagcgactggagcgacgagtacgcctgccccggcccctag

SEQ ID NO: 19167 - DNA, 351 bp, Artificial Sequence
  Description of Artificial Sequence: Synthetic coding sequence
atgaacaaggtgttcccccagggcgagaacggctacaccgccgccgagagcaaggcccaccccggcggcgagggcgacgtgccccagagcctgccccacttcctggtggcccactgcggcgaccccgccagctggatctacagcgaccagaagtgcgacggcaccaacaactgcggcgactgcagcgacgagctgagccccgtgaccgtgtgccccccctgcggccccggctggtggagatgccccagcaccttcttcaagtactgcgactgcatccccagacacctgtgcagagaccacgtgcagcactgcagcgactggagcgacgagtacgcctgccccggcccctag

SEQ ID NO: 19168 - DNA, 819 bp, Artificial Sequence
  Description of Artificial Sequence: Synthetic coding sequence
atggaggcctgctgcctgctgcagctgccccagagactgctgctgctgggcgccgccgccctgaccgccaccgccctggagaccgccgacctggccgagctgtgcggccagacctggcagggcgacggcctgctgctgagaagccacgccgccagcagaagattctacttcgtggcccccgacaccgactgcggcctgtgggtgcaggccgccgcccccggcgacagaatcagattccagttcagattcttcctggtgtacagcctgacccccgccccccccgccctgaacaccagcagccccgcccccgccgacccctgcgcccccggcagctacctgcagttctacgagggcccccccggcgcccccagacccctgggcagccccctgtgcggcctgaacatccccgtgcccgtggccagcagcggccccttcctgggcctgagactggtgaccagaggcagacagcccagagtggacttcgtgggcgaggtgaccagcttcagactgggcccctgcggcgcctacttcagatgccagaacggcagatgcatccccagcagcctggtgtgcgacccctggggcatggacaactgcggcgacggcagcgaccagggcagctggagccccgccgactgcagaggccccagccccgtgcccagccagaccggcagcaccgacgcccacaccagcagaagcctgacccccagccccgccctgggcagcgccggcagcctgtggatcgccgccgagagaagcagccccgccggcagagaccccaccagacaggacgccgccctggagggcagcaccgagtag

SEQ ID NO: 19169 - DNA, 819 bp, Artificial Sequence; identical to SEQ ID NO: 19168
  Description of Artificial Sequence: Synthetic coding sequence

SEQ ID NO: 19170 - DNA, 1038 bp, Artificial Sequence
  Description of Artificial Sequence: Synthetic coding sequence
atgtggctgctgggccccctgtgcctgctgctgagcagcgccgccgagagccagctgctgcccggcaacaacttcaccaacgagtgcaacatccccggcaacttcatgtgcagcaacggcagatgcatccccggcgcctggcagtgcgacggcctgcccgactgcttcgacaagagcgacgagaaggagtgccccaaggccaagagcaagtgcggccccaccttcttcccctgcgccagcggcatccactgcatcatcggcagattcagatgcaacggcttcgaggactgccccgacggcagcgacgaggagaactgcaccgccaaccccctgctgtgcagcaccgccagataccactgcaagaacggcctgtgcatcgacaagagcttcatctgcgacggccagaacaactgccaggacaacagcgacgaggagagctgcgagagcagccaggagcccggcagcggccaggtgttcgtgaccagcgagaaccagctggtgtactaccccagcatcacctacgccatcatcggcagcagcgtgatcttcgtgctggtggtggccctgctggccctggtgctgcaccaccagagaaagagaaacaacctgatgaccctgcccgtgcacagactgcagcaccccgtgctgctgagcagactggtggtgctggaccacccccaccactgcaacgtgacctacaacgtgaacaacggcatccagtacgtggccagccaggccgagcagaacgccagcgaggtgggcagcccccccagctacagcgaggccctgctggaccagagacccgcctggtacgacctgcccccccccccctacagcagcgacaccgagagcctgaaccaggccgacctgcccccctacagaagcagaagcggcagcgccaacagcgccagcagccaggccgccagcagcctgctgagcgtggaggacaccagccacagccccggccagcccggcccccaggagggcaccgccgagcccagagacagcgagcccagccagggcaccgaggaggtgtag

SEQ ID NO: 19171 - DNA, 468 bp, Artificial Sequence
  Description of Artificial Sequence: Synthetic coding sequence
atgtggctgctgggccccctgtgcctgctgctgagcagcgccgccgagagccagctgctgcccggcaacaacttcaccaacgagtgcaacatccccggcaacttcatgtgcagcaacggcagatgcatccccggcgcctggcagtgcgacggcctgcccgactgcttcgacaagagcgacgagaaggagtgccccaaggccaagagcaagtgcggccccaccttcttcccctgcgccagcggcatccactgcatcatcggcagattcagatgcaacggcttcgaggactgccccgacggcagcgacgaggagaactgcaagaacggcctgtgcatcgacaagagcttcatctgcgacggccagaacaactgccaggacaacagcgacgaggagagctgcgagagcagccagggcctgagaggcatgaccttcctgcacagacccaccctgctgaccagaaacctgtag

SEQ ID NO: 19172 - DNA, 1503 bp, Artificial Sequence
  Description of Artificial Sequence: Synthetic coding sequence
atggccagcgtggcccaggagagcgccggcagccagagaagactgccccccagacacggcgccctgagaggcctgctgctgctgtgcctgtggctgcccagcggcagagccgccctgccccccgccgcccccctgagcgagctgcacgcccagctgagcggcgtggagcagctgctggaggagttcagaagacagctgcagcaggagagaccccaggaggagctggagctggagctgagagccggcggcggcccccaggaggactgccccggccccggcagcggcggctacagcgccatgcccgacgccatcatcagaaccaaggacagcctggccgccggcgccagcttcctgagagcccccgccgccgtgagaggctggagacagtgcgtggccgcctgctgcagcgagcccagatgcagcgtggccgtggtggagctgcccagaagacccgccccccccgccgccgtgctgggctgctacctgttcaactgcaccgccagaggcagaaacgtgtgcaagttcgccctgcacagcggctacagcagctacagcctgagcagagcccccgacggcgccgccctggccaccgccagagccagccccagacaggagaaggacgccccccccctgagcaaggccggccaggacgtggtgctgcacctgcccaccgacggcgtggtgctggacggcagagagagcaccgacgaccacgccatcgtgcagtacgagtgggccctgctgcagggcgaccccagcgtggacatgaaggtgccccagagcggcaccctgaagctgagccacctgcaggagggcacctacaccttccagctgaccgtgaccgacaccgccggccagagaagcagcgacaacgtgagcgtgaccgtgctgagagccgcctacagcaccggcggctgcctgcacacctgcagcagataccacttcttctgcgacgacggctgctgcatcgacatcaccctggcctgcgacggcgtgcagcagtgccccgacggcagcgacgaggacttctgccagaacctgggcctggacagaaagatggtgacccacaccgccgccagccccgccctgcccagaaccaccggccccagcgaggacgccggcggcgacagcctggtggagaagagccagaaggccaccgcccccaacaagccccccgccctgagcaacaccgagaagagaaaccacagcgccttctggggccccgagagccagatcatccccgtgatgcccgacagcagcagcagcggcaagaacagaaaggaggagagctacatcttcgagagcaagggcgacggcggcggcggcgagcaccccgcccccgagaccggcgccgtgctgcccctggccctgggcctggccatcaccgccctgctgctgctgatggtggcctgcagactgagactggtgaagcagaagctgaagaaggccagacccatcaccagcgaggagagcgactacctgatcaacggcatgtacctgtag

SEQ ID NO: 19173 - DNA, 978 bp, Artificial Sequence
  Description of Artificial Sequence: Synthetic coding sequence
atggccagcgtggcccaggagagcgccggcagccagagaagactgccccccagacacggcgccctgagaggcctgctgctgctgtgcctgtggctgcccagcggcagagccgccctgccccccgccgcccccctgagcgagctgcacgcccagctgagcggcgtggagcagctgctggaggagttcagaagacagctgcagcaggagagaccccaggaggagctggagctggagctgagagccggcggcggcccccaggaggactgccccggccccggcagcggcggctacagcgccatgcccgacgccatcatcagaaccaaggacagcctggccgccggcgccagcttcctgagagcccccgccgccgtgagaggctggagacagtgcgtggccgcctgctgcagcgagcccagatgcagcgtggccgtggtggagctgcccagaagacccgccccccccgccgccgtgctgggctgctacctgttcaactgcaccgccagaggcagaaacgtgtgcaagttcgccctgcacagcggctacagcagctacagcctgagcagagcccccgacggcgccgccctggccaccgccagagccagccccagacaggagaaggacgccccccccctgagcaaggccggccaggacgtggtgctgcacctgcccaccgacggcgtggtgctggacggcagagagagcaccgacgaccacgccatcgtgcagtacgagtgggccctgctgcagggcgaccccagcgtggacatgaaggtgccccagagcggcaccctgaagctgagccacctgcaggagggcacctacaccttccagctgaccgtgaccgacaccgccggccagagaagcagcgacaacgtgagcgtgaccgtgctgagagccgcctacagcaccggcgacggctggagcatctgctgcatctgcagcaagagagaggccaaggagttcagcgagaccagctag

SEQ ID NO: 19174 - DNA, 738 bp, Artificial Sequence
  Description of Artificial Sequence: Synthetic coding sequence
atgaaggtgccccagagcggcaccctgaagctgagccacctgcaggagggcacctacaccttccagctgaccgtgaccgacaccgccggccagagaagcagcgacaacgtgagcgtgaccgtgctgagagccgcctacagcaccggcggctgcctgcacacctgcagcagataccacttcttctgcgacgacggctgctgcatcgacatcaccctggcctgcgacggcgtgcagcagtgccccgacggcagcgacgaggacttctgccagaacctgggcctggacagaaagatggtgacccacaccgccgccagccccgccctgcccagaaccaccggccccagcgaggacgccggcggcgacagcctggtggagaagagccagaaggccaccgcccccaacaagccccccgccctgagcaacaccgagaagagaaaccacagcgccttctggggccccgagagccagatcatccccgtgatgcccgacagcagcagcagcggcaagaacagaaaggaggagagctacatcttcgagagcaagggcgacggcggcggcggcgagcaccccgcccccgagaccggcgccgtgctgcccctggccctgggcctggccatcaccgccctgctgctgctgatggtggcctgcagactgagactggtgaagcagaagctgaagaaggccagacccatcaccagcgaggagagcgactacctgatcaacggcatgtacctgtag

SEQ ID NO: 19175 - DNA, 2580 bp, Artificial Sequence
  Description of Artificial Sequence: Synthetic coding sequence
atggcctgcagatggagcaccaaggagagccccagatggagaagcgccctgctgctgctgttcctggccggcgtgtacggcaacggcgccctggccgagcacagcgagaacgtgcacatcagcggcgtgagcaccgcctgcggcgagacccccgagcagatcagagcccccagcggcatcatcaccagccccggctggcccagcgagtaccccgccaagatcaactgcagctggttcatcagagccaaccccggcgagatcatcaccatcagcttccaggacttcgacatccagggcagcagaagatgcaacctggactggctgaccatcgagacctacaagaacatcgagagctacagagcctgcggcagcaccatcccccccccctacatcagcagccaggaccacatctggatcagattccacagcgacgacaacatcagcagaaagggcttcagactggcctacttcagcggcaagagcgaggagcccaactgcgcctgcgaccagttcagatgcggcaacggcaagtgcatccccgaggcctggaagtgcaacaacatggacgagtgcggcgacagcagcgacgaggagatctgcgccaaggaggccaacccccccaccgccgccgccttccagccctgcgcctacaaccagttccagtgcctgagcagattcaccaaggtgtacacctgcctgcccgagagcctgaagtgcgacggcaacatcgactgcctggacctgggcgacgagatcgactgcgacgtgcccacctgcggccagtggctgaagtacttctacggcaccttcaacagccccaactaccccgacttctacccccccggcagcaactgcacctggctgatcgacaccggcgaccacagaaaggtgatcctgagattcaccgacttcaagctggacggcaccggctacggcgactacgtgaagatctacgacggcctggaggagaacccccacaagctgctgagagtgctgaccgccttcgacagccacgcccccctgaccgtggtgagcagcagcggccagatcagagtgcacttctgcgccgacaaggtgaacgccgccagaggcttcaacgccacctaccaggtggacggcttctgcctgccctgggagatcccctgcggcggcaactggggctgctacaccgagcagcagagatgcgacggctactggcactgccccaacggcagagacgagaccaactgcaccatgtgccagaaggaggagttcccctgcagcagaaacggcgtgtgctaccccagaagcgacagatgcaactaccagaaccactgccccaacggcagcgacgagaagaactgcttcttctgccagcccggcaacttccactgcaagaacaacagatgcgtgttcgagagctgggtgtgcgacagccaggacgactgcggcgacggcagcgacgaggagaactgccccgtgatcgtgcccaccagagtgatcaccgccgccgtgatcggcagcctgatctgcggcctgctgctggtgatcgccctgggctgcacctgcaagctgtacagcctgagaatgttcgagagaagaagcttcgagacccagctgagcagagtggaggccgagctgctgagaagagaggccccccccagctacggccagctgatcgcccagggcctgatcccccccgtggaggacttccccgtgtgcagccccaaccaggccagcgtgctggagaacctgagactggccgtgagaagccagctgggcttcaccagcgtgagactgcccatggccggcagaagcagcaacatctggaacagaatcttcaacttcgccagaagcagacacagcggcagcctggccctggtgagcgccgacggcgacgaggtggtgcccagccagagcaccagcagagagcccgagagaaaccacacccacagaagcctgttcagcgtggagagcgacgacaccgacaccgagaacgagagaagagacatggccggcgccagcggcggcgtggccgcccccctgccccagaaggtgccccccaccaccgccgtggaggccaccgtgggcgcctgcgccagcagcagcacccagagcaccagaggcggccacgccgacaacggcagagacgtgaccagcgtggagccccccagcgtgagccccgccagacaccagctgaccagcgccctgagcagaatgacccagggcctgagatgggtgagattcaccctgggcagaagcagcagcctgagccagaaccagagccccctgagacagctggacaacggcgtgagcggcagagaggacgacgacgacgtggagatgctgatccccatcagcgacggcagcagcgacttcgacgtgaacgactgcagcagacccctgctggacctggccagcgaccagggccagggcctgagacagccctacaacgccaccaaccccggcgtgagacccagcaacagagacggcccctgcgagagatgcggcatcgtgcacaccgcccagatccccgacacctgcctggaggtgaccctgaagaacgagaccagcgacgacgaggccctgctgctgtgctag

SEQ ID NO: 19176 - DNA, 2523 bp, Artificial Sequence
  Description of Artificial Sequence: Synthetic coding sequence
atggcctgcagatggagcaccaaggagagccccagatggagaagcgccctgctgctgctgttcctggccggcgtgtacgcctgcggcgagacccccgagcagatcagagcccccagcggcatcatcaccagccccggctggcccagcgagtaccccgccaagatcaactgcagctggttcatcagagccaaccccggcgagatcatcaccatcagcttccaggacttcgacatccagggcagcagaagatgcaacctggactggctgaccatcgagacctacaagaacatcgagagctacagagcctgcggcagcaccatcccccccccctacatcagcagccaggaccacatctggatcagattccacagcgacgacaacatcagcagaaagggcttcagactggcctacttcagcggcaagagcgaggagcccaactgcgcctgcgaccagttcagatgcggcaacggcaagtgcatccccgaggcctggaagtgcaacaacatggacgagtgcggcgacagcagcgacgaggagatctgcgccaaggaggccaacccccccaccgccgccgccttccagccctgcgcctacaaccagttccagtgcctgagcagattcaccaaggtgtacacctgcctgcccgagagcctgaagtgcgacggcaacatcgactgcctggacctgggcgacgagatcgactgcgacgtgcccacctgcggccagtggctgaagtacttctacggcaccttcaacagccccaactaccccgacttctacccccccggcagcaactgcacctggctgatcgacaccggcgaccacagaaaggtgatcctgagattcaccgacttcaagctggacggcaccggctacggcgactacgtgaagatctacgacggcctggaggagaacccccacaagctgctgagagtgctgaccgccttcgacagccacgcccccctgaccgtggtgagcagcagcggccagatcagagtgcacttctgcgccgacaaggtgaacgccgccagaggcttcaacgccacctaccaggtggacggcttctgcctgccctgggagatcccctgcggcggcaactggggctgctacaccgagcagcagagatgcgacggctactggcactgccccaacggcagagacgagaccaactgcaccatgtgccagaaggaggagttcccctgcagcagaaacggcgtgtgctaccccagaagcgacagatgcaactaccagaaccactgccccaacggcagcgacgagaagaactgcttcttctgccagcccggcaacttccactgcaagaacaacagatgcgtgttcgagagctgggtgtgcgacagccaggacgactgcggcgacggcagcgacgaggagaactgccccgtgatcgtgcccaccagagtgatcaccgccgccgtgatcggcagcctgatctgcggcctgctgctggtgatcgccctgggctgcacctgcaagctgtacagcctgagaatgttcgagagaagaagcttcgagacccagctgagcagagtggaggccgagctgctgagaagagaggccccccccagctacggccagctgatcgcccagggcctgatcccccccgtggaggacttccccgtgtgcagccccaaccaggccagcgtgctggagaacctgagactggccgtgagaagccagctgggcttcaccagcgtgagactgcccatggccggcagaagcagcaacatctggaacagaatcttcaacttcgccagaagcagacacagcggcagcctggccctggtgagcgccgacggcgacgaggtggtgcccagccagagcaccagcagagagcccgagagaaaccacacccacagaagcctgttcagcgtggagagcgacgacaccgacaccgagaacgagagaagagacatggccggcgccagcggcggcgtggccgcccccctgccccagaaggtgccccccaccaccgccgtggaggccaccgtgggcgcctgcgccagcagcagcacccagagcaccagaggcggccacgccgacaacggcagagacgtgaccagcgtggagccccccagcgtgagccccgccagacaccagctgaccagcgccctgagcagaatgacccagggcctgagatgggtgagattcaccctgggcagaagcagcagcctgagccagaaccagagccccctgagacagctggacaacggcgtgagcggcagagaggacgacgacgacgtggagatgctgatccccatcagcgacggcagcagcgacttcgacgtgaacgactgcagcagacccctgctggacctggccagcgaccagggccagggcctgagacagccctacaacgccaccaaccccggcgtgagacccagcaacagagacggcccctgcgagagatgcggcatcgtgcacaccgcccagatccccgacacctgcctggaggtgaccctgaagaacgagaccagcgacgacgaggccctgctgctgtgctag

SEQ ID NO: 19177 - DNA, 8592 bp, Artificial Sequence
  Description of Artificial Sequence: Synthetic coding sequence
atggccagcgaggacaacagagtgcccagccccccccccaccggcgacgacggcggcggcggcggcagagaggagacccccaccgagggcggcgccctgagcctgaagcccggcctgcccatcagaggcatcagaatgaagttcgccgtgctgaccggcctggtggaggtgggcgaggtgagcaacagagacatcgtggagaccgtgttcaacctgctggtgggcggccagttcgacctggagatgaacttcatcatccaggagggcgagagcatcaactgcatggtggacctgctggagaagtgcgacatcacctgccaggccgaggtgtggagcatgttcaccgccatcctgaagaagagcatcagaaacctgcaggtgtgcaccgaggtgggcctggtggagaaggtgctgggcaagatcgagaaggtggacaacatgatcgccgacctgctggtggacatgctgggcgtgctggccagctacaacctgaccgtgagagagctgaagctgttcttcagcaagctgcagggcgacaagggcagatggcccccccacgccggcaagctgctgagcgtgctgaagcacatgccccagaagtacggccccgacgccttcttcaacttccccggcaagagcgccgccgccatcgccctgccccccatcgccaagtggccctaccagaacggcttcaccttccacacctggctgagaatggaccccgtgaacaacatcaacgtggacaaggacaagccctacctgtactgcttcagaaccagcaagggcctgggctacagcgcccacttcgtgggcggctgcctgatcgtgaccagcatcaagagcaagggcaagggcttccagcactgcgtgaagttcgacttcaagccccagaagtggtacatggtgaccatcgtgcacatctacaacagatggaagaacagcgagctgagatgctacgtgaacggcgagctggccagctacggcgagatcacctggttcgtgaacaccagcgacaccttcgacaagtgcttcctgggcagcagcgagaccgccgacgccaacagagtgttctgcggccagatgaccgccgtgtacctgttcagcgaggccctgaacgccgcccagatcttcgccatctaccagctgggcctgggctacaagggcaccttcaagttcaaggccgagagcgacctgttcctggccgagcaccacaagctgctgctgtacgacggcaagctgagcagcgccatcgccttcacctacaaccccagagccaccgacgcccagctgtgcctggagagcagccccaaggacaaccccagcatcttcgtgcacagcccccacgccctgatgctgcaggacgtgaaggccgtgctgacccacagcatccagagcgccatgcacagcatcggcggcgtgcaggtgctgttccccctgttcgcccagctggactacagacagtacctgagcgacgagatcgacctgaccatctgcagcaccctgctggccttcatcatggagctgctgaagaacagcatcgccatgcaggagcagatgctggcctgcaagggcttcctggtgatcggctacagcctggagaagagcagcaagagccacgtgagcagagccgtgctggagctgtgcctggccttcagcaagtacctgagcaacctgcagaacggcatgcccctgctgaagcagctgtgcgaccacgtgctgctgaaccccgccatctggatccacacccccgccaaggtgcagctgatgctgtacacctacctgagcaccgagttcatcggcaccgtgaacatctacaacaccatcagaagagtgggcaccgtgctgctgatcatgcacaccctgaagtactactactgggccgtgaacccccaggacagaagcggcatcacccccaagggcctggacggccccagacccaaccagaaggagatgctgagcctgagagccttcctgctgatgttcatcaagcagctggtgatgaaggacagcggcgtgaaggaggacgagctgcaggccatcctgaactacctgctgaccatgcacgaggacgacaacctgatggacgtgctgcagctgctggtggccctgatgagcgagcaccccaacagcatgatccccgccttcgaccagagaaacggcctgagagtgatctacaagctgctggccagcaagagcgagggcatcagagtgcaggccctgaaggccatgggctacttcctgaagcacctggcccccaagagaaaggccgaggtgatgctgggccacggcctgttcagcctgctggccgagagactgatgctgcagaccaacctgatcaccatgaccacctacaacgtgctgttcgagatcctgatcgagcagatcggcacccaggtgatccacaagcagcaccccgaccccgacagcagcgtgaagatccagaacccccagatcctgaaggtgatcgccaccctgctgagaaacagcccccagtgccccgagagcatggaggtgagaagagccttcctgagcgacatgatcaagctgttcaacaacagcagagagaacagaagaagcctgctgcagtgcagcgtgtggcaggagtggatgctgagcctgtgctacttcaaccccaagaacagcgacgagcagaagatcaccgagatggtgtacgccatcttcagaatcctgctgtaccacgccgtgaagtacgagtggggcggctggagagtgtgggtggacaccctgagcatcacccacagcaaggtgaccttcgagatccacaaggagaacctggccaacatcttcagagagcagcagggcaaggtggacgaggagatcggcctgtgcagcagcaccagcgtgcaggccgccagcggcatcagaagagacatcaacgtgagcgtgggcagccagcagcccgacaccaaggacagccccgtgtgcccccacttcaccaccaacggcaacgagaacagcagcatcgagaagaccagcagcctggagagcgccagcaacatcgagctgcagaccaccaacaccagctacgaggagatgaaggccgagcaggagaaccaggagctgcccgacgagggcaccctggaggagaccctgaccaacgagaccagaaacgccgacgacctggaggtgagcagcgacatcatcgaggccgtggccatcagcagcaacagcttcatcaccaccggcaaggacagcatgaccgtgagcgaggtgaccgccagcatcagcagccccagcgaggaggacgccagcgagatgcccgagttcctggacaagagcatcgtggaggaggaggaggacgacgactacgtggagctgaaggtggagggcagccccaccgaggaggccaacctgcccaccgagctgcaggacaacagcctgagccccgccgccagcgaggccggcgagaagctggacatgttcggcaacgacgacaagctgatcttccaggagggcaagcccgtgaccgagaagcagaccgacaccgagacccaggacagcaaggacagcggcatccagaccatgaccgccagcggcagcagcgccatgagccccgagaccaccgtgagccagatcgccgtggagagcgacctgggccagatgctggaggagggcaagaaggccaccaacctgaccagagagaccaagctgatcaacgactgccacggcagcgtgagcgaggccagcagcgagcagaagatcgccaagctggacgtgagcaacgtggccaccgacaccgagagactggagctgaaggccagccccaacgtggaggccccccagccccacagacacgtgctggagatcagcagacagcacgagcagcccggccagggcatcgcccccgacgccgtgaacggccagagaagagacagcagaagcaccgtgttcagaatccccgagttcaactggagccagatgcaccagagactgctgaccgacctgctgttcagcatcgagaccgacatccagatgtggagaagccacagcaccaagaccgtgatggacttcgtgaacagcagcgacaacgtgatcttcgtgcacaacaccatccacctgatcagccaggtgatggacaacatggtgatggcctgcggcggcatcctgcccctgctgagcgccgccaccagcgccacccacgagctggagaacatcgagcccacccagggcctgagcatcgaggccagcgtgaccttcctgcagagactgatcagcctggtggacgtgctgatcttcgccagcagcctgggcttcaccgagatcgaggccgagaagagcatgagcagcggcggcatcctgagacagtgcctgagactggtgtgcgccgtggccgtgagaaactgcctggagtgccagcagcacagccagctgaagaccagaggcgacaaggccctgaagcccatgcacagcctgatccccctgggcaagagcgccgccaagagccccgtggacatcgtgaccggcggcatcagccccgtgagagacctggacagactgctgcaggacatggacatcaacagactgagagccgtggtgttcagagacatcgaggacagcaagcaggcccagttcctggccctggccgtggtgtacttcatcagcgtgctgatggtgagcaagtacagagacatcctggagccccagaacgagagacacagccagagctgcaccgagaccggcagcgagaacgagaacgtgagcctgagcgagatcacccccgccgccttcagcaccctgaccaccgccagcgtggaggagagcgagagcaccagcagcgccagaagaagagacagcggcatcggcgaggagaccgccaccggcctgggcagccacgtggaggtgaccccccacaccgccccccccggcgtgagcgccggccccgacgccatcagcgaggtgctgagcaccctgagcctggaggtgaacaagagccccgagaccaagaacgacagaggcaacgacctggacaccaaggccacccccagcgtgagcgtgagcaagaacgtgaacgtgaaggacatcctgagaagcctggtgaacatccccgccgacggcgtgaccgtggaccccgccctgctgccccccgcctgcctgggcgccctgggcgacctgagcgtggagcagcccgtgcagttcagaagcttcgacagaagcgtgatcgtggccgccaagaagagcgccgtgagccccagcaccttcaacaccagcatccccaccaacgccgtgagcgtggtgagcagcgtggacagcgcccaggccagcgacatgggcggcgagagccccggcagcagaagcagcaacgccaagctgcccagcgtgcccaccgtggacagcgtgagccaggaccccgtgagcaacatgagcatcaccgagagactggagcacgccctggagaaggccgcccccctgctgagagagatcttcgtggacttcgcccccttcctgagcagaaccctgctgggcagccacggccaggagctgctgatcgagggcaccagcctggtgtgcatgaagagcagcagcagcgtggtggagctggtgatgctgctgtgcagccaggagtggcagaacagcatccagaagaacgccggcctggccttcatcgagctggtgaacgagggcagactgctgagccagaccatgaaggaccacctggtgagagtggccaacgaggccgagttcatcctgagcagacagagagccgaggacatccacagacacgccgagttcgagagcctgtgcgcccagtacagcgccgacaagagagaggacgagaagatgtgcgaccacctgatcagagccgccaagtacagagaccacgtgaccgccacccagctgatccagaagatcatcaacatcctgaccgacaagcacggcgcctggggcaacagcgccgtgagcagacccctggagttctggagactggactactgggaggacgacctgagaagaagaagaagattcgtgagaaaccccctgggcagcacccaccccgaggccaccctgaagaccgccgtggagcacgtgtgcatcttcaagctgagagagaacagcaaggccaccgacgaggacatcctggccaagggcaagcagagcatcagaagccaggccctgggcaaccagaacagcgagaacgagatcctgctggagggcgacgacgacaccctgagcagcgtggacgagaaggacctggagaacctggccggccccgtgagcctgagcacccccgcccagctggtggcccccagcgtggtggtgaagggcaccctgagcgtgaccagcagcgagctgtacttcgaggtggacgaggaggaccccaacttcaagaagatcgaccccaagatcctggcctacaccgagggcctgcacggcaagtggctgttcaccgagatcagaagcatcttcagcagaagatacctgctgcagaacaccgccctggagatcttcatggccaacagagtggccgtgatgttcaacttccccgaccccgccaccgtgaagaaggtggtgaactacctgcccagagtgggcgtgggcaccagcttcggcctgccccagaccagaagaatcagcctggccagccccagacagctgttcaaggccagcaacatgacccagagatggcagcacagagagatcagcaacttcgagtacctgatgttcctgaacaccatcgccggcagaagctacaacgacctgaaccagtaccccgtgttcccctgggtgatcaccaactacgagagcgaggagctggacctgaccctgcccaccaacttcagagacctgagcaagcccatcggcgccctgaaccccaagagagccgccttcttcgccgagagatacgagagctgggaggacgaccaggtgcccaagttccactacggcacccactacagcaccgccagcttcgtgctggcctggctgctgagaatcgagcccttcaccacctacttcctgaacctgcagggcggcaagttcgaccacgccgacagaaccttcagcagcatcagcagagcctggagaaacagccagagagacaccagcgacatcaaggagctgatccccgagttctactacctgcccgagatgttcgtgaacttcaacaactacaacctgggcgtgatggacgacggcaccgtggtgagcgacgtggagctgcccccctgggccaagaccagcgaggagttcgtgcacatcaacagactggccctggagagcgagttcgtgagctgccagctgcaccagtggatcgacctgatcttcggctacaagcagcagggccccgaggccgtgagagccctgaacgtgttctactacctgacctacgagggcgccgtgaacctgaacagcatcaccgaccccgtgctgagagaggccgtggaggcccagatcagaagcttcggccagacccccagccagctgctgatcgagccccacccccccagaggcagcgccatgcaggtgagccccctgatgttcaccgacaaggcccagcaggacgtgatcatggtgctgaagttccccagcaacagccccgtgacccacgtggccgccaacacccagcccggcctggccacccccgccgtgatcaccgtgaccgccaacagactgttcgccgtgaacaagtggcacaacctgcccgcccaccagggcgccgtgcaggaccagccctaccagctgcccgtggagatcgaccccctgatcgccagcaacaccggcatgcacagaagacagatcaccgacctgctggaccagagcatccaggtgcacagccagtgcttcgtgatcaccagcgacaacagatacatcctggtgtgcggcttctgggacaagagcttcagagtgtacagcaccgacaccggcagactgatccaggtggtgttcggccactgggacgtggtgacctgcctggccagaagcgagagctacatcggcggcaactgctacatcctgagcggcagcagagacgccaccctgctgctgtggtactggaacggcaagtgcagcggcatcggcgacaaccccggcagcgagaccgccgcccccagagccatcctgaccggccacgactacgaggtgacctgcgccgccgtgtgcgccgagctgggcctggtgctgagcggcagccaggagggcccctgcctgatccacagcatgaacggcgacctgctgagaaccctggagggccccgagaactgcctgaagcccaagctgatccaggccagcagagagggccactgcgtgatcttctacgagaacggcctgttctgcaccttcagcgtgaacggcaagctgcaggccaccatggagaccgacgacaacatcagagccatccagctgagcagagacggccagtacctgctgaccggcggcgacagaggcgtggtggtggtgagacaggtgagcgacctgaagcagctgttcgcctaccccggctgcgacgccggcatcagagccatggccctgagctacgaccagagatgcatcatcagcggcatggccagcggcagcatcgtgctgttctacaacgacttcaacagatggcaccacgagtaccagaccagatactag

SEQ ID NO: 19178 - DNA, 8559 bp, Artificial Sequence
  Description of Artificial Sequence: Synthetic coding sequence
atggccagcgaggacaacagagtgcccagccccccccccaccggcgacgacggcggcggcggcggcagagaggagacccccaccgagggcggcgccctgagcctgaagcccggcctgcccatcagaggcatcagaatgaagttcgccgtgctgaccggcctggtggaggtgggcgaggtgagcaacagagacatcgtggagaccgtgttcaacctgctggtgggcggccagttcgacctggagatgaacttcatcatccaggagggcgagagcatcaactgcatggtggacctgctggagaagtgcgacatcacctgccaggccgaggtgtggagcatgttcaccgccatcctgaagaagagcatcagaaacctgcaggtgtgcaccgaggtgggcctggtggagaaggtgctgggcaagatcgagaaggtggacaacatgatcgccgacctgctggtggacatgctgggcgtgctggccagctacaacctgaccgtgagagagctgaagctgttcttcagcaagctgcagggcgacaagggcagatggcccccccacgccggcaagctgctgagcgtgctgaagcacatgccccagaagtacggccccgacgccttcttcaacttccccggcaagagcgccgccgccatcgccctgccccccatcgccaagtggccctaccagaacggcttcaccttccacacctggctgagaatggaccccgtgaacaacatcaacgtggacaaggacaagccctacctgtactgcttcagaaccagcaagggcctgggctacagcgcccacttcgtgggcggctgcctgatcgtgaccagcatcaagagcaagggcaagggcttccagcactgcgtgaagttcgacttcaagccccagaagtggtacatggtgaccatcgtgcacatctacaacagatggaagaacagcgagctgagatgctacgtgaacggcgagctggccagctacggcgagatcacctggttcgtgaacaccagcgacaccttcgacaagtgcttcctgggcagcagcgagaccgccgacgccaacagagtgttctgcggccagatgaccgccgtgtacctgttcagcgaggccctgaacgccgcccagatcttcgccatctaccagctgggcctgggctacaagggcaccttcaagttcaaggccgagagcgacctgttcctggccgagcaccacaagctgctgctgtacgacggcaagctgagcagcgccatcgccttcacctacaaccccagagccaccgacgcccagctgtgcctggagagcagccccaaggacaaccccagcatcttcgtgcacagcccccacgccctgatgctgcaggacgtgaaggccgtgctgacccacagcatccagagcgccatgcacagcatcggcggcgtgcaggtgctgttccccctgttcgcccagctggactacagacagtacctgagcgacgagatcgacctgaccatctgcagcaccctgctggccttcatcatggagctgctgaagaacagcatcgccatgcaggagcagatgctggcctgcaagggcttcctggtgatcggctacagcctggagaagagcagcaagagccacgtgagcagagccgtgctggagctgtgcctggccttcagcaagtacctgagcaacctgcagaacggcatgcccctgctgaagcagctgtgcgaccacgtgctgctgaaccccgccatctggatccacacccccgccaaggtgcagctgatgctgtacacctacctgagcaccgagttcatcggcaccgtgaacatctacaacaccatcagaagagtgggcaccgtgctgctgatcatgcacaccctgaagtactactactgggccgtgaacccccaggacagaagcggcatcacccccaagggcctggacggccccagacccaaccagaaggagatgctgagcctgagagccttcctgctgatgttcatcaagcagctggtgatgaaggacagcggcgtgaaggaggacgagctgcaggccatcctgaactacctgctgaccatgcacgaggacgacaacctgatggacgtgctgcagctgctggtggccctgatgagcgagcaccccaacagcatgatccccgccttcgaccagagaaacggcctgagagtgatctacaagctgctggccagcaagagcgagggcatcagagtgcaggccctgaaggccatgggctacttcctgaagcacctggcccccaagagaaaggccgaggtgatgctgggccacggcctgttcagcctgctggccgagagactgatgctgcagaccaacctgatcaccatgaccacctacaacgtgctgttcgagatcctgatcgagcagatcggcacccaggtgatccacaagcagcaccccgaccccgacagcagcgtgaagatccagaacccccagatcctgaaggtgatcgccaccctgctgagaaacagcccccagtgccccgagagcatggaggtgagaagagccttcctgagcgacatgatcaagctgttcaacaacagcagagagaacagaagaagcctgctgcagtgcagcgtgtggcaggagtggatgctgagcctgtgctacttcaaccccaagaacagcgacgagcagaagatcaccgagatggtgtacgccatcttcagaatcctgctgtaccacgccgtgaagtacgagtggggcggctggagagtgtgggtggacaccctgagcatcacccacagcaaggtgaccttcgagatccacaaggagaacctggccaacatcttcagagagcagcagggcaaggtggacgaggagatcggcctgtgcagcagcaccagcgtgcaggccgccagcggcatcagaagagacatcaacgtgagcgtgggcagccagcagcccgacaccaaggacagccccgtgtgcccccacttcaccaccaacggcaacgagaacagcagcatcgagaagaccagcagcctggagagcgccagcaacatcgagctgcagaccaccaacaccagctacgaggagatgaaggccgagcaggagaaccaggagctgcccgacgagggcaccctggaggagaccctgaccaacgagaccagaaacgccgacgacctggaggtgagcagcgacatcatcgaggccgtggccatcagcagcaacagcttcatcaccaccggcaaggacagcatgaccgtgagcgaggtgaccgccagcatcagcagccccagcgaggaggacgccagcgagatgcccgagttcctggacaagagcatcgtggaggaggaggaggacgacgactacgtggagctgaaggtggagggcagccccaccgaggaggccaacctgcccaccgagctgcaggacaacagcctgagccccgccgccagcgaggccggcgagaagctggacatgttcggcaacgacgacaagctgatcttccaggagggcaagcccgtgaccgagaagcagaccgacaccgagacccaggacagcaaggacagcggcatccagaccatgaccgccagcggcagcagcgccatgagccccgagaccaccgtgagccagatcgccgtggagagcgacctgggccagatgctggaggagggcaagaaggccaccaacctgaccagagagaccaagctgatcaacgactgccacggcagcgtgagcgaggccagcagcgagcagaagatcgccaagctggacgtgagcaacgtggccaccgacaccgagagactggagctgaaggccagccccaacgtggaggccccccagccccacagacacgtgctggagatcagcagacagcacgagcagcccggccagggcatcgcccccgacgccgtgaacggccagagaagagacagcagaagcaccgtgttcagaatccccgagttcaactggagccagatgcaccagagactgctgaccgacctgctgttcagcatcgagaccgacatccagatgtggagaagccacagcaccaagaccgtgatggacttcgtgaacagcagcgacaacgtgatcttcgtgcacaacaccatccacctgatcagccaggtgatggacaacatggtgatggcctgcggcggcatcctgcccctgctgagcgccgccaccagcgccacccacgagctggagaacatcgagcccacccagggcctgagcatcgaggccagcgtgaccttcctgcagagactgatcagcctggtggacgtgctgatcttcgccagcagcctgggcttcaccgagatcgaggccgagaagagcatgagcagcggcggcatcctgagacagtgcctgagactggtgtgcgccgtggccgtgagaaactgcctggagtgccagcagcacagccagctgaagaccagaggcgacaaggccctgaagcccatgcacagcctgatccccctgggcaagagcgccgccaagagccccgtggacatcgtgaccggcggcatcagccccgtgagagacctggacagactgctgcaggacatggacatcaacagactgagagccgtggtgttcagagacatcgaggacagcaagcaggcccagttcctggccctggccgtggtgtacttcatcagcgtgctgatggtgagcaagtacagagacatcctggagccccagaacgagagacacagccagagctgcaccgagaccggcagcgagaacgagaacgtgagcctgagcgagatcacccccgccgccttcagcaccctgaccaccgccagcgtggaggagagcgagagcaccagcagcgccagaagaagagacagcggcatcggcgaggagaccgccaccggcctgggcagccacgtggaggtgaccccccacaccgccccccccggcgtgagcgccggccccgacgccatcagcgaggtgctgagcaccctgagcctggaggtgaacaagagccccgagaccaagaacgacagaggcaacgacctggacaccaaggccacccccagcgtgagcgtgagcaagaacgtgaacgtgaaggacatcctgagaagcctggtgaacatccccgccgacggcgtgaccgtggaccccgccctgctgccccccgcctgcctgggcgccctgggcgacctgagcgtggagcagcccgtgcagttcagaagcttcgacagaagcgtgatcgtggccgccaagaagagcgccgtgagccccagcaccttcaacaccagcatccccaccaacgccgtgagcgtggtgagcagcgtggacagcgcccaggccagcgacatgggcggcgagagccccggcagcagaagcagcaacgccaagctgcccagcgtgcccaccgtggacagcgtgagccaggaccccgtgagcaacatgagcatcaccgagagactggagcacgccctggagaaggccgcccccctgctgagagagatcttcgtggacttcgcccccttcctgagcagaaccctgctgggcagccacggccaggagctgctgatcgagggcaccagcctggtgtgcatgaagagcagcagcagcgtggtggagctggtgatgctgctgtgcagccaggagtggcagaacagcatccagaagaacgccggcctggccttcatcgagctggtgaacgagggcagactgctgagccagaccatgaaggaccacctggtgagagtggccaacgaggccgagttcatcctgagcagacagagagccgaggacatccacagacacgccgagttcgagagcctgtgcgcccagtacagcgccgacaagagagaggacgagaagatgtgcgaccacctgatcagagccgccaagtacagagaccacgtgaccgccacccagctgatccagaagatcatcaacatcctgaccgacaagcacggcgcctggggcaacagcgccgtgagcagacccctggagttctggagactggactactgggaggacgacctgagaagaagaagaagattcgtgagaaaccccctgggcagcacccaccccgaggccaccctgaagaccgccgtggagcacgccaccgacgaggacatcctggccaagggcaagcagagcatcagaagccaggccctgggcaaccagaacagcgagaacgagatcctgctggagggcgacgacgacaccctgagcagcgtggacgagaaggacctggagaacctggccggccccgtgagcctgagcacccccgcccagctggtggcccccagcgtggtggtgaagggcaccctgagcgtgaccagcagcgagctgtacttcgaggtggacgaggaggaccccaacttcaagaagatcgaccccaagatcctggcctacaccgagggcctgcacggcaagtggctgttcaccgagatcagaagcatcttcagcagaagatacctgctgcagaacaccgccctggagatcttcatggccaacagagtggccgtgatgttcaacttccccgaccccgccaccgtgaagaaggtggtgaactacctgcccagagtgggcgtgggcaccagcttcggcctgccccagaccagaagaatcagcctggccagccccagacagctgttcaaggccagcaacatgacccagagatggcagcacagagagatcagcaacttcgagtacctgatgttcctgaacaccatcgccggcagaagctacaacgacctgaaccagtaccccgtgttcccctgggtgatcaccaactacgagagcgaggagctggacctgaccctgcccaccaacttcagagacctgagcaagcccatcggcgccctgaaccccaagagagccgccttcttcgccgagagatacgagagctgggaggacgaccaggtgcccaagttccactacggcacccactacagcaccgccagcttcgtgctggcctggctgctgagaatcgagcccttcaccacctacttcctgaacctgcagggcggcaagttcgaccacgccgacagaaccttcagcagcatcagcagagcctggagaaacagccagagagacaccagcgacatcaaggagctgatccccgagttctactacctgcccgagatgttcgtgaacttcaacaactacaacctgggcgtgatggacgacggcaccgtggtgagcgacgtggagctgcccccctgggccaagaccagcgaggagttcgtgcacatcaacagactggccctggagagcgagttcgtgagctgccagctgcaccagtggatcgacctgatcttcggctacaagcagcagggccccgaggccgtgagagccctgaacgtgttctactacctgacctacgagggcgccgtgaacctgaacagcatcaccgaccccgtgctgagagaggccgtggaggcccagatcagaagcttcggccagacccccagccagctgctgatcgagccccacccccccagaggcagcgccatgcaggtgagccccctgatgttcaccgacaaggcccagcaggacgtgatcatggtgctgaagttccccagcaacagccccgtgacccacgtggccgccaacacccagcccggcctggccacccccgccgtgatcaccgtgaccgccaacagactgttcgccgtgaacaagtggcacaacctgcccgcccaccagggcgccgtgcaggaccagccctaccagctgcccgtggagatcgaccccctgatcgccagcaacaccggcatgcacagaagacagatcaccgacctgctggaccagagcatccaggtgcacagccagtgcttcgtgatcaccagcgacaacagatacatcctggtgtgcggcttctgggacaagagcttcagagtgtacagcaccgacaccggcagactgatccaggtggtgttcggccactgggacgtggtgacctgcctggccagaagcgagagctacatcggcggcaactgctacatcctgagcggcagcagagacgccaccctgctgctgtggtactggaacggcaagtgcagcggcatcggcgacaaccccggcagcgagaccgccgcccccagagccatcctgaccggccacgactacgaggtgacctgcgccgccgtgtgcgccgagctgggcctggtgctgagcggcagccaggagggcccctgcctgatccacagcatgaacggcgacctgctgagaaccctggagggccccgagaactgcctgaagcccaagctgatccaggccagcagagagggccactgcgtgatcttctacgagaacggcctgttctgcaccttcagcgtgaacggcaagctgcaggccaccatggagaccgacgacaacatcagagccatccagctgagcagagacggccagtacctgctgaccggcggcgacagaggcgtggtggtggtgagacaggtgagcgacctgaagcagctgttcgcctaccccggctgcgacgccggcatcagagccatggccctgagctacgaccagagatgcatcatcagcggcatggccagcggcagcatcgtgctgttctacaacgacttcaacagatggcaccacgagtaccagaccagatactag

SEQ ID NO: 19179 - DNA, 717 bp, Artificial Sequence
  Description of Artificial Sequence: Synthetic coding sequence
atgctgggcagcccctgcctgctgtggctgctggccgtgaccttcctggtgcccagagcccagcccctggccccccaggacttcgaggaggaggaggccgacgagaccgagaccgcctggccccccctgcccgccgtgccctgcgactacgaccactgcagacacctgcaggtgccctgcaaggagctgcagagagtgggccccgccgcctgcctgtgccccggcctgagcagccccgcccagccccccgacccccccagaatgggcgaggtgagaatcgccgccgaggagggcagagccgtggtgcactggtgcgcccccttcagccccgtgctgcactactggctgctgctgtgggacggcagcgaggccgcccagaagggcccccccctgaacgccaccgtgagaagagccgagctgaagggcctgaagcccggcggcatctacgtggtgtgcgtggtggccgccaacgaggccggcgccagcagagtgccccaggccggcggcgagggcctggagggcgccgacatccccgccttcggcccctgcagcagactggccgtgccccccaaccccagaaccctggtgcacgccgccgtgggcgtgggcaccgccctggccctgctgagctgcgccgccctggtgtggcacttctgcctgagagacagatggggctgccccagaagagccgccgccagagccgccggcgccctgtag

SEQ ID NO: 19180 - DNA, 270 bp, Artificial Sequence
  Description of Artificial Sequence: Synthetic coding sequence
atgtgccagaaggaggtgatggagcagagcgccggcatcatgtacagaaagagctgcgccagcagcgccgcctgcctgatcgccagcgccggctaccagagcttctgcagccccggcaagctgaacagcgtgtgcatcagctgctgcaacacccccctgtgcaacggccccagacccaagaagagaggcagcagcgccagcgccctgagacccggcctgagaaccaccatcctgttcctgaagctggccctgttcagcgcccactgctag

SEQ ID NO: 19181 - DNA, 426 bp, Artificial Sequence
  Description of Artificial Sequence: Synthetic coding sequence
atgtgggtgctgggcatcgccgccaccttctgcggcctgttcctgctgcccggcttcgccctgcagatccagtgctaccagtgcgaggagttccagctgaacaacgactgcagcagccccgagttcatcgtgaactgcaccgtgaacgtgcaggacatgtgccagaaggaggtgatggagcagagcgccggcatcatgtacagaaagagctgcgccagcagcgccgcctgcctgatcgccagcgccggctaccagagcttctgcagccccggcaagctgaacagcgtgtgcatcagctgctgcaacacccccctgtgcaacggccccagacccaagaagagaggcagcagcgccagcgccctgagacccggcctgagaaccaccatcctgttcctgaagctggccctgttcagcgcccactgctag

SEQ ID NO: 19182 - DNA, 495 bp, Artificial Sequence
  Description of Artificial Sequence: Synthetic coding sequence
atgcaggcccccagagccgcccccgccgcccccctgagctacgacagaagacccagagacagcggcagaatgtgggtgctgggcatcgccgccaccttctgcggcctgttcctgctgcccggcttcgccctgcagatccagtgctaccagtgcgaggagttccagctgaacaacgactgcagcagccccgagttcatcgtgaactgcaccgtgaacgtgcaggacatgtgccagaaggaggtgatggagcagagcgccggcatcatgtacagaaagagctgcgccagcagcgccgcctgcctgatcgccagcgccggctaccagagcttctgcagccccggcaagctgaacagcgtgtgcatcagctgctgcaacacccccctgtgcaacggccccagacccaagaagagaggcagcagcgccagcgccctgagacccggcctgagaaccaccatcctgttcctgaagctggccctgttcagcgcccactgctag

SEQ ID NO: 19183 - DNA, 378 bp, Artificial Sequence
  Description of Artificial Sequence: Synthetic coding sequence
atgagaggcaccagactggccctgctggccctggtgctggccgcctgcggcgagctggcccccgccctgagatgctacgtgtgccccgagcccaccggcgtgagcgactgcgtgaccatcgccacctgcaccaccaacgagaccatgtgcaagaccaccctgtacagcagagagatcgtgtaccccttccagggcgacagcaccgtgaccaagagctgcgccagcaagtgcaagcccagcgacgtggacggcatcggccagaccctgcccgtgagctgctgcaacaccgagctgtgcaacgtggacggcgcccccgccctgaacagcctgcactgcggcgccctgaccctgctgcccctgctgagcctgagactgtag

SEQ ID NO: 19184 - DNA, 741 bp, Artificial Sequence
  Description of Artificial Sequence: Synthetic coding sequence
atgggcccccagcacctgagactggtgcagctgttctgcctgctgggcgccatcagcaccctgcccagagccggcgccctgctgtgctacgaggccaccgccagcagattcagagccgtggccttccacaactggaagtggctgctgatgagaaacatggtgtgcaagctgcaggagggctgcgaggagaccctggtgttcatcgagaccggcaccgccagaggcgtggtgggcttcaagggctgcagcagcagcagcagctaccccgcccagatcagctacctggtgagcccccccggcgtgagcatcgccagctacagcagagtgtgcagaagctacctgtgcaacaacctgaccaacctggagcccttcgtgaagctgaaggccagcacccccaagagcatcaccagcgccagctgcagctgccccacctgcgtgggcgagcacatgaaggactgcctgcccaacttcgtgaccaccaacagctgccccctggccgccagcacctgctacagcagcaccctgaagttccaggccggcttcctgaacaccaccttcctgctgatgggctgcgccagagagcacaaccagctgctggccgacttccaccacatcggcagcatcaaggtgaccgaggtgctgaacatcctggagaagagccagatcgtgggcgccgccagcagcagacaggaccccgcctggggcgtggtgctgggcctgctgttcgccttcagagactag

SEQ ID NO: 19185 - DNA, 636 bp, Artificial Sequence
  Description of Artificial Sequence: Synthetic coding sequence
atgggcccccagcacctgagactggtgcagctgttctgcctgctgggcgccatcagcaccctgcccagaatgagctgcggcgccggctgctacaagacccagaagggcaccgccagaggcgtggtgggcttcaagggctgcagcagcagcagcagctaccccgcccagatcagctacctggtgagcccccccggcgtgagcatcgccagctacagcagagtgtgcagaagctacctgtgcaacaacctgaccaacctggagcccttcgtgaagctgaaggccagcacccccaagagcatcaccagcgccagctgcagctgccccacctgcgtgggcgagcacatgaaggactgcctgcccaacttcgtgaccaccaacagctgccccctggccgccagcacctgctacagcagcaccctgaagttccaggccggcttcctgaacaccaccttcctgctgatgggctgcgccagagagcacaaccagctgctggccgacttccaccacatcggcagcatcaaggtgaccgaggtgctgaacatcctggagaagagccagatcgtgggcgccgccagcagcagacaggaccccgcctggggcgtggtgctgggcctgctgttcgccttcagagactag

SEQ ID NO: 19186 - DNA, 756 bp, Artificial Sequence
  Description of Artificial Sequence: Synthetic coding sequence
atggccatgggcgtgcccagagtgatcctgctgtgcctgttcggcgccgccctgtgcctgaccggcagccaggccctgcagtgctacagcttcgagcacacctacttcggccccttcgacctgagagccatgaagctgcccagcatcagctgcccccacgagtgcttcgaggccatcctgagcctggacaccggctacagagcccccgtgaccctggtgagaaagggctgctggaccggcccccccgccggccagacccagagcaacgccgacgccctgccccccgactacagcgtggtgagaggctgcaccaccgacaagtgcaacgcccacctgatgacccacgacgccctgcccaacctgagccaggcccccgacccccccaccctgagcggcgccgagtgctacgcctgcatcggcgtgcaccaggacgactgcgccatcggcagaagcagaagagtgcagtgccaccaggaccagaccgcctgcttccagggcaacggcagaatgaccgtgggcaacttcagcgtgcccgtgtacatcagaacctgccacagacccagctgcaccaccgagggcaccaccagcccctggaccgccatcgacctgcagggcagctgctgcgagggctacctgtgcaacagaaagagcatgacccagcccttcaccagcgccagcgccaccaccccccccagagccctgcaggtgctggccctgctgctgcccgtgctgctgctggtgggcctgagcgcctag

SEQ ID NO: 19187 - DNA, 627 bp, Artificial Sequence
  Description of Artificial Sequence: Synthetic coding sequence
atgaagctgcccagcatcagctgcccccacgagtgcttcgaggccatcctgagcctggacaccggctacagagcccccgtgaccctggtgagaaagggctgctggaccggcccccccgccggccagacccagagcaacgccgacgccctgccccccgactacagcgtggtgagaggctgcaccaccgacaagtgcaacgcccacctgatgacccacgacgccctgcccaacctgagccaggcccccgacccccccaccctgagcggcgccgagtgctacgcctgcatcggcgtgcaccaggacgactgcgccatcggcagaagcagaagagtgcagtgccaccaggaccagaccgcctgcttccagggcaacggcagaatgaccgtgggcaacttcagcgtgcccgtgtacatcagaacctgccacagacccagctgcaccaccgagggcaccaccagcccctggaccgccatcgacctgcagggcagctgctgcgagggctacctgtgcaacagaaagagcatgacccagcccttcaccagcgccagcgccaccaccccccccagagccctgcaggtgctggccctgctgctgcccgtgctgctgctggtgggcctgagcgcctag

SEQ ID NO: 19188 - DNA, 624 bp, Artificial Sequence
  Description of Artificial Sequence: Synthetic coding sequence
atgagactgatcaccctgagcgccaacctgttcaccgtgcccgagagaagcctgaccaccaccttcagcttcagcagatacaagagcagcgacagacccgcccacaaggtgagcatgctgctgctgtgccacgccctggccatcgccgtggtgcagatcgtgatcttcagcgagagctgggccttcgccaagaacatcaacttctacaacgtgagaccccccctggaccccacccccttccccaacagcttcaagtgcttcacctgcgagaacgccggcgacaactacaactgcaacagatgggccgaggacaagtggtgcccccagaacacccagtactgcctgaccgtgcaccacttcaccagccacggcagaagcaccagcatcaccaagaagtgcgccagcagaagcgagtgccacttcgtgggctgccaccacagcagagacagcgagcacaccgagtgcagaagctgctgcgagggcatgatctgcaacgtggagctgcccaccaaccacaccaacgccgtgttcgccgtgatgcacgcccagagaaccagcggcagcagcgcccccaccctgtacctgcccgtgctggcctgggtgttcgtgctgcccctgctgtag

SEQ ID NO: 19189 - DNA, 552 bp, Artificial Sequence
  Description of Artificial Sequence: Synthetic coding sequence
atgctgtacaagagcagcgacagacccgcccacaaggtgagcatgctgctgctgtgccacgccctggccatcgccgtggtgcagatcgtgatcttcagcgagagctgggccttcgccaagaacatcaacttctacaacgtgagaccccccctggaccccacccccttccccaacagcttcaagtgcttcacctgcgagaacgccggcgacaactacaactgcaacagatgggccgaggacaagtggtgcccccagaacacccagtactgcctgaccgtgcaccacttcaccagccacggcagaagcaccagcatcaccaagaagtgcgccagcagaagcgagtgccacttcgtgggctgccaccacagcagagacagcgagcacaccgagtgcagaagctgctgcgagggcatgatctgcaacgtggagctgcccaccaaccacaccaacgccgtgttcgccgtgatgcacgcccagagaaccagcggcagcagcgcccccaccctgtacctgcccgtgctggcctgggtgttcgtgctgcccctgctgtag

SEQ ID NO: 19190 - DNA, 624 bp, Artificial Sequence
  Description of Artificial Sequence: Synthetic coding sequence
atgctgctgatcaccctgagcgccaacctgttcaccgtgcccgagagaagcctgaccaccaccttcagcttcagcagatacaagagcagcgacagacccgcccacaaggtgagcatgctgctgctgtgccacgccctggccatcgccgtggtgcagatcgtgatcttcagcgagagctgggccttcgccaagaacatcaacttctacaacgtgagaccccccctggaccccacccccttccccaacagcttcaagtgcttcacctgcgagaacgccggcgacaactacaactgcaacagatgggccgaggacaagtggtgcccccagaacacccagtactgcctgaccgtgcaccacttcaccagccacggcagaagcaccagcatcaccaagaagtgcgccagcagaagcgagtgccacttcgtgggctgccaccacagcagagacagcgagcacaccgagtgcagaagctgctgcgagggcatgatctgcaacgtggagctgcccaccaaccacaccaacgccgtgttcgccgtgatgcacgcccagagaaccagcggcagcagcgcccccaccctgtacctgcccgtgctggcctgggtgttcgtgctgcccctgctgtag

SEQ ID NO: 19191 - DNA, 552 bp, Artificial Sequence; identical to SEQ ID NO: 19189
  Description of Artificial Sequence: Synthetic coding sequence

SEQ ID NO: 19192 - DNA, 378 bp, Artificial Sequence
  Description of Artificial Sequence: Synthetic coding sequence
atgaaggccctgatgctgctgaccctgagcgtgctgctgtgctgggtgagcgccgacatcagatgccacagctgctacaaggtgcccgtgctgggctgcgtggacagacagagctgcagactggagcccggccagcagtgcctgaccacccacgcctacctgggcaagatgtgggtgttcagcaacctgagatgcggcacccccgaggagccctgccaggaggccttcaaccagaccaacagaaagctgggcctgacctacaacaccacctgctgcaacaaggacaactgcaacagcgccggccccagacccacccccgccctgggcctggtgttcctgaccagcctggccggcctgggcctgtggctgctgcactag

SEQ ID NO: 19193 - DNA, 378 bp, Artificial Sequence; identical to SEQ ID NO: 19192
  Description of Artificial Sequence: Synthetic coding sequence

SEQ ID NO: 19194 - DNA, 378 bp, Artificial Sequence; identical to SEQ ID NO: 19192
  Description of Artificial Sequence: Synthetic coding sequence

SEQ ID NO: 19195 - DNA, 378 bp, Artificial Sequence; identical to SEQ ID NO: 19192
  Description of Artificial Sequence: Synthetic coding sequence

SEQ ID NO: 19196 - DNA, 378 bp, Artificial Sequence; identical to SEQ ID NO: 19192
  Description of Artificial Sequence: Synthetic coding sequence

SEQ ID NO: 19197 - DNA, 378 bp, Artificial Sequence; identical to SEQ ID NO: 19192
  Description of Artificial Sequence: Synthetic coding sequence

SEQ ID NO: 19198 - DNA, 378 bp, Artificial Sequence; identical to SEQ ID NO: 19192
  Description of Artificial Sequence: Synthetic coding sequence

SEQ ID NO: 19199 - DNA, 210 bp, Artificial Sequence
  Description of Artificial Sequence: Synthetic coding sequence
atgtgggtgttcagcaacctgagatgcggcacccccgaggagccctgccaggaggccttcaaccagaccaacagaaagctgggcctgacctacaacaccacctgctgcaacaaggacaactgcaacagcgccggccccagacccacccccgccctgggcctggtgttcctgaccagcctggccggcctgggcctgtggctgctgcactag

SEQ ID NO: 19200 - DNA, 210 bp, Artificial Sequence; identical to SEQ ID NO: 19199
  Description of Artificial Sequence: Synthetic coding sequence

SEQ ID NO: 19201 - DNA, 894 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcgccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagagacgccagcatcccccagttcaagcccgagatccaggtgtacgagaacatccacctggccagactgggcccccccgcccacaagcccagatag

SEQ ID NO: 19202 - DNA, 894 bp, Artificial Sequence; identical to SEQ ID NO: 19201
  Description of Artificial Sequence: Synthetic coding sequence

SEQ ID NO: 19203 - DNA, 894 bp, Artificial Sequence; identical to SEQ ID NO: 19201
  Description of Artificial Sequence: Synthetic coding sequence

SEQ ID NO: 19204 - DNA, 894 bp, Artificial Sequence; identical to SEQ ID NO: 19201
  Description of Artificial Sequence: Synthetic coding sequence

SEQ ID NO: 19205 - DNA, 894 bp, Artificial Sequence; identical to SEQ ID NO: 19201
  Description of Artificial Sequence: Synthetic coding sequence

SEQ ID NO: 19206 - DNA, 1149 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcgccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagaggcaacagaatgagatgctacaactgcggcggcagccccagcagcagctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 19207 - DNA, 1149 bp, Artificial Sequence; identical to SEQ ID NO: 19206
  Description of Artificial Sequence: Synthetic coding sequence

SEQ ID NO: 19208 - DNA, 1149 bp, Artificial Sequence; identical to SEQ ID NO: 19206
  Description of Artificial Sequence: Synthetic coding sequence

SEQ ID NO: 19209 - DNA, 5169 bp, Artificial Sequence
  Description of Artificial Sequence: Synthetic coding sequence
atgagaaccggctgggccacccccagaagacccgccggcctgctgatgctgctgttctggttcttcgacctggccgagcccagcggcagagccgccaacgaccccttcaccatcgtgcacggcaacaccggcaagtgcatcaagcccgtgtacggctggatcgtggccgacgactgcgacgagaccgaggacaagctgtggaagtgggtgagccagcacagactgttccacctgcacagccagaagtgcctgggcctggacatcaccaagagcgtgaacgagctgagaatgttcagctgcgacagcagcgccatgctgtggtggaagtgcgagcaccacagcctgtacggcgccgccagatacagactggccctgaaggacggccacggcaccgccatcagcaacgccagcgacgtgtggaagaagggcggcagcgaggagagcctgtgcgaccagccctaccacgagatctacaccagagacggcaacagctacggcagaccctgcgagttccccttcctgatcgacggcacctggcaccacgactgcatcctggacgaggaccacagcggcccctggtgcgccaccaccctgaactacgagtacgacagaaagtggggcatctgcctgaagcccgagaacggctgcgaggacaactgggagaagaacgagcagttcggcagctgctaccagttcaacacccagaccgccctgagctggaaggaggcctacgtgagctgccagaaccagggcgccgacctgctgagcatcaacagcgccgccgagctgacctacctgaaggagaaggagggcatcgccaagatcttctggatcggcctgaaccagctgtacagcgccagaggctgggagtggagcgaccacaagcccctgaacttcctgaactgggaccccgacagacccagcgcccccaccatcggcggcagcagctgcgccagaatggacgccgagagcggcctgtggcagagcttcagctgcgaggcccagctgccctacgtgtgcagaaagcccctgaacaacaccgtggagctgaccgacgtgtggacctacagcgacaccagatgcgacgccggctggctgcccaacaacggcttctgctacctgctggtgaacgagagcaacagctgggacaaggcccacgccaagtgcaaggccttcagcagcgacctgatcagcatccacagcctggccgacgtggaggtggtggtgaccaagctgcacaacgaggacatcaaggaggaggtgtggatcggcctgaagaacatcaacatccccaccctgttccagtggagcgacggcaccgaggtgaccctgacctactgggacgagaacgagcccaacgtgccctacaacaagacccccaactgcgtgagctacctgggcgagctgggccagtggaaggtgcagagctgcgaggagaagctgaagtacgtgtgcaagagaaagggcgagaagctgaacgacgccagcagcgacaagatgtgcccccccgacgagggctggaagagacacggcgagacctgctacaagatctacgaggacgaggtgcccttcggcaccaactgcaacctgaccatcaccagcagattcgagcaggagtacctgaacgacctgatgaagaagtacgacaagagcctgagaaagtacttctggaccggcctgagagacgtggacagctgcggcgagtacaactgggccaccgtgggcggcagaagaagagccgtgaccttcagcaactggaacttcctggagcccgccagccccggcggctgcgtggccatgagcaccggcaagagcgtgggcaagtgggaggtgaaggactgcagaagcttcaaggccctgagcatctgcaagaagatgagcggccccctgggccccgaggaggccagccccaagcccgacgacccctgccccgagggctggcagagcttccccgccagcctgagctgctacaaggtgttccacgccgagagaatcgtgagaaagagaaactgggaggaggccgagagattctgccaggccctgggcgcccacctgagcagcttcagccacgtggacgagatcaaggagttcctgcacttcctgaccgaccagttcagcggccagcactggctgtggatcggcctgaacaagagaagccccgacctgcagggcagctggcagtggagcgacagaacccccgtgagcaccatcatcatgcccaacgagttccagcaggactacgacatcagagactgcgccgccgtgaaggtgttccacagaccctggagaagaggctggcacttctacgacgacagagagttcatctacctgagacccttcgcctgcgacaccaagctggagtgggtgtgccagatccccaagggcagaacccccaagacccccgactggtacaaccccgacagagccggcatccacggcccccccctgatcatcgagggcagcgagtactggttcgtggccgacctgcacctgaactacgaggaggccgtgctgtactgcgccagcaaccacagcttcctggccaccatcaccagcttcgtgggcctgaaggccatcaagaacaagatcgccaacatcagcggcgacggccagaagtggtggatcagaatcagcgagtggcccatcgacgaccacttcacctacagcagatacccctggcacagattccccgtgaccttcggcgaggagtgcctgtacatgagcgccaagacctggctgatcgacctgggcaagcccaccgactgcagcaccaagctgcccttcatctgcgagaagtacaacgtgagcagcctggagaagtacagccccgacagcgccgccaaggtgcagtgcagcgagcagtggatccccttccagaacaagtgcttcctgaagatcaagcccgtgagcctgaccttcagccaggccagcgacacctgccacagctacggcggcaccctgcccagcgtgctgagccagatcgagcaggacttcatcaccagcctgctgcccgacatggaggccaccctgtggatcggcctgagatggaccgcctacgagaagatcaacaagtggaccgacaacagagagctgacctacagcaacttccaccccctgctggtgagcggcagactgagaatccccgagaacttcttcgaggaggagagcagataccactgcgccctgatcctgaacctgcagaagagccccttcaccggcacctggaacttcaccagctgcagcgagagacacttcgtgagcctgtgccagaagtacagcgaggtgaagagcagacagaccctgcagaacgccagcgagaccgtgaagtacctgaacaacctgtacaagatcatccccaagaccctgacctggcacagcgccaagagagagtgcctgaagagcaacatgcagctggtgagcatcaccgacccctaccagcaggccttcctgagcgtgcaggccctgctgcacaacagcagcctgtggatcggcctgttcagccaggacgacgagctgaacttcggctggagcgacggcaagagactgcacttcagcagatgggccgagaccaacggccagctggaggactgcgtggtgctggacaccgacggcttctggaagaccgtggactgcaacgacaaccagcccggcgccatctgctactacagcggcaacgagaccgagaaggaggtgaagcccgtggacagcgtgaagtgccccagccccgtgctgaacaccccctggatccccttccagaactgctgctacaacttcatcatcaccaagaacagacacatggccaccacccaggacgaggtgcacaccaagtgccagaagctgaaccccaagagccacatcctgagcatcagagacgagaaggagaacaacttcgtgctggagcagctgctgtacttcaactacatggccagctgggtgatgctgggcatcacctacagaaacaagagcctgatgtggttcgacaagacccccctgagctacacccactggagagccggcagacccaccatcaagaacgagaagttcctggccggcctgagcaccgacggcttctgggacatccagaccttcaaggtgatcgaggaggccgtgtacttccaccagcacagcatcctggcctgcaagatcgagatggtggactacaaggaggagtacaacaccaccctgccccagttcatgccctacgaggacggcatctacagcgtgatccagaagaaggtgacctggtacgaggccctgaacatgtgcagccagagcggcggccacctggccagcgtgcacaaccagaacggccagctgttcctggaggacatcgtgaagagagacggcttccccctgtgggtgggcctgagcagccacgacggcagcgagagcagcttcgagtggagcgacggcagcaccttcgactacatcccctggaagggccagaccagccccggcaactgcgtgctgctggaccccaagggcacctggaagcacgagaagtgcaacagcgtgaaggacggcgccatctgctacaagcccaccaagagcaagaagctgagcagactgacctacagcagcagatgccccgccgccaaggagaacggcagcagatggatccagtacaagggccactgctacaagagcgaccaggccctgcacagcttcagcgaggccaagaagctgtgcagcaagcacgaccacagcgccaccatcgtgagcatcaaggacgaggacgagaacaagttcgtgagcagactgatgagagagaacaacaacatcaccatgagagtgtggctgggcctgagccagcacagcgtggaccagagctggagctggctggacggcagcgaggtgaccttcgtgaagtgggagaacaagagcaagagcggcgtgggcagatgcagcatgctgatcgccagcaacgagacctggaagaaggtggagtgcgagcacggcttcggcagagtggtgtgcaaggtgcccctgggccccgactacaccgccatcgccatcatcgtggccaccctgagcatcctggtgctgatgggcggcctgatctggttcctgttccagagacacagactgcacctggccggcttcagcagcgtgagatacgcccagggcgtgaacgaggacgagatcatgctgcccagcttccacgactag

SEQ ID NO: 19210 - DNA, 5454 bp, Artificial Sequence
  Description of Artificial Sequence: Synthetic coding sequence
atgagaaccggctgggccacccccagaagacccgccggcctgctgatgctgctgttctggttcttcgacctggccgagcccagcggcagagccgccaacgaccccttcaccatcgtgcacggcaacaccggcaagtgcatcaagcccgtgtacggctggatcgtggccgacgactgcgacgagaccgaggacaagctgtggaagtgggtgagccagcacagactgttccacctgcacagccagaagtgcctgggcctggacatcaccaagagcgtgaacgagctgagaatgttcagctgcgacagcagcgccatgctgtggtggaagtgcgagcaccacagcctgtacggcgccgccagatacagactggccctgaaggacggccacggcaccgccatcagcaacgccagcgacgtgtggaagaagggcggcagcgaggagagcctgtgcgaccagccctaccacgagatctacaccagagacggcaacagctacggcagaccctgcgagttccccttcctgatcgacggcacctggcaccacgactgcatcctggacgaggaccacagcggcccctggtgcgccaccaccctgaactacgagtacgacagaaagtggggcatctgcctgaagcccgagaacggctgcgaggacaactgggagaagaacgagcagttcggcagctgctaccagttcaacacccagaccgccctgagctggaaggaggcctacgtgagctgccagaaccagggcgccgacctgctgagcatcaacagcgccgccgagctgacctacctgaaggagaaggagggcatcgccaagatcttctggatcggcctgaaccagctgtacagcgccagaggctgggagtggagcgaccacaagcccctgaacttcctgaactgggaccccgacagacccagcgcccccaccatcggcggcagcagctgcgccagaatggacgccgagagcggcctgtggcagagcttcagctgcgaggcccagctgccctacgtgtgcagaaagcccctgaacaacaccgtggagctgaccgacgtgtggacctacagcgacaccagatgcgacgccggctggctgcccaacaacggcttctgctacctgctggtgaacgagagcaacagctgggacaaggcccacgccaagtgcaaggccttcagcagcgacctgatcagcatccacagcctggccgacgtggaggtggtggtgaccaagctgcacaacgaggacatcaaggaggaggtgtggatcggcctgaagaacatcaacatccccaccctgttccagtggagcgacggcaccgaggtgaccctgacctactgggacgagaacgagcccaacgtgccctacaacaagacccccaactgcgtgagctacctgggcgagctgggccagtggaaggtgcagagctgcgaggagaagctgaagtacgtgtgcaagagaaagggcgagaagctgaacgacgccagcagcgacaagatgtgcccccccgacgagggctggaagagacacggcgagacctgctacaagatctacgaggacgaggtgcccttcggcaccaactgcaacctgaccatcaccagcagattcgagcaggagtacctgaacgacctgatgaagaagtacgacaagagcctgagaaagtacttctggaccggcctgagagacgtggacagctgcggcgagtacaactgggccaccgtgggcggcagaagaagagccgtgaccttcagcaactggaacttcctggagcccgccagccccggcggctgcgtggccatgagcaccggcaagagcgtgggcaagtgggaggtgaaggactgcagaagcttcaaggccctgagcatctgcaagaagatgagcggccccctgggccccgaggaggccagccccaagcccgacgacccctgccccgagggctggcagagcttccccgccagcctgagctgctacaaggtgttccacgccgagagaatcgtgagaaagagaaactgggaggaggccgagagattctgccaggccctgggcgcccacctgagcagcttcagccacgtggacgagatcaaggagttcctgcacttcctgaccgaccagttcagcggccagcactggctgtggatcggcctgaacaagagaagccccgacctgcagggcagctggcagtggagcgacagaacccccgtgagcaccatcatcatgcccaacgagttccagcaggactacgacatcagagactgcgccgccgtgaaggtgttccacagaccctggagaagaggctggcacttctacgacgacagagagttcatctacctgagacccttcgcctgcgacaccaagctggagtgggtgtgccagatccccaagggcagaacccccaagacccccgactggtacaaccccgacagagccggcatccacggcccccccctgatcatcgagggcagcgagtactggttcgtggccgacctgcacctgaactacgaggaggccgtgctgtactgcgccagcaaccacagcttcctggccaccatcaccagcttcgtgggcctgaaggccatcaagaacaagatcgccaacatcagcggcgacggccagaagtggtggatcagaatcagcgagtggcccatcgacgaccacttcacctacagcagatacccctggcacagattccccgtgaccttcggcgaggagtgcctgtacatgagcgccaagacctggctgatcgacctgggcaagcccaccgactgcagcaccaagctgcccttcatctgcgagaagtacaacgtgagcagcctggagaagtacagccccgacagcgccgccaaggtgcagtgcagcgagcagtggatccccttccagaacaagtgcttcctgaagatcaagcccgtgagcctgaccttcagccaggccagcgacacctgccacagctacggcggcaccctgcccagcgtgctgagccagatcgagcaggacttcatcaccagcctgctgcccgacatggaggccaccctgtggatcggcctgagatggaccgcctacgagaagatcaacaagtggaccgacaacagagagctgacctacagcaacttccaccccctgctggtgagcggcagactgagaatccccgagaacttcttcgaggaggagagcagataccactgcgccctgatcctgaacctgcagaagagccccttcaccggcacctggaacttcaccagctgcagcgagagacacttcgtgagcctgtgccagaagtacagcgaggtgaagagcagacagaccctgcagaacgccagcgagaccgtgaagtacctgaacaacctgtacaagatcatccccaagaccctgacctggcacagcgccaagagagagtgcctgaagagcaacatgcagctggtgagcatcaccgacccctaccagcaggccttcctgagcgtgcaggccctgctgcacaacagcagcctgtggatcggcctgttcagccaggacgacgagctgaacttcggctggagcgacggcaagagactgcacttcagcagatgggccgagaccaacggccagctggaggactgcgtggtgctggacaccgacggcttctggaagaccgtggactgcaacgacaaccagcccggcgccatctgctactacagcggcaacgagaccgagaaggaggtgaagcccgtggacagcgtgaagtgccccagccccgtgctgaacaccccctggatccccttccagaactgctgctacaacttcatcatcaccaagaacagacacatggccaccacccaggacgaggtgcacaccaagtgccagaagctgaaccccaagagccacatcctgagcatcagagacgagaaggagaacaacttcgtgctggagcagctgctgtacttcaactacatggccagctgggtgatgctgggcatcacctacagaaacaagagcctgatgtggttcgacaagacccccctgagctacacccactggagagccggcagacccaccatcaagaacgagaagttcctggccggcctgagcaccgacggcttctgggacatccagaccttcaaggtgatcgaggaggccgtgtacttccaccagcacagcatcctggcctgcaagatcgagatggtggactacaaggaggagtacaacaccaccctgccccagttcatgccctacgaggacggcatctacagcgtgatccagaagaaggtgacctggtacgaggccctgaacatgtgcagccagagcggcggccacctggccagcgtgcacaaccagaacggccagctgttcctggaggacatcgtgaagagagacggcttccccctgtgggtgggcctgagcagccacgacggcagcgagagcagcttcgagtggagcgacggcagcaccttcgactacatcccctggaagggccagaccagccccggcaactgcgtgctgctggaccccaagggcacctggaagcacgagaagtgcaacagcgtgaaggacggcgccatctgctacaagcccaccaagagcaagaagctgagcagactgacctacagcagcagatgccccgccgccaaggagaacggcagcagatggatccagtacaagggccactgctacaagagcgaccaggccctgcacagcttcagcgaggccaagaagctgtgcagcaagcacgaccacagcgccaccatcgtgagcatcaaggacgaggacgagaacaagttcgtgagcagactgatgagagagaacaacaacatcaccatgagagtgtggctgggcctgagccagcacagcgtggactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgacgccagcttcaagtggttcgacaacagcaacatgaccttcgacaagtggaccgaccaggacgacgacgaggacctggtggacacctgcgccttcctgcacatcaagaccggcgagtggaagaagggcaactgcgaggtgagcagcgtggagggcaccctgtgcaagaccgccatcccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 19211 - DNA, 5622 bp, Artificial Sequence
  Description of Artificial Sequence: Synthetic coding sequence
atgagaaccggctgggccacccccagaagacccgccggcctgctgatgctgctgttctggttcttcgacctggccgagcccagcggcagagccgccaacgaccccttcaccatcgtgcacggcaacaccggcaagtgcatcaagcccgtgtacggctggatcgtggccgacgactgcgacgagaccgaggacaagctgtggaagtgggtgagccagcacagactgttccacctgcacagccagaagtgcctgggcctggacatcaccaagagcgtgaacgagctgagaatgttcagctgcgacagcagcgccatgctgtggtggaagtgcgagcaccacagcctgtacggcgccgccagatacagactggccctgaaggacggccacggcaccgccatcagcaacgccagcgacgtgtggaagaagggcggcagcgaggagagcctgtgcgaccagccctaccacgagatctacaccagagacggcaacagctacggcagaccctgcgagttccccttcctgatcgacggcacctggcaccacgactgcatcctggacgaggaccacagcggcccctggtgcgccaccaccctgaactacgagtacgacagaaagtggggcatctgcctgaagcccgagaacggctgcgaggacaactgggagaagaacgagcagttcggcagctgctaccagttcaacacccagaccgccctgagctggaaggaggcctacgtgagctgccagaaccagggcgccgacctgctgagcatcaacagcgccgccgagctgacctacctgaaggagaaggagggcatcgccaagatcttctggatcggcctgaaccagctgtacagcgccagaggctgggagtggagcgaccacaagcccctgaacttcctgaactgggaccccgacagacccagcgcccccaccatcggcggcagcagctgcgccagaatggacgccgagagcggcctgtggcagagcttcagctgcgaggcccagctgccctacgtgtgcagaaagcccctgaacaacaccgtggagctgaccgacgtgtggacctacagcgacaccagatgcgacgccggctggctgcccaacaacggcttctgctacctgctggtgaacgagagcaacagctgggacaaggcccacgccaagtgcaaggccttcagcagcgacctgatcagcatccacagcctggccgacgtggaggtggtggtgaccaagctgcacaacgaggacatcaaggaggaggtgtggatcggcctgaagaacatcaacatccccaccctgttccagtggagcgacggcaccgaggtgaccctgacctactgggacgagaacgagcccaacgtgccctacaacaagacccccaactgcgtgagctacctgggcgagctgggccagtggaaggtgcagagctgcgaggagaagctgaagtacgtgtgcaagagaaagggcgagaagctgaacgacgccagcagcgacaagatgtgcccccccgacgagggctggaagagacacggcgagacctgctacaagatctacgaggacgaggtgcccttcggcaccaactgcaacctgaccatcaccagcagattcgagcaggagtacctgaacgacctgatgaagaagtacgacaagagcctgagaaagtacttctggaccggcctgagagacgtggacagctgcggcgagtacaactgggccaccgtgggcggcagaagaagagccgtgaccttcagcaactggaacttcctggagcccgccagccccggcggctgcgtggccatgagcaccggcaagagcgtgggcaagtgggaggtgaaggactgcagaagcttcaaggccctgagcatctgcaagaagatgagcggccccctgggccccgaggaggccagccccaagcccgacgacccctgccccgagggctggcagagcttccccgccagcctgagctgctacaaggtgttccacgccgagagaatcgtgagaaagagaaactgggaggaggccgagagattctgccaggccctgggcgcccacctgagcagcttcagccacgtggacgagatcaaggagttcctgcacttcctgaccgaccagttcagcggccagcactggctgtggatcggcctgaacaagagaagccccgacctgcagggcagctggcagtggagcgacagaacccccgtgagcaccatcatcatgcccaacgagttccagcaggactacgacatcagagactgcgccgccgtgaaggtgttccacagaccctggagaagaggctggcacttctacgacgacagagagttcatctacctgagacccttcgcctgcgacaccaagctggagtgggtgtgccagatccccaagggcagaacccccaagacccccgactggtacaaccccgacagagccggcatccacggcccccccctgatcatcgagggcagcgagtactggttcgtggccgacctgcacctgaactacgaggaggccgtgctgtactgcgccagcaaccacagcttcctggccaccatcaccagcttcgtgggcctgaaggccatcaagaacaagatcgccaacatcagcggcgacggccagaagtggtggatcagaatcagcgagtggcccatcgacgaccacttcacctacagcagatacccctggcacagattccccgtgaccttcggcgaggagtgcctgtacatgagcgccaagacctggctgatcgacctgggcaagcccaccgactgcagcaccaagctgcccttcatctgcgagaagtacaacgtgagcagcctggagaagtacagccccgacagcgccgccaaggtgcagtgcagcgagcagtggatccccttccagaacaagtgcttcctgaagatcaagcccgtgagcctgaccttcagccaggccagcgacacctgccacagctacggcggcaccctgcccagcgtgctgagccagatcgagcaggacttcatcaccagcctgctgcccgacatggaggccaccctgtggatcggcctgagatggaccgcctacgagaagatcaacaagtggaccgacaacagagagctgacctacagcaacttccaccccctgctggtgagcggcagactgagaatccccgagaacttcttcgaggaggagagcagataccactgcgccctgatcctgaacctgcagaagagccccttcaccggcacctggaacttcaccagctgcagcgagagacacttcgtgagcctgtgccagaagtacagcgaggtgaagagcagacagaccctgcagaacgccagcgagaccgtgaagtacctgaacaacctgtacaagatcatccccaagaccctgacctggcacagcgccaagagagagtgcctgaagagcaacatgcagctggtgagcatcaccgacccctaccagcaggccttcctgagcgtgcaggccctgctgcacaacagcagcctgtggatcggcctgttcagccaggacgacgagctgaacttcggctggagcgacggcaagagactgcacttcagcagatgggccgagaccaacggccagctggaggactgcgtggtgctggacaccgacggcttctggaagaccgtggactgcaacgacaaccagcccggcgccatctgctactacagcggcaacgagaccgagaaggaggtgaagcccgtggacagcgtgaagtgccccagccccgtgctgaacaccccctggatccccttccagaactgctgctacaacttcatcatcaccaagaacagacacatggccaccacccaggacgaggtgcacaccaagtgccagaagctgaaccccaagagccacatcctgagcatcagagacgagaaggagaacaacttcgtgctggagcagctgctgtacttcaactacatggccagctgggtgatgctgggcatcacctacagaaacaagagcctgatgtggttcgacaagacccccctgagctacacccactggagagccggcagacccaccatcaagaacgagaagttcctggccggcctgagcaccgacggcttctgggacatccagaccttcaaggtgatcgaggaggccgtgtacttccaccagcacagcatcctggcctgcaagatcgagatggtggactacaaggaggagtacaacaccaccctgccccagttcatgccctacgaggacggcatctacagcgtgatccagaagaaggtgacctggtacgaggccctgaacatgtgcagccagagcggcggccacctggccagcgtgcacaaccagaacggccagctgttcctggaggacatcgtgaagagagacggcttccccctgtgggtgggcctgagcagccacgacggcagcgagagcagcttcgagtggagcgacggcagcaccttcgactacatcccctggaagggccagaccagccccggcaactgcgtgctgctggaccccaagggcacctggaagcacgagaagtgcaacagcgtgaaggacggcgccatctgctacaagcccaccaagagcaagaagctgagcagactgacctacagcagcagatgccccgccgccaaggagaacggcagcagatggatccagtacaagggccactgctacaagagcgaccaggccctgcacagcttcagcgaggccaagaagctgtgcagcaagcacgaccacagcgccaccatcgtgagcatcaaggacgaggacgagaacaagttcgtgagcagactgatgagagagaacaacaacatcaccatgagagtgtggctgggcctgagccagcacagcgtggaccagagctggagctggctggacggcagcgaggtgaccttcgtgaagtgggagaacaagagcaagagcggcgtgggcagatgcagcatgctgatcgccagcaacgagacctggaagaaggtggagtgcgagcacggcttcggcagagtggtgtgcaaggtgcccctggactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgacgccagcttcaagtggttcgacaacagcaacatgaccttcgacaagtggaccgaccaggacgacgacgaggacctggtggacacctgcgccttcctgcacatcaagaccggcgagtggaagaagggcaactgcgaggtgagcagcgtggagggcaccctgtgcaagaccgccatcccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 19212 - DNA, 1149 bp, Artificial Sequence
  Description of Artificial Sequence: Synthetic coding sequence
atgagaagccacttcctgcagtgggccctggccaccagcagaaacaaggaccagatcaccaacatcttcagcggcttcgccggcctgctggccatcctgctggtggtggccgtgttctgcatcctgtggaactggaacaagagaaagaagagacaggtgccctacctgagagtgaccgtgatgcccctgctgaccctgccccagaccagacagagagccaagaacatctacgacatcctgccctggagacaggaggacctgggcagacacgagagcagaagcatgagaatcttcagcaccgagagcctgctgagcagaaacagcgagagccccgagcacgtgcccagccaggccggcaacgccttccaggagcacaccgcccacatccacgccaccgagtacgccgtgggcatctacgacaacgccatggtgccccagatgtgcggcaacctgacccccagcgcccactgcatcaacgtgagagccagcagagactgcgccagcatcagcagcgaggacagccacgactacgtgaacgtgcccaccgccgaggagatcgccgagaccctggccagcaccaagagccccagcagaaacctgttcgtgctgcccagcacccagaagctggagttcaccgaggagagagacgagggctgcggcgacgccggcgactgcaccagcctgtacagccccggcgccgaggacagcgacagcctgagcaacggcgagggcagcagccagatcagcaacgactacgtgaacatgaccggcctggacctgagcgccatccaggagagacagctgtgggtggccttccagtgctgcagagactacgagaacgtgcccgccgccgaccccagcggcagccagcagcaggccgagaaggacgtgcccagcagcaacatcggccacgtggaggacaagaccgacgaccccggcacccacgtgcagtgcgtgaagagaaccttcctggccagcggcgactacgccgacttccagcccttcacccagagcgaggacagccagatgaagcacagagaggagatgagcaacgaggacagcagcgactacgagaacgtgctgaccgccaagctgggcggcagagacagcgagcagggccccggcacccagctgctgcccgacgagtag

SEQ ID NO: 19213 - DNA, 1197 bp, Artificial Sequence
  Description of Artificial Sequence: Synthetic coding sequence
atggacggcgtgacccccaccctgagcaccatcagaggcagaaccctggagagcagcaccctgcacgtgacccccagaagcctggacagaaacaaggaccagatcaccaacatcttcagcggcttcgccggcctgctggccatcctgctggtggtggccgtgttctgcatcctgtggaactggaacaagagaaagaagagacaggtgccctacctgagagtgaccgtgatgcccctgctgaccctgccccagaccagacagagagccaagaacatctacgacatcctgccctggagacaggaggacctgggcagacacgagagcagaagcatgagaatcttcagcaccgagagcctgctgagcagaaacagcgagagccccgagcacgtgcccagccaggccggcaacgccttccaggagcacaccgcccacatccacgccaccgagtacgccgtgggcatctacgacaacgccatggtgccccagatgtgcggcaacctgacccccagcgcccactgcatcaacgtgagagccagcagagactgcgccagcatcagcagcgaggacagccacgactacgtgaacgtgcccaccgccgaggagatcgccgagaccctggccagcaccaagagccccagcagaaacctgttcgtgctgcccagcacccagaagctggagttcaccgaggagagagacgagggctgcggcgacgccggcgactgcaccagcctgtacagccccggcgccgaggacagcgacagcctgagcaacggcgagggcagcagccagatcagcaacgactacgtgaacatgaccggcctggacctgagcgccatccaggagagacagctgtgggtggccttccagtgctgcagagactacgagaacgtgcccgccgccgaccccagcggcagccagcagcaggccgagaaggacgtgcccagcagcaacatcggccacgtggaggacaagaccgacgaccccggcacccacgtgcagtgcgtgaagagaaccttcctggccagcggcgactacgccgacttccagcccttcacccagagcgaggacagccagatgaagcacagagaggagatgagcaacgaggacagcagcgactacgagaacgtgctgaccgccaagctgggcggcagagacagcgagcagggccccggcacccagctgctgcccgacgagtag

SEQ ID NO: 19214 - DNA, 189 bp, Artificial Sequence
  Description of Artificial Sequence: Synthetic coding sequence
atggaccccagagagtgcgtgtgcatgagcggcggcatctgcatgtgcggcgacaactgcaagtgcaccacctgcaactgcaagacctactggaagagctgctgcccctgctgcccccccggctgcgccaagtgcgccagaggctgcatctgcaagggcggcagcgacaagtgcagctgctgcccctag

SEQ ID NO: 19215 - DNA, 369 bp, Artificial Sequence
  Description of Artificial Sequence: Synthetic coding sequence
atgaccaccgccaccagacaggaggtgctgggcctgtacagaagcatcttcagactggccagaaagtggcaggccaccagcggccagatggaggacaccatcaaggagaagcagtacatcctgaacgaggccagaaccctgttcagaaagaacaagaacctgaccgacaccgacctgatcaagcagtgcatcgacgagtgcaccgccagaatcgagatcggcctgcactacaagatcccctaccccagacccatccacctgccccccatgggcctgacccccctgagaggcagaggcctgagaagccaggagaagctgagaaagctgagcaagcccgtgtacctgagaagccacgacgaggtgagctag

SEQ ID NO: 19216 - DNA, 369 bp, Artificial Sequence; identical to SEQ ID NO: 19215
  Description of Artificial Sequence: Synthetic coding sequence

SEQ ID NO: 19217 - DNA, 369 bp, Artificial Sequence; identical to SEQ ID NO: 19215
  Description of Artificial Sequence: Synthetic coding sequence

SEQ ID NO: 19218 - DNA, 267 bp, Artificial Sequence
  Description of Artificial Sequence: Synthetic coding sequence
atggccgccagcagactgccccccgccaccctgaccctgaagcagttcgtgagaagacagcaggtgctgctgctgtacagaagaatcctgcagaccatcagacaggtgcccaacgacagcgacagaaagtacctgaaggactgggccagagaggagttcagaagaaacaagagcgccaccgaggaggacaccatcagaatgatgatcacccagggcaacatgcagctgaaggagctggagaagaccctggccctggccaagagctag

SEQ ID NO: 19219 - DNA, 273 bp, Artificial Sequence
  Description of Artificial Sequence: Synthetic coding sequence
atgaagatggccaacagcctgagaggcgaggtgctgaagctgtacaagaacctgctgtacctgggcagagactaccccaagggcgccgactacttcaagaagagactgaagaacatcttcctgaagaacaaggacgtgaagaaccccgagaagatcaaggagctgatcgcccagggcgagttcgtgatgaaggagctggaggccctgtacttcctgagaaagtacagagccatgaagcagagatactacagcgacaccaacaagaccaactag

SEQ ID NO: 19220 - DNA, 105 bp, Artificial Sequence
  Description of Artificial Sequence: Synthetic coding sequence
atggccaacagcctgagaggcgaggtgctgaagctgtacaagaacctgctgtacctgggcagagactaccccaagggcgccgactacttcaagaagagactgtag

SEQ ID NO: 19221 - DNA, 267 bp, Artificial Sequence
  Description of Artificial Sequence: Synthetic coding sequence
atggccaacagcctgagaggcgaggtgctgaagctgtacaagaacctgctgtacctgggcagagactaccccaagggcgccgactacttcaagaagagactgaagaacatcttcctgaagaacaaggacgtgaagaaccccgagaagatcaaggagctgatcgcccagggcgagttcgtgatgaaggagctggaggccctgtacttcctgagaaagtacagagccatgaagcagagatactacagcgacaccaacaagaccaactag

SEQ ID NO: 19222 - DNA, 267 bp, Artificial Sequence; identical to SEQ ID NO: 19221
  Description of Artificial Sequence: Synthetic coding sequence

SEQ ID NO: 19223 - DNA, 267 bp, Artificial Sequence; identical to SEQ ID NO: 19221
  Description of Artificial Sequence: Synthetic coding sequence

SEQ ID NO: 19224 - DNA, 267 bp, Artificial Sequence; identical to SEQ ID NO: 19221
  Description of Artificial Sequence: Synthetic coding sequence

SEQ ID NO: 19225 - DNA, 315 bp, Artificial Sequence
  Description of Artificial Sequence: Synthetic coding sequence
atgggcagagccgtgaaggtgctgcagctgttcaagaccctgcacagaaccagacagcaggtgttcaagaacgacgccagagccctggaggccgccagaatcaagatcaacgaggagttcaagaacaacaagagcgagaccagcagcaagaagatcgaggagctgatgaagatcggcagcgacgtggagctgctgctgagaaccagcgtgatccagggcatccacaccgaccacaacaccctgaagctggtgcccagaaaggacctgctggtggagaacgtgccctactgcgacgcccccacccagaagcagtag

SEQ ID NO: 19226 - DNA, 921 bp, Artificial Sequence
  Description of Artificial Sequence: Synthetic coding sequence
atggccggcagacaccagaacagaagcttccccctgcccggcgtgcagagcagcggccaggtgcacgccttcggcaactgcagcgacagcgacatcctggaggaggacgccgaggtgtacgagctgagaagcagaggcaaggagaaggtgagaagaagcaccagcagagacagactggacgacatcatcgtgctgaccaaggacatccaggagggcgacaccctgaacgccatcgccctgcagtactgctgcaccgtggccgacatcaagagagtgaacaacctgatcagcgaccaggacttcttcgccctgagaagcatcaagatccccgtgaagaagttcagcagcctgaccgagaccctgtgcccccccaagggcagacagaccagcagacacagcagcgtgcagtacagcagcgagcagcaggagatcctgcccgccaacgacagcctggcctacagcgacagcgccggcagcttcctgaaggaggtggacagagacatcgagcagatcgtgaagtgcaccgacaacaagagagagaacctgaacgaggtggtgagcgccctgaccgcccagcagatgagattcgagcccgacaacaagaacacccagagaaaggacccctactacggcgccgactggggcatcggctggtggaccgccgtggtgatcatgctgatcgtgggcatcatcacccccgtgttctacctgctgtactacgagatcctggccaaggtggacgtgagccaccacagcaccgtggacagcagccacctgcacagcaagatcaccccccccagccagcagagagagatggagaacggcatcgtgcccaccaagggcatccacttcagccagcaggacgaccacaagctgtacagccaggacagccagagccccgccgcccagcaggagacctag

SEQ ID NO: 19227 - DNA, 921 bp, Artificial Sequence; identical to SEQ ID NO: 19226
  Description of Artificial Sequence: Synthetic coding sequence

SEQ ID NO: 19228 - DNA, 384 bp, Artificial Sequence
  Description of Artificial Sequence: Synthetic coding sequence
atggccggcagacaccagaacagaagcttccccctgcccggcgtgcagagcagcggccaggtgcacgccttcggcaactgcagcgacagcgacatcctggaggaggacgccgaggtgtacgagctgagaagcagaggcaaggagaaggtgagaagaagcaccagcagagacagactggacgacatcatcgtgctgaccaaggacatccaggagggcgacaccctgaacgccatcgccctgcagtactgctgcaccgtgtaccagaacagcagcaagaaggtgcagttcctggacagaaacaccctgagcagcaagagaaagaccgacttcaccagcttcatctgcagcatcctgttcagaaccaccggcaacttcgccagctag

SEQ ID NO: 19229 - DNA, 891 bp, Artificial Sequence
  Description of Artificial Sequence: Synthetic coding sequence
atgagacacgaggagctgctgaccaagaccttccagggccccgccgtggtgtgcggcacccccaccagccacgtgtacatgttcaagaacggcagcggcgacagcggcgacagcagcgaggaggagagccacagagtggtgctgagacccagaggcaaggagagacacaagagcggcgtgcaccagcccccccaggccggcgccggcgacgtggtgctgctgcagagagagctggcccaggaggacagcctgaacaagctggccctgcagtacggctgcaaggtggccgacatcaagaaggtgaacaacttcatcagagagcaggacctgtacgccctgaagagcgtgaagatccccgtgagaaaccacggcatcctgatggagacccacaaggagctgaagcccctgctgagccccagcagcgagaccaccgtgaccgtggagctgcccgaggccgacagagccggcgccggcaccggcgcccaggccggccagctgatgggcttcttcaagggcatcgaccaggacatcgagagagccgtgcagagcgagatcttcctgcacgagagctactgcatggacaccagccaccagcccctgctgcccgccccccccaagacccccatggacggcgccgactgcggcatccagtggtggaacgccgtgttcatcatgctgctgatcggcatcgtgctgcccgtgttctacctggtgtacttcaagatccaggccagcggcgagacccccaacagcctgaacaccaccgtgatccccaacggcagcatggccatgggcaccgtgcccggccaggcccccagactggccgtggccgtgcccgccgtgaccagcgccgacagccagttcagccagaccacccaggccggcagctag

SEQ ID NO: 19230 - DNA, 894 bp, Artificial Sequence
  Description of Artificial Sequence: Synthetic coding sequence
atggccgtgggcaccagaggcaccctgctgaagaagagcctgaccgtgtggttctgcggccccggcgccagaagcgccaccagagccgtgagcaccagcctgcccagaagagagcaggtgacctggtgctgctgcagcggcagctggcccagaagaaccgccagcaccagctggagatgcagcatggccgccaacaccttctacttcagacccaacggcgccggcgacaccagacagaacctgatccccgacttctacgccttcagagtgatcaacaacggcaaggtggccgacatcaagaaggtgaacaacttcatcagagagcaggacctgtacgccctgaagagcgtgaagatccccgtgagaaaccacggcatcctgatggagacccacaaggagctgaagcccctgctgagccccagcagcgagaccaccgtgaccgtggagctgcccgaggccgacagagccggcgccggcaccggcgcccaggccggccagctgatgggcttcttcaagggcatcgaccaggacatcgagagagccgtgcagagcgagatcttcctgcacgagagctactgcatggacaccagccaccagcccctgctgcccgccccccccaagacccccatggacggcgccgactgcggcatccagtggtggaacgccgtgttcatcatgctgctgatcggcatcgtgctgcccgtgttctacctggtgtacttcaagatccaggccagcggcgagacccccaacagcctgaacaccaccgtgatccccaacggcagcatggccatgggcaccgtgcccggccaggcccccagactggccgtggccgtgcccgccgtgaccagcgccgacagccagttcagccagaccacccaggccggcagctag

SEQ ID NO: 19231 - DNA, 891 bp, Artificial Sequence; identical to SEQ ID NO: 19229
  Description of Artificial Sequence: Synthetic coding sequence

SEQ ID NO: 19232 - DNA, 513 bp, Artificial Sequence
  Description of Artificial Sequence: Synthetic coding sequence
atggagacccacaaggagctgaagcccctgctgagccccagcagcgagaccaccgtgaccgtggagctgcccgaggccgacagagccggcgccggcaccggcgcccaggccggccagctgatgggcttcttcaagggcatcgaccaggacatcgagagagccgtgcagagcgagatcttcctgcacgagagctactgcatggacaccagccaccagcccctgctgcccgccccccccaagacccccatggacggcgccgactgcggcatccagtggtggaacgccgtgttcatcatgctgctgatcggcatcgtgctgcccgtgttctacctggtgtacttcaagatccaggccagcggcgagacccccaacagcctgaacaccaccgtgatccccaacggcagcatggccatgggcaccgtgcccggccaggcccccagactggccgtggccgtgcccgccgtgaccagcgccgacagccagttcagccagaccacccaggccggcagctag

SEQ ID NO: 19233 - DNA, 1635 bp, Artificial Sequence
  Description of Artificial Sequence: Synthetic coding sequence
atgagcagatgcgcccaggccgccgaggtggccgccaccgtgcccggcgccggcgtgggcaacgtgggcctgagaccccccatggtgcccagacaggccagcttcttccccccccccgtgcccaaccccttcgtgcagcagacccagatcggcagcgccagaagagtgcagatcgtgctgctgggcatcatcctgctgcccatcagagtgctgctggtggccctgatcctgctgctggcctggcccttcgccgccatcagcaccgtgtgctgccccgagaagctgacccaccccatcaccggctggagaagaaagatcacccagaccgccctgaagttcctgggcagagccatgttcttcagcatgggcttcatcgtggccgtgaagggcaagatcgccagccccctggaggcccccgtgttcgtggccgccccccacagcaccttcttcgacggcatcgcctgcgtggtggccggcctgcccagcatggtgagcagaaacgagaacgcccaggtgcccctgatcggcagactgctgagagccgtgcagcccgtgctggtgagcagagtggaccccgacagcagaaagaacaccatcaacgagatcatcaagagaaccaccagcggcggcgagtggccccagatcctggtgttccccgagggcacctgcaccaacagaagctgcctgatcaccttcaagcccggcgccttcatccccggcgtgcccgtgcagcccgtgctgctgagataccccaacaagctggacaccgtgacctggacctggcagggctacaccttcatccagctgtgcatgctgaccttctgccagctgttcaccaaggtggaggtggagttcatgcccgtgcaggtgcccaacgacgaggagaagaacgaccccgtgctgttcgccaacaaggtgagaaacctgatggccgaggccctgggcatccccgtgaccgaccacacctacgaggactgcagactgatgatcagcgccggccagctgaccctgcccatggaggccggcctggtggagttcaccaagatcagcagaaagctgaagctggactgggacggcgtgagaaagcacctggacgagtacgccagcatcgccagcagcagcaagggcggcagaatcggcatcgaggagttcgccaagtacctgaagctgcccgtgagcgacgtgctgagacagctgttcgccctgttcgacagaaaccacgacggcagcatcgacttcagagagtacgtgatcggcctggccgtgctgtgcaaccccagcaacaccgaggagatcatccaggtggccttcaagctgttcgacgtggacgaggacggctacatcaccgaggaggagttcagcaccatcctgcaggccagcctgggcgtgcccgacctggacgtgagcggcctgttcaaggagatcgcccagggcgacagcatcagctacgaggagttcaagagcttcgccctgaagcaccccgagtacgccaagatcttcaccacctacctggacctgcagacctgccacgtgttcagcctgcccaaggaggtgcagaccacccccagcaccgccagcaacaaggtgagccccgagaagcacgaggagagcaccagcgacaagaaggacgactag

SEQ ID NO: 19234 - DNA, 1113 bp, Artificial Sequence
  Description of Artificial Sequence: Synthetic coding sequence
atggccatcaccctggaggaggccccctggctgggctggctgctggtgaaggccctgatgagattcgccttcatggtggtgaacaacctggtggccatccccagctacatctgctacgtgatcatcctgcagcccctgagagtgctggacagcaagagattctggtacatcgagggcatcatgtacaagtggctgctgggcatggtggccagctggggctggtacgccggctacaccgtgatggagtggggcgaggacatcaaggccgtgagcaaggacgaggccgtgatgctggtgaaccaccaggccaccggcgacgtgtgcaccctgatgatgtgcctgcaggacaagggcctggtggtggcccagatgatgtggctgatggaccacatcttcaagtacaccaacttcggcatcgtgagcctggtgcacggcgacttcttcatcagacagggcagaagctacagagaccagcagctgctgctgctgaagaagcacctggagaacaactacagaagcagagacagaaagtggatcgtgctgttccccgagggcggcttcctgagaaagagaagagagaccagccaggccttcgccaagaagaacaacctgcccttcctgaccaacgtgaccctgcccagaagcggcgccaccaagatcatcctgaacgccctggtggcccagcagaagaacggcagccccgccggcggcgacgccaaggagctggacagcaagagcaagggcctgcagtggatcatcgacaccaccatcgcctaccccaaggccgagcccatcgacatccagacctggatcctgggctacagaaagcccaccgtgacccacgtgcactacagaatcttccccatcaaggacgtgcccctggagaccgacgacctgaccacctggctgtaccagagattcgtggagaaggaggacctgctgagccacttctacgagaccggcgccttcccccccagcaagggccacaaggaggccgtgagcagagagatgaccctgagcaacctgtggatcttcctgatccagagcttcgccttcctgagcggctacatgtggtacaacatcatccagtacttctaccactgcctgttctag

SEQ ID NO: 19235 - DNA, 1113 bp, Artificial Sequence; identical to SEQ ID NO: 19234
  Description of Artificial Sequence: Synthetic coding sequence

SEQ ID NO: 19236 - DNA, 702 bp, Artificial Sequence
  Description of Artificial Sequence: Synthetic coding sequence
atggtgagcatgagcttcaagagaaacagaagcgacagattctacagcaccagatgctgcggctgctgccacgtgagaaccggcaccatcatcctgggcacctggtacatggtggtgaacctgctgatggccatcctgctgaccgtggaggtgacccaccccaacagcatgcccgccgtgaacatccagtacgaggtgatcggcaactactacagcagcgagagaatggccgacaacgcctgcgtgctgttcgccgtgagcgtgctgatgttcatcatcagcagcatgctggtgtacggcgccatcagctaccaggtgggctggctgatccccttcttctgctacagactgttcgacttcgtgctgagctgcctggtggccatcagcagcctgacctacctgcccagaatcaaggagtacctggaccagctgcccgacttcccctacaaggacgacctgctggccctggacagcagctgcctgctgttcatcgtgctggtgttcttcgccctgttcatcatcttcaaggcctacctgatcaactgcgtgtggaactgctacaagtacatcaacaacagaaacgtgcccgagatcgccgtgtaccccgccttcgaggcccccccccagtacgtgctgcccacctacgagatggccgtgaagatgcccgagaaggagcccccccccccctacctgcccgcctag

SEQ ID NO: 19237 - DNA, 1251 bp, Artificial Sequence
  Description of Artificial Sequence: Synthetic coding sequence
atgcccagacagctgagcgccgccgccgccctgttcgccagcctggccgtgatcctgcacgacggcagccagatgagagccaaggccttccccgagaccagagactacagccagcccaccgccgccgccaccgtgcaggacatcaagaagcccgtgcagcagcccgccaagcaggccccccaccagaccctggccgccagattcatggacggccacatcaccttccagaccgccgccaccgtgaagatccccaccaccacccccgccaccaccaagaacaccgccaccaccagccccatcacctacaccctggtgaccacccaggccacccccaacaacagccacaccgccccccccgtgaccgaggtgaccgtgggccccagcctggccccctacagcctgccccccaccatcaccccccccgcccacaccaccggcaccagcagcagcaccgtgagccacaccaccggcaacaccacccagcccagcaaccagaccaccctgcccgccaccctgagcatcgccctgcacaagagcaccaccggccagaagcccgtgcagcccacccacgcccccggcaccaccgccgccgcccacaacaccaccagaaccgccgcccccgccagcaccgtgcccggccccaccctggccccccagcccagcagcgtgaagaccggcatctaccaggtgctgaacggcagcagactgtgcatcaaggccgagatgggcatccagctgatcgtgcaggacaaggagagcgtgttcagccccagaagatacttcaacatcgaccccaacgccacccaggccagcggcaactgcggcaccagaaagagcaacctgctgctgaacttccagggcggcttcgtgaacctgaccttcaccaaggacgaggagagctactacatcagcgaggtgggcgcctacctgaccgtgagcgaccccgagaccatctaccagggcatcaagcacgccgtggtgatgttccagaccgccgtgggccacagcttcaagtgcgtgagcgagcagagcctgcagctgagcgcccacctgcaggtgaagaccaccgacgtgcagctgcaggccttcgacttcgaggacgaccacttcggcaacgtggacgagtgcagcagcgactacaccatcgtgctgcccgtgatcggcgccatcgtggtgggcctgtgcctgatgggcatgggcgtgtacaagatcagactgagatgccagagcagcggctaccagagaatctag

SEQ ID NO: 19238 - DNA, 543 bp, Artificial Sequence
  Description of Artificial Sequence: Synthetic coding sequence
atgcccagacagctgagcgccgccgccgccctgttcgccagcctggccgtgatcctgcacgacggcagccagatgagagccaaggccttccccgagaccagagactacagccagcccaccgccgccgccaccgtgcaggacatcaagaagcccgtgcagcagcccgccaagcaggccccccaccagaccctggccgccagattcatggacggccacatcaccttccagaccgccgccaccgtgaagatccccaccaccacccccgccaccaccaagaacaccgccaccaccagccccatcacctacaccctggtgaccacccaggccacccccaacaacagccacaccgccccccccgtgaccgaggtgaccgtgggccccagcctggccccctacagcctgccccccaccatcaccccccccgcccacaccaccggcaccagcagcagcaccgtgagccacaccaccggcaacaccacccagcccagcaaccagaccaccctgcccgccaccctgagcatcgccctgcacaagagcacctag

SEQ ID NO: 19239 - DNA, 843 bp, Artificial Sequence
  Description of Artificial Sequence: Synthetic coding sequence
atggacctgcagggcagaggcgtgcccagcatcgacagactgagagtgctgctgatgctgttccacaccatggcccagatcatggccgagcaggaggtggagaacctgagcggcctgagcaccaaccccgagaaggacatcttcgtggtgagagagaacggcaccacctgcctgatggccgagttcgccgccaagttcatcgtgccctacgacgtgtgggccagcaactacgtggacctgatcaccgagcaggccgacatcgccctgaccagaggcgccgaggtgaagggcagatgcggccacagccagagcgagctgcaggtgttctgggtggacagagcctacgccctgaagatgctgttcgtgaaggagagccacaacatgagcaagggccccgaggccacctggagactgagcaaggtgcagttcgtgtacgacagcagcgagaagacccacttcaaggacgccgtgagcgccggcaagcacaccgccaacagccaccacctgagcgccctggtgacccccgccggcaagagctacgagtgccaggcccagcagaccatcagcctggccagcagcgacccccagaagaccgtgaccatgatcctgagcgccgtgcacatccagcccttcgacatcatcagcgacttcgtgttcagcgaggagcacaagtgccccgtggacgagagagagcagctggaggagaccctgcccctgatcctgggcctgatcctgggcctggtgatcatggtgaccctggccatctaccacgtgcaccacaagatgaccgccaaccaggtgcagatccccagagacagaagccagtacaagcacatgggctag

SEQ ID NO: 19240 - DNA, 711 bp, Artificial Sequence
  Description of Artificial Sequence: Synthetic coding sequence
atggacctgcagggcagaggcgtgcccagcatcgacagactgagagtgctgctgatgctgttccacaccatggcccagatcatggccgagcaggaggtggagaacctgagcggcctgagcaccaaccccgagaaggacatcttcgtggtgagagagaacggcaccacctgcctgatggccgagttcgccgccaagttcatcgtgccctacgacgtgtgggccagcaactacgtggacgagagccacaacatgagcaagggccccgaggccacctggagactgagcaaggtgcagttcgtgtacgacagcagcgagaagacccacttcaaggacgccgtgagcgccggcaagcacaccgccaacagccaccacctgagcgccctggtgacccccgccggcaagagctacgagtgccaggcccagcagaccatcagcctggccagcagcgacccccagaagaccgtgaccatgatcctgagcgccgtgcacatccagcccttcgacatcatcagcgacttcgtgttcagcgaggagcacaagtgccccgtggacgagagagagcagctggaggagaccctgcccctgatcctgggcctgatcctgggcctggtgatcatggtgaccctggccatctaccacgtgcaccacaagatgaccgccaaccaggtgcagatccccagagacagaagccagtacaagcacatgggctag

SEQ ID NO: 19241 - DNA, 978 bp, Artificial Sequence
  Description of Artificial Sequence: Synthetic coding sequence
atgagcctgcagagcagactgagcggcagactggcccagctgagagccgccggccagctgctggtgccccccagacccagacccggccacctggccggcgccaccagaaccagaagcagcacctgcggcccccccgccttcctgggcgtgttcggcagaagagccagaaccagcgccggcgtgggcgcctggggcgccgccgccgtgggcagaaccgccggcgtgagaacctgggcccccctggccatggccgccaaggtggacctgagcaccagcaccgactggaaggaggccaagagcttcctgaagggcctgagcgacaagcagagagaggagcactacttctgcaaggacttcgtgagactgaagaagatccccacctggaaggagatggccaagggcgtggccgtgaaggtggaggagcccagatacaagaaggacaagcagctgaacgagaagatcagcctgctgagaagcgacatcaccaagctggaggtggacgccatcgtgaacgccgccaacagcagcctgctgggcggcggcggcgtggacggctgcatccacagagccgccggccccctgctgaccgacgagtgcagaaccctgcagagctgcaagaccggcaaggccaagatcaccggcggctacagactgcccgccaagtacgtgatccacaccgtgggccccatcgcctacggcgagcccagcgccagccaggccgccgagctgagaagctgctacctgagcagcctggacctgctgctggagcacagactgagaagcgtggccttcccctgcatcagcaccggcgtgttcggctacccctgcgaggccgccgccgagatcgtgctggccaccctgagagagtggctggagcagcacaaggacaaggtggacagactgatcatctgcgtgttcctggagaaggacgaggacatctacagaagcagactgccccactacttccccgtggcctag

SEQ ID NO: 19242 - DNA, 2151 bp, Artificial Sequence
  Description of Artificial Sequence: Synthetic coding sequence
atgaacaacttcagagccaccatcctgttctgggccgccgccgcctgggccaagagcggcaagcccagcggcgagatggacgaggtgggcgtgcagaagtgcaagaacgccctgaagctgcccgtgctggaggtgctgcccggcggcggctgggacaacctgagaaacgtggacatgggcagagtgatggagctgacctacagcaactgcagaaccaccgaggacggccagtacatcatccccgacgagatcttcaccatcccccagaagcagagcaacctggagatgaacagcgagatcctggagagctgggccaactaccagagcagcaccagctacagcatcaacaccgagctgagcctgttcagcaaggtgaacggcaagttcagcaccgagttccagagaatgaagaccctgcaggtgaaggaccaggccatcaccaccagagtgcaggtgagaaacctggtgtacaccgtgaagatcaaccccaccctggagctgagcagcggcttcagaaaggagctgctggacatcagcgacagactggagaacaaccagaccagaatggccacctacctggccgagctgctggtgctgaactacggcacccacgtgaccaccagcgtggacgccggcgccgccctgatccaggaggaccacctgagagccagcttcctgcaggacagccagagcagcagaagcgccgtgaccgccagcgccggcctggccttccagaacaccgtgaacttcaagttcgaggagaactacaccagccagaacgtgctgaccaagagctacctgagcaacagaaccaacagcagagtgcagagcatcggcggcgtgcccttctaccccggcatcaccctgcaggcctggcagcagggcatcaccaaccacctggtggccatcgacagaagcggcctgcccctgcacttcttcatcaaccccaacatgctgcccgacctgcccggccccctggtgaagaaggtgagcaagaccgtggagaccgccgtgaagagatactacaccttcaacacctaccccggctgcaccgacctgaacagccccaacttcaacttccaggccaacaccgacgacggcagctgcgagggcaagatgaccaacttcagcttcggcggcgtgtaccaggagtgcacccagctgagcggcaacagagacgtgctgctgtgccagaagctggagcagaagaaccccctgaccggcgacttcagctgccccagcggctacagccccgtgcacctgctgagccagatccacgaggagggctacaaccacctggagtgccacagaaagtgcaccctgctggtgttctgcaagaccgtgtgcgaggacgtgttccaggtggccaaggccgagttcagagccttctggtgcgtggccagcagccaggtgcccgagaacagcggcctgctgttcggcggcctgttcagcagcaagagcatcaaccccatgaccaacgcccagagctgccccgccggctacttccccctgagactgttcgagaacctgaaggtgtgcgtgagccaggactacgagctgggcagcagattcgccgtgcccttcggcggcttcttcagctgcaccgtgggcaaccccctggtggaccccgccatcagcagagacctgggcgcccccagcctgaagaagtgccccggcggcttcagccagcaccccgccctgatcagcgacggctgccaggtgagctactgcgtgaagagcggcctgttcaccggcggcagcctgccccccgccagactgccccccttcaccagaccccccctgatgagccaggccgccaccaacaccgtgatcgtgaccaacagcgagaacgccagaagctggatcaaggacagccagacccaccagtggagactgggcgagcccatcgagctgagaagagccatgaacgtgatccacggcgacggcggcggcctgagcggcggcgccgccgccggcgtgaccgtgggcgtgaccaccatcctggccgtggtgatcaccctggccatctacggcaccagaaagttcaagaagaaggcctaccaggccatcgaggagagacagagcctggtgcccggcaccgccgccaccggcgacaccacctaccaggagcagggccagagccccgcctag

SEQ ID NO: 19243 - DNA, 495 bp, Artificial Sequence
  Description of Artificial Sequence: Synthetic coding sequence
atgaacaacttcagagccaccatcctgttctgggccgccgccgcctgggccaagagcggcaagcccagcggcgagatggacgaggtgggcgtgcagaagtgcaagaacgccctgaagctgcccgtgctggaggtgctgcccggcggcggctgggacaacctgagaaacgtggacatgggcagagtgatggagctgacctacagcaactgcagaaccaccgaggacggccagtacatcatccccgacgagatcttcaccatcccccagaagcagagcaacctggagatgaacagcgagatcctggagagctgggccaactaccagagcagcaccagctacagcatcaacaccgagctgagcctgttcagcaaggtgaacggcaagttcagcaccgagttccagagagtgcccgccccctgccaggcccccaccttccaccccgccaccccccacgagagcggctgccaccagtactgccacagcgaccagttctag

SEQ ID NO: 19244 - DNA, 1398 bp, Artificial Sequence
  Description of Artificial Sequence: Synthetic coding sequence
atggaggaggaggacgaggaggccagagccctgctggccggcggccccgacgaggccgacagaggcgcccccgccgcccccggcgccctgcccgccctgtgcgaccccagcagactggcccacagactgctggtgctgctgctgatgtgcttcctgggcttcggcagctacttctgctacgacaaccccgccgccctgcagacccaggtgaagagagacatgcaggtgaacaccaccaagttcatgctgctgtacgcctggtacagctggcccaacgtggtgctgtgcttcttcggcggcttcctgatcgacagagtgttcggcatcagatggggcaccatcatcttcagctgcttcgtgtgcatcggccaggtggtgttcgccctgggcggcatcttcaacgccttctggctgatggagttcggcagattcgtgttcggcatcggcggcgagagcctggccgtggcccagaacacctacgccgtgagctggttcaagggcaaggagctgaacctggtgttcggcctgcagctgagcatggccagaatcggcagcaccgtgaacatgaacctgatgggctggctgtacagcaagatcgaggccctgctgggcagcgccggccacaccaccctgggcatcaccctgatgatcggcggcatcacctgcatcctgagcctgatctgcgccctggccctggcctacctggaccagagagccgagagaatcctgcacaaggagcagggcaagaccggcgaggtgatcaagctgaccgacgtgaaggacttcagcctgcccctgtggctgatcttcatcatctgcgtgtgctactacgtggccgtgttccccttcatcggcctgggcaaggtgttcttcaccgagaagttcggcttcagcagccaggccgccagcgccatcaacagcgtggtgtacgtgatcagcgcccccatgagccccgtgttcggcctgctggtggacaagaccggcaagaacatcatctgggtgctgtgcgccgtggccgccaccctggtgagccacatgatgctggccttcaccatgtggaacccctggatcgccatgtgcctgctgggcctgagctacagcctgctggcctgcgccctgtggcccatggtggccttcgtggtgcccgagcaccagctgggcaccgcctacggcttcatgcagagcatccagaacctgggcctggccatcatcagcatcatcgccggcatgatcctggacagcagaggctacctgttcctggaggtgttcttcatcgcctgcgtgagcctgagcctgctgagcgtggtgctgctgtacctggtgaacagagcccagggcggcaacctgaactacagcgccagacagagagaggagatcaagttcagccacaccgagtag

SEQ ID NO: 19245 - DNA, 762 bp, Artificial Sequence
  Description of Artificial Sequence: Synthetic coding sequence
atggaggaggaggacgaggaggccagagccctgctggccggcggccccgacgaggccgacagaggcgcccccgccgcccccggcgccctgcccgccctgtgcgaccccagcagactggcccacagactgctggtgctgctgctgatgtgcttcctgggcttcggcagctacttctgctacgacaaccccgccgccctgcagacccaggtgaagagagacatgcaggtgaacaccaccaagttcatgctgctgtacgcctggtacagctggcccaacgtggtgctgtgcttcttcggcggcttcctgatcgacagagtgttcggcagcaccgtgaacatgaacctgatgggctggctgtacagcaagatcgaggccctgctgggcagcgccggccacaccaccctgggcatcaccctgatgatcggcggcatcacctgcatcctgagcctgatctgcgccctggccctggcctacctggaccagagagccgagagaatcctgcacaaggagcagggcaagaccggcgaggtgatcaagctgaccgacgtgaaggacttcagcctgcccctgtggctgatcttcatcatctgcgtgtgctactacgtggccgtgttccccttcatcggcctgggcaaggtgttcttcaccgagaagttcggcttcagcagccaggccgccagcgccatcaacagcgtggtgtacgtgatcagcgcccccatgagccccgtgttcggcctgctggtggacaagaccggcaagtag

SEQ ID NO: 19246 - DNA, 1428 bp, Artificial Sequence
  Description of Artificial Sequence: Synthetic coding sequence
atgggcgtggccctgagagacctgcccggcagacacgtgagcagcagaagccacgtgaccgccgtgctgaccgtgttccacggcagatgcttcctgcccggcttcggcgtggtgaccaccttccccagccccagccccgccggcgccatggaggaggaggacgaggaggccagagccctgctggccggcggccccgacgaggccgacagaggcgcccccgccgcccccggcgccctgcccgccctgtgcgaccccagcagactggcccacagactgctggtgctgctgctgatgtgcttcctgggcttcgccatcttcgccatgatcatcctgctgcccttcagactgaagctgaacgagtggggcaccatcatcttcagctgcttcgtgtgcatcggccaggtggtgttcgccctgggcggcatcttcaacgccttctggctgatggagttcggcagattcgtgttcggcatcggcggcgagagcctggccgtggcccagaacacctacgccgtgagctggttcaagggcaaggagctgaacctggtgttcggcctgcagctgagcatggccagaatcggcagcaccgtgaacatgaacctgatgggctggctgtacagcaagatcgaggccctgctgggcagcgccggccacaccaccctgggcatcaccctgatgatcggcggcatcacctgcatcctgagcctgatctgcgccctggccctggcctacctggaccagagagccgagagaatcctgcacaaggagcagggcaagaccggcgaggtgatcaagctgaccgacgtgaaggacttcagcctgcccctgtggctgatcttcatcatctgcgtgtgctactacgtggccgtgttccccttcatcggcctgggcaaggtgttcttcaccgagaagttcggcttcagcagccaggccgccagcgccatcaacagcgtggtgtacgtgatcagcgcccccatgagccccgtgttcggcctgctggtggacaagaccggcaagaacatcatctgggtgctgtgcgccgtggccgccaccctggtgagccacatgatgctggccttcaccatgtggaacccctggatcgccatgtgcctgctgggcctgagctacagcctgctggcctgcgccctgtggcccatggtggccttcgtggtgcccgagcaccagctgggcaccgcctacggcttcatgcagagcatccagaacctgggcctggccatcatcagcatcatcgccggcatgatcctggacagcagaggctacctgttcctggaggtgttcttcatcgcctgcgtgagcctgagcctgctgagcgtggtgctgctgtacctggtgaacagagcccagggcggcaacctgaactacagcgccagacagagagaggagatcaagttcagccacaccgagtag

SEQ ID NO: 19247 - DNA, 1545 bp, Artificial Sequence
  Description of Artificial Sequence: Synthetic coding sequence
atgggcgtggccctgagagacctgcccggcagacacgtgagcagcagaagccacgtgaccgccgtgctgaccgtgttccacggcagatgcttcctgcccggcttcggcgtggtgaccaccttccccagccccagccccgccggcgccatggaggaggaggacgaggaggccagagccctgctggccggcggccccgacgaggccgacagaggcgcccccgccgcccccggcgccctgcccgccctgtgcgaccccagcagactggcccacagactgctggtgctgctgctgatgtgcttcctgggcttcggcagctacttctgctacgacaaccccgccgccctgcagacccaggtgaagagagacatgcaggtgaacaccaccaagttcatgctgctgtacgcctggtacagctggcccaacgtggtgctgtgcttcttcggcggcttcctgatcgacagagtgttcggcatcagatggggcaccatcatcttcagctgcttcgtgtgcatcggccaggtggtgttcgccctgggcggcatcttcaacgccttctggctgatggagttcggcagattcgtgttcggcatcggcggcgagagcctggccgtggcccagaacacctacgccgtgagctggttcaagggcaaggagctgaacctggtgttcggcctgcagctgagcatggccagaatcggcagcaccgtgaacatgaacctgatgggctggctgtacagcaagatcgaggccctgctgggcagcgccggccacaccaccctgggcatcaccctgatgatcggcggcatcacctgcatcctgagcctgatctgcgccctggccctggcctacctggaccagagagccgagagaatcctgcacaaggagcagggcaagaccggcgaggtgatcaagctgaccgacgtgaaggacttcagcctgcccctgtggctgatcttcatcatctgcgtgtgctactacgtggccgtgttccccttcatcggcctgggcaaggtgttcttcaccgagaagttcggcttcagcagccaggccgccagcgccatcaacagcgtggtgtacgtgatcagcgcccccatgagccccgtgttcggcctgctggtggacaagaccggcaagaacatcatctgggtgctgtgcgccgtggccgccaccctggtgagccacatgatgctggccttcaccatgtggaacccctggatcgccatgtgcctgctgggcctgagctacagcctgctggcctgcgccctgtggcccatggtggccttcgtggtgcccgagcaccagctgggcaccgcctacggcttcatgcagagcatccagaacctgggcctggccatcatcagcatcatcgccggcatgatcctggacagcagaggctacctgttcctggaggtgttcttcatcgcctgcgtgagcctgagcctgctgagcgtggtgctgctgtacctggtgaacagagcccagggcggcaacctgaactacagcgccagacagagagaggagatcaagttcagccacaccgagtag

SEQ ID NO: 19248 - DNA, 1368 bp, Artificial Sequence
  Description of Artificial Sequence: Synthetic coding sequence
atgggctggggcggcggcggcggctgcacccccagaccccccatccaccagcagccccccgagagaagagtggtgaccgtggtgttcctgggcctgctgctggacctgctggccttcaccctgctgctgcccctgctgcccggcctgctggagagccacggcagagcccacgaccccctgtacggcagctggcagggcggcgtggactggttcgccaccgccatcggcatgcccgtggagaagagatacaacagcgtgctgttcggcggcctgatcggcagcgccttcagcgtgctgcagttcctgtgcgcccccctgaccggcgccaccagcgactgcctgggcagaagacccgtgatgctgctgtgcctgatgggcgtggccaccagctacgccgtgtgggccaccagcagaagcttcgccgccttcctggccagcagactgatcggcggcatcagcaagggcaacgtgagcctgagcaccgccatcgtggccgacctgggcagccccctggccagaagccagggcatggccgtgatcggcgtggccttcagcctgggcttcaccctgggccccatgctgggcgccagcctgcccctggagatggccccctggttcgccctgctgttcgccgccagcgacctgctgttcatcttctgcttcctgcccgagaccctgcccctggagaagagagcccccagcatcgccctgggcttcagagacgccgccgacctgctgagccccctggccctgctgagattcagcgccgtggccagaggccaggacccccccagcggcgacagactgagcagcctgagaagactgggcctggtgtacttcctgtacctgttcctgttcagcggcctggagtacaccctgagcttcctgacccaccagagattccagttcagcagcctgcagcagggcaagatgttcttcctgatcggcctgaccatggccaccatccagggcgcctacgccagaagaatccaccccggcggcgaggtggccgccgtgaagagagccctgctgctgctggtgcccgccttcctgctgatcggctggggcagaagcctgcccgtgctgggcctgggcctgctgctgtacagcttcgccgccgccgtggtggtgccctgcctgagcagcgtggtggccggctacggcagccccggccagaagggcaccgtgatgggcaccctgagaagcctgggcgccctggccagagccgccggccccctggtggccgccagcgtgtactggctggccggcgcccaggcctgcttcaccacctggagcggcctgttcctgctgcccttcttcctgctgcagaagctgagctaccccgcccagaccctgaaggccgagtag

SEQ ID NO: 19249 - DNA, 1368 bp, Artificial Sequence; identical to SEQ ID NO: 19248
  Description of Artificial Sequence: Synthetic coding sequence

SEQ ID NO: 19250 - DNA, 1350 bp, Artificial Sequence
  Description of Artificial Sequence: Synthetic coding sequence
atgagccccgagagcaagaagctgttcaacatcatcatcctgggcgtggccttcatgttcatgttcaccgccttccagacctgcggcaacgtggcccagaccgtgatcagaagcctgaacagaaccgacttccacggcagcggctacaccagcatggccatcatctacggcgtgttcagcgccagcaacctgatcacccccagcgtggtggccatcgtgggcccccagctgagcatgttcgccagcggcctgttctacagcatgtacatcgccgtgttcatccagcccttcccctggagcttctacaccgccagcgtgttcatcggcatcgccgccgccgtgctgtggaccgcccagggcaactgcctgaccatcaacagcgacgagcacagcatcggcagaaacagcggcatcttctgggccctgctgcagagcagcctgttcttcggcaacctgtacatctacttcgcctggcagggcaagacccagatcagcgagagcgacagaagaaccgtgttcatcgccctgaccgtgatcagcctggtgggcaccgtgctgttcttcctgatcagaaagcccgacagcgagaacgtgctgggcgaggacgagagcagcgacgaccaggacatggaggtgaacgagagcgcccagaacaacctgaccaaggccgtggacgccttcaagaagagcttcaagctgtgcgtgaccaaggagatgctgctgctgagcatcaccaccgcctacaccggcctggagctgaccttcttcagcggcgtgtacggcacctgcatcggcgccaccaacaagttcggcgccgaggagaagagcctgatcggcctgagcggcatcttcatcggcatcggcgagatcctgggcggcagcctgttcggcctgctgagcaagaacaacagattcggcagaaaccccgtggtgctgctgggcatcctggtgcacttcatcgccttctacctgatcttcctgaacatgcccggcgacgcccccatcgcccccgtgaagggcaccgacagcagcgcctacatcaagagcagcaaggaggtggccatcctgtgcagcttcctgctgggcctgggcgacagctgcttcaacacccagctgctgagcatcctgggcttcctgtacagcgaggacagcgcccccgccttcgccatcttcaagttcgtgcagagcatctgcgccgccgtggccttcttctacagcaactacctgctgctgcactggcagctgctggtgatggtgatcttcggcttcttcggcaccatcagcttcttcaccgtggagtgggaggccgccgccttcgtggccagaggcagcgactacagaagcatctag

SEQ ID NO: 19251 - DNA, 1194 bp, Artificial Sequence
  Description of Artificial Sequence: Synthetic coding sequence
atgagccccgagagcaagaagctgttcaacatcatcatcctgggcgtggccttcatgttcatgttcaccgccttccagacctgcggcaacgtggcccagaccgtgatcagaagcctgaacagaaccgacttccacggcagcggctacaccagcatggccatcatctacggcgtgttcagcgccagcaacctgatcacccccagcgtggtggccatcgtgggcccccagctgagcatgttcgccagcggcctgttctacagcatgtacatcgccgtgttcatccagcccttcccctggagcttctacaccgccagcgtgttcatcggcatcgccgccgccgagagcgacagaagaaccgtgttcatcgccctgaccgtgatcagcctggtgggcaccgtgctgttcttcctgatcagaaagcccgacagcgagaacgtgctgggcgaggacgagagcagcgacgaccaggacatggaggtgaacgagagcgcccagaacaacctgaccaaggccgtggacgccttcaagaagagcttcaagctgtgcgtgaccaaggagatgctgctgctgagcatcaccaccgcctacaccggcctggagctgaccttcttcagcggcgtgtacggcacctgcatcggcgccaccaacaagttcggcgccgaggagaagagcctgatcggcctgagcggcatcttcatcggcatcggcgagatcctgggcggcagcctgttcggcctgctgagcaagaacaacagattcggcagaaaccccgtggtgctgctgggcatcctggtgcacttcatcgccttctacctgatcttcctgaacatgcccggcgacgcccccatcgcccccgtgaagggcaccgacagcagcgcctacatcaagagcagcaaggaggtggccatcctgtgcagcttcctgctgggcctgggcgacagctgcttcaacacccagctgctgagcatcctgggcttcctgtacagcgaggacagcgcccccgccttcgccatcttcaagttcgtgcagagcatctgcgccgccgtggccttcttctacagcaactacctgctgctgcactggcagctgctggtgatggtgatcttcggcttcttcggcaccatcagcttcttcaccgtggagtgggaggccgccgccttcgtggccagaggcagcgactacagaagcatctag

SEQ ID NO: 19252 - DNA, 1443 bp, Artificial Sequence
  Description of Artificial Sequence: Synthetic coding sequence
atgggccccggcccccccgccgccggcgccgcccccagccccagacccctgagcctggtggccagactgagctacgccgtgggccacttcctgaacgacctgtgcgccagcatgtggttcacctacctgctgctgtacctgcacagcgtgagagcctacagcagcagaggcgccggcctgctgctgctgctgggccaggtggccgacggcctgtgcacccccctggtgggctacgaggccgacagagccgccagctgctgcgccagatacggccccagaaaggcctggcacctggtgggcaccgtgtgcgtgctgctgagcttccccttcatcttcagcccctgcctgggctgcggcgccgccacccccgagtgggccgccctgctgtactacggccccttcatcgtgatcttccagttcggctgggccagcacccagatcagccacctgagcctgatccccgagctggtgaccaacgaccacgagaaggtggagctgaccgccctgagatacgccttcaccgtggtggccaacatcaccgtgtacggcgccgcctggctgctgctgcacctgcagggcagcagcagagtggagcccacccaggacatcagcatcagcgaccagctgggcggccaggacgtgcccgtgttcagaaacctgagcctgctggtggtgggcgtgggcgccgtgttcagcctgctgttccacctgggcaccagagagagaagaagaccccacgccgaggagcccggcgagcacacccccctgctggcccccgccaccgcccagcccctgctgctgtggaagcactggctgagagagcccgccttctaccaggtgggcatcctgtacatgaccaccagactgatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcagaaacatgacctacttcagcggcctgctggtgatcctggccttcgccgcctgggtggccctggccgagggcctgggcgtggccgtgtacgccgccgccgtgctgctgggcgccggctgcgccaccatcctggtgaccagcctggccatgaccgccgacctgatcggcccccacaccaacagcggcgccttcgtgtacggcagcatgagcttcctggacaaggtggccaacggcctggccgtgatggccatccagagcctgcacccctgccccagcgagctgtgctgcagagcctgcgtgagcttctaccactgggccatggtggccgtgaccggcggcgtgggcgtggccgccgccctgtgcctgtgcagcctgctgctgtggcccaccagactgagaagatgggacagagacgccagaccctag

SEQ ID NO: 19253 - DNA, 1422 bp, Artificial Sequence
  Description of Artificial Sequence: Synthetic coding sequence
atgggccccggcccccccgccgccggcgccgcccccagccccagacccctgagcctggtggccagactgagctacgccgtgggccacttcctgaacgacctgtgcgccagcatgtggttcacctacctgctgctgtacctgcacagcgtgagagcctacagcagcagaggcgccggcctgctgctgctgctgggccaggtggccgacggcctgtgcacccccctggtgggctacgaggccgacagagccgccagctgctgcgccagatacggccccagaaaggcctggcacctggtgggcaccgtgtgcgtgctgctgagcttccccttcatcttcagcccctgcctgggctgcggcgccgccacccccgagtgggccgccctgctgtactacggccccttcatcgtgatcttccagttcggctgggccagcacccagatcagccacctgagcctgatccccgagctggtgaccaacgaccacgagaaggtggagctgaccgccctgagatacgccttcaccgtggtggccaacatcaccgtgtacggcgccgcctggctgctgctgcacctgcagggcagcagcagagtggagcccacccaggacatcagcatcagcgaccagctgggcggccaggacgtgcccgtgttcagaaacctgagcctgctggtggtgggcgtgggcgccgtgttcagcctgctgttccacctgggcaccagagagagaagaagaccccacgccgaggagcccggcgagcacacccccctgctggcccccgccaccgcccagcccctgctgctgtggaagcactggctgagagagcccgccttctaccaggtgggcatcctgtacatgaccaccagactgatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcagaaacatgacctacttcagcggcctgctggtgatcctggccttcgccgcctgggtggccctggccgagggcctgggcgtggccgtgtacgccgccgccgtgctgctgggcgccggctgcgccaccatcctggtgaccagcctggccatgaccgccgacctgatcggcccccacaccaacagcggcgccttcgtgtacggcagcatgagcttcctggacaaggtggccaacggcctggccgtgatggccatccagagcctgcacccctgccccagcgagctgtgctgcagagcctgcgtgagcttctaccactgggccatggtggccgtgaccggcggcgtgggcgtggccgccgccctgtgcctgtgcagcctgctgctgtggcccaccagactgagaagatag

SEQ ID NO: 19254 - DNA, 1617 bp, Artificial Sequence
  Description of Artificial Sequence: Synthetic coding sequence
atgggccccggcccccccgccgccggcgccgcccccagccccagacccctgagcctggtggccagactgagctacgccgtgggccacttcctgaacgacctgtgcgccagcatgtggttcacctacctgctgctgtacctgcacagcgtgagagcctacagcagcagaggcgccggcctgctgctgctgctgggccaggtggccgacggcctgtgcacccccctggtgggctacgaggccgacagagccgccagctgctgcgccagatacggccccagaaaggcctggcacctggtgggcaccgtgtgcgtgctgctgagcttccccttcatcttcagcccctgcctgggctgcggcgccgccacccccgagtgggccgccctgctgtactacggccccttcatcgtgatcttccagttcggctgggccagcacccagatcagccacctgagcctgatccccgagctggtgaccaacgaccacgagaaggtggagctgaccgccctgagatacgccttcaccgtggtggccaacatcaccgtgtacggcgccgcctggctgctgctgcacctgcagggcagcagcagagtggagcccacccaggacatcagcatcagcgaccagctgggcggccaggacgtgcccgtgttcagaaacctgagcctgctggtggtgggcgtgggcgccgtgttcagcctgctgttccacctgggcaccagagagagaagaagaccccacgccgaggagcccggcgagcacacccccctgctggcccccgccaccgcccagcccctgctgctgtggaagcactggctgagagagcccgccttctaccaggtgggcatcctgtacatgaccaccagactgatcgtgaacctgagccagacctacatggccatgtacctgacctacagcctgcacctgcccaagaagttcatcgccaccatccccctggtgatgtacctgagcggcttcctgagcagcttcctgatgaagcccatcaacaagtgcatcggcagaaacatgacctacttcagcggcctgctggtgatcctggccttcgccgcctgggtggccctggccgagggcctgggcgtggccgtgtacgccgccgccgtgctgctgggcgccggctgcgccaccatcctggtgaccagcctggccatgaccgccgacctgatcggcccccacaccaacagcggcgccttcgtgtacggcagcatgagcttcctggacaaggtggccaacggcctggccgtgatggccatccagagcctgcacccctgccccagcgagctgtgctgcagagcctgcgtgagcttctaccactgggccatggtggccgtgaccggcggcgtgggcgtggccgccgccctgtgcctgtgcagcctgctgctgtggcccaccagactgagaagaagcttcctggcctggagaagaggcagaggcgaggacaagggccccggctacagctggatccccaccgtgctggtgcagccccccagacccaccagccccttcctgtgggaggcccccctggcctggagatgcaccagaaagaagtggagcggcgccggcaccaagccctggcccagagaggactggggcacccactag

SEQ ID NO: 19255 - DNA, 1239 bp, Artificial Sequence
  Description of Artificial Sequence: Synthetic coding sequence
atgagaggcaagctgctgcccctggccggcctgtacctggtgcagggcctgccctacggcctgcagagcggcctgctgcccgtgctgctgagagccggcggcctgagcctgaccagagtgggcctggccaaggtgctgtacgccccctggctgctgaagctggcctgggcccccctggtggacgcccagggcagcgccagagcctgggtgaccagaagcaccgccggcctgggcctggtgtgcggcctgctggccggcctgcccccccccggcgccggccaggccggcctgcccgccgccgtggccggcctgctgctgctgctgaacctgggcgccgccatgcaggacgtggccctggacgccctggccgtgcagctgctggagcccgccgagctgggccccggcaacaccgtgcaggtggtggcctacaagctgggcgccgccctggccggcggcgccctgctggccctgctgcccaccttcagctggccccagctgttcctgctgctggccgccacctactggctggccgccgccctggcctgggccgcccccgccctgagaagactgccccagcagccccccagcgagcagagaccccacaccgcccacctgctgagagacgtgctggccgtgcccggcaccgtgtggaccgccggcttcgtgctgacctacaagctgggcgagcagggcgccagcagcctgttccccctgctgctgctggaccacggcgtgagcgcccccgagctgggcctgtggaacggcgtgggcgccgtggtgtgcagcatcgccggcagcagcctgggcggcaccctgctggccaagcactggaagctgctgcccctgctgagaagcgtgctgagattcagactgggcggcctggcctgccagaccgccctggtgttccacctggacaccctgggcgccagcatggacgccggcaccatcctgagaggcagcgccctgctgagcctgtgcctgcagcacttcctgggcggcctggtgaccaccgtgaccttcaccggcatgatgagatgcagccagctggcccccagagccctgcaggccacccactacagcctgctggccaccctggagctgctgggcaagctgctgctgggcaccctggccggcggcctggccgacggcctgggcccccacccctgcttcctgctgctgctgatcctgagcgccttccccgtgctgtacctggacctggcccccagcaccttcctgtag

SEQ ID NO: 19256 - DNA, 1545 bp, Artificial Sequence
  Description of Artificial Sequence: Synthetic coding sequence
atgggctgcgacggcagagtgagcggcctgctgagaagaaacctgcagcccaccctgacctactggagcgtgttcttcagcttcggcctgtgcatcgccttcctgggccccaccctgctggacctgagatgccagacccacagcagcctgccccagatcagctgggtgttcttcagccagcagctgtgcctgctgctgggcagcgccctgggcggcgtgttcaagagaaccctggcccagagcctgtgggccctgttcaccagcagcctggccatcagcctggtgttcgccgtgatccccttctgcagagacgtgaaggtgctggccagcgtgatggccctggccggcctggccatgggctgcatcgacaccgtggccaacatgcagctggtgagaatgtaccagaaggacagcgccgtgttcctgcaggtgctgcacttcttcgtgggcttcggcgccctgctgagccccctgatcgccgaccccttcctgagcgaggccaactgcctgcccgccaacagcaccgccaacaccaccagcagaggccacctgttccacgtgagcagagtgctgggccagcaccacgtggacgccaagccctggagcaaccagaccttccccggcctgacccccaaggacggcgccggcaccagagtgagctacgccttctggatcatggccctgatcaacctgcccgtgcccatggccgtgctgatgctgctgagcaaggagagactgctgacctgctgcccccagagaagacccctgctgctgagcgccgacgagctggccctggagacccagccccccgagaaggaggacgccagcagcctgccccccaagttccagagccacctgggccacgaggacctgttcagctgctgccagagaaagaacctgagaggcgccccctacagcttcttcgccatccacatcaccggcgccctggtgctgttcatgaccgacggcctgaccggcgcctacagcgccttcgtgtacagctacgccgtggagaagcccctgagcgtgggccacaaggtggccggctacctgcccagcctgttctggggcttcatcaccctgggcagactgctgagcatccccatcagcagcagaatgaagcccgccaccatggtgttcatcaacgtggtgggcgtggtggtgaccttcctggtgctgctgatcttcagctacaacgtggtgttcctgttcgtgggcaccgccagcctgggcctgttcctgagcagcaccttccccagcatgctggcctacaccgaggacagcctgcagtacaagggctgcgccaccaccgtgctggtgaccggcgccggcgtgggcgagatggtgctgcagatgctggtgggcagcatcttccaggcccagggcagctacagcttcctggtgtgcggcgtgatcttcggctgcctggccttcaccttctacatcctgctgctgttcttccacagaatgcaccccggcctgcccagcgtgcccacccaggacagaagcatcggcatggagaacagcgagtgctaccagagatag

SEQ ID NO: 19257 - DNA, 1284 bp, Artificial Sequence
  Description of Artificial Sequence: Synthetic coding sequence
atgggctgcgacggcagagtgagcggcctgctgagaagaaacctgcagcccaccctgacctactggagcgtgttcttcagcttcggcctgtgcatcgccttcctgggccccaccctgctggacctgagatgccagacccacagcagcctgccccagatcagctgggtgttcttcagccagcagctgtgcctgctgctgggcagcgccctgggcggcgtgttcaagagaaccctggcccagagcctgtgggccctgttcaccagcagcctggccatcagcctggtgttcgccgtgatccccttctgcagagacgtgaaggtgctggccagcgtgatggccctggccggcctggccatgggctgcatcgacaccgtggccaacatgcagctggtgagaatgtaccagaaggacagcgccgtgttcctgcagctgcccgtgcccatggccgtgctgatgctgctgagcaaggagagactgctgacctgctgcccccagagaagacccctgctgctgagcgccgacgagctggccctggagacccagccccccgagaaggaggacgccagcagcctgccccccaagttccagagccacctgggccacgaggacctgttcagctgctgccagagaaagaacctgagaggcgccccctacagcttcttcgccatccacatcaccggcgccctggtgctgttcatgaccgacggcctgaccggcgcctacagcgccttcgtgtacagctacgccgtggagaagcccctgagcgtgggccacaaggtggccggctacctgcccagcctgttctggggcttcatcaccctgggcagactgctgagcatccccatcagcagcagaatgaagcccgccaccatggtgttcatcaacgtggtgggcgtggtggtgaccttcctggtgctgctgatcttcagctacaacgtggtgttcctgttcgtgggcaccgccagcctgggcctgttcctgagcagcaccttccccagcatgctggcctacaccgaggacagcctgcagtacaagggctgcgccaccaccgtgctggtgaccggcgccggcgtgggcgagatggtgctgcagatgctggtgggcagcatcttccaggcccagggcagctacagcttcctggtgtgcggcgtgatcttcggctgcctggccttcaccttctacatcctgctgctgttcttccacagaatgcaccccggcctgcccagcgtgcccacccaggacagaagcatcggcatggagaacagcgagtgctaccagagatag

SEQ ID NO: 19258 - DNA, 1323 bp, Artificial Sequence
  Description of Artificial Sequence: Synthetic coding sequence
atgggctgcgacggcagagtgagcggcctgctgagaagaaacctgcagcccaccctgacctactggagcgtgttcttcagcttcggcctgtgcatcgccttcctgggccccaccctgctggacctgagatgccagacccacagcagcctgccccagatcagctgggtgttcttcagccagcagctgtgcctgctgctgggcagcgccctgggcggcgtgttcaagagaaccctggcccagagcctgtgggccctgttcaccagcagcctggccatcagcctggtgttcgccgtgatccccttctgcagagacgtgaaggtgctggccagcgtgatggccctggccggcctggccatgggctgcatcgacaccgtggccaacatgcagctggtgagaatgtaccagaaggacagcgccgtgttcctgcaggtgctgcacttcttcgtgggcttcggcgccctgctgagccccctgatcgccgaccccttcctgagcgaggccaactgcctgcccgccaacagcaccgccaacaccaccagcagaggccacctgttccacgtgagcagagtgctgggccagcaccacgtggacgccaagccctggagcaaccagaccttccccggcctgacccccaaggacggcgccggcaccagagtgagctacgccttctggatcatggccctgatcaacctgcccgtgcccatggccgtgctgatgctgctgagcaaggagagactgctgacctgctgcccccagagaagacccctgctgctgagcgccgacgagctggccctggagacccagccccccgagaaggaggacgccagcagcctgccccccaagttccagagccacctgggccacgaggacctgttcagctgctgccagagaaagaacctgagaggcgccccctacagcttcttcgccatccacatcaccggcgccctggtgctgttcatgaccgacggcctgaccggcgcctacagcgccttcgtgtacagctacgccgtggagaagcccctgagcgtgggccacaaggtggccggctacctgcccagcctgttctggggcttcatcaccctgggcagactgctgagcatccccatcagcagcagaatgaagcccgccaccatggtgttcatcaacgtggtgggcgtggtggtgaccttcctggtgctgctgatcttcagctacaacgtggtgttcctgttcgtgggcaccgccagcctgggcctgttcctgagcagcaccttccccagcatgctggcctacaccgaggacagcctgcagtacaaggacatccccggcagcggccagctgtag

SEQ ID NO: 19259 - DNA, 1299 bp, Artificial Sequence
  Description of Artificial Sequence: Synthetic coding sequence
atggaggtgaccgccgtgggcgaggaggccaaccagggcgacctgctgggcttcggccagagatgctgcagcctgggcagcagcaacccctggctgtacagaaccgccggcatcttccccgagcactgcaccgaggagaagaagatcggcacctacttcagagtggccccccaggccagcaagagccagagaagcagatgccacggcatggccgccagcgaggccagacccggcgaggccaccgccgccagctacggcagacccttccccacccaccccagaagacaggagttcagagccagagtggtgagaggccccaccatgctggtgaccgcctacctggccttcgtgggcctgctggccagctgcctgggcctggagctgagcagatgcagagccaagccccccggcagagcctgcagcaaccccagcttcctgagattccagctggacttctaccaggtgtacttcctggccctggccgccgactggctgcaggccccctacctgtacaagctgtaccagcactactacttcctggagggccagatcgccatcctgtacgtgtgcggcctggccagcaccgtgctgttcggcctggtggccagcagcctggtggactggctgggcagaaagaacagctgcgtgctgttcagcctgacctacagcctgtgctgcctgaccaagctgagccaggactacttcgtgctgctggtgggcagagccctgggcggcctgagcaccgccctgctgttcagcgccttcgaggcctggtacatccacgagcacgtggagagacacgacttccccgccgagtggatccccgccaccttcgccagagccgccttctggaaccacgtgctggccgtggtggccggcgtggccgccgaggccgtggccagctggatcggcctgggccccgtggcccccttcgtggccgccatccccctgctggccctggccggcgccctggccctgagaaactggggcgagaactacgacagacagagagccttcagcagaacctgcgccggcggcctgagatgcctgctgagcgacagaagagtgctgctgctgggcaccatccaggccctgttcgagagcgtgatcttcatcttcgtgttcctgtggacccccgtgctggacccccacggcgcccccctgggcatcatcttcagcagcttcatggccgccagcctgctgggcagcagcctgtacagaatcgccaccagcaagagaaccgtgatcgagaagcaggccctgggcatctgcagcgccttcgccctgctgagctggtag

SEQ ID NO: 19260 - DNA, 1353 bp, Artificial Sequence
  Description of Artificial Sequence: Synthetic coding sequence
atgctggtgaccgcctacctggccttcgtgggcctgctggccagctgcctgggcctggagctgagcagatgcagagccaagccccccggcagagcctgcagcaaccccagcttcctgagattccagctggacttctaccaggtgtacttcctggccctggccgccgactggctgcaggccccctacctgtacaagctgtaccagcactactacttcctggagggccagatcgccatcctgtacgtgtgcggcctggccagcaccgtgctgttcggcctggtggccagcagcctggtggactggctgggcagaaagaacagctgcgtgctgttcagcctgacctacagcctgtgctgcctgaccaagctgagccaggactacttcgtgctgctggtgggcagagccctgggcggcctgagcaccgccctgctgttcagcgccttcgaggcctggtacatccacgagcacgtggagagacacgacttccccgccgagtggatccccgccaccttcgccagagccgccttctggaaccacgtgctggccgtggtggccggcgtggccgccgaggccgtggccagctggatcggcctgggccccgtggcccccttcgtggccgccatccccctgctggccctggccggcgccctggccctgagaaactggggcgagaactacgacagacagagagccttcagcagaacctgcgccggcggcctgagatgcctgctgagcgacagaagagtgctgctgctgggcaccatccaggccctgttcgagagcgtgatcttcatcttcgtgttcctgtggacccccgtgctggacccccacggcgcccccctgggcatcatcttcagcagcttcatggccgccagcctgctgggcagcagcctgtacagaatcgccaccagcaagagataccacctgcagcccatgcacctgctgagcctggccgtgctgatcgtggtgttcagcctgttcatgctgaccttcagcaccagccccggccaggagagccccgtggagagcttcatcgccttcctgctgatcgagctggcctgcggcctgtacttccccagcatgagcttcctgagaagaaaggtgatccccgagaccgagcaggccggcgtgctgaactggttcagagtgcccctgcacagcctggcctgcctgggcctgctggtgctgcacgacagcgacagaaagaccggcaccagaaacatgttcagcatctgcagcgccgtgatggtgatggccctgctggccgtggtgggcctgttcaccgtggtgagacacgacgccgagctgagagtgcccagccccaccgaggagccctacgcccccgagctgtag

SEQ ID NO: 19261 - DNA, 1674 bp, Artificial Sequence
  Description of Artificial Sequence: Synthetic coding sequence
atggaggtgaccgccgtgggcgaggaggccaaccagggcgacctgctgggcttcggccagagatgctgcagcctgggcagcagcaacccctggctgtacagaaccgccggcatcttccccgagcactgcaccgaggagaagaagatcggcacctacttcagagtggccccccaggccagcaagagccagagaagcagatgccacggcatggccgccagcgaggccagacccggcgaggccaccgccgccagctacggcagacccttccccacccaccccagaagacaggagttcagagccagagtggtgagaggccccaccatgctggtgaccgcctacctggccttcgtgggcctgctggccagctgcctgggcctggagctgagcagatgcagagccaagccccccggcagagcctgcagcaaccccagcttcctgagattccagctggacttctaccaggtgtacttcctggccctggccgccgactggctgcaggccccctacctgtacaagctgtaccagcactactacttcctggagggccagatcgccatcctgtacgtgtgcggcctggccagcaccgtgctgttcggcctggtggccagcagcctggtggactggctgggcagaaagaacagctgcgtgctgttcagcctgacctacagcctgtgctgcctgaccaagctgagccaggactacttcgtgctgctggtgggcagagccctgggcggcctgagcaccgccctgctgttcagcgccttcgaggcctggtacatccacgagcacgtggagagacacgacttccccgccgagtggatccccgccaccttcgccagagccgccttctggaaccacgtgctggccgtggtggccggcgtggccgccgaggccgtggccagctggatcggcctgggccccgtggcccccttcgtggccgccatccccctgctggccctggccggcgccctggccctgagaaactggggcgagaactacgacagacagagagccttcagcagaacctgcgccggcggcctgagatgcctgctgagcgacagaagagtgctgctgctgggcaccatccaggccctgttcgagagcgtgatcttcatcttcgtgttcctgtggacccccgtgctggacccccacggcgcccccctgggcatcatcttcagcagcttcatggccgccagcctgctgggcagcagcctgtacagaatcgccaccagcaagagataccacctgcagcccatgcacctgctgagcctggccgtgctgatcgtggtgttcagcctgttcatgctgaccttcagcaccagccccggccaggagagccccgtggagagcttcatcgccttcctgctgatcgagctggcctgcggcctgtacttccccagcatgagcttcctgagaagaaaggtgatccccgagaccgagcaggccggcgtgctgaactggttcagagtgcccctgcacagcctggcctgcctgggcctgctggtgctgcacgacagcgacagaaagaccggcaccagaaacatgttcagcatctgcagcgccgtgatggtgatggccctgctggccgtggtgggcctgttcaccgtggtgagacacgacgccgagctgagagtgcccagccccaccgaggagccctacgcccccgagctgtag

SEQ ID NO: 19262 - DNA, 1395 bp, Artificial Sequence
  Description of Artificial Sequence: Synthetic coding sequence
atggaggtgaccgccgtgggcgaggaggccaaccagggcgacctgctgggcttcggccagagatgctgcagcctgggcagcagcaacccctggctgtacagaaccgccggcatcttccccgagcactgcaccgaggagaagaagatcggcacctacttcagagtggccccccaggccagcaagagccagagaagcagatgccacggcatggccgccagcgaggccagacccggcgaggccaccgccgccagctacggcagacccttccccacccaccccagaagacaggagttcagagccagagtggtgagaggccccaccatgctggtgaccgcctacctggccttcgtgggcctgctggccagctgcctgggcctggagctgagcagatgcagagccaagccccccggcagagcctgcagcaaccccagcttcctgagattccagctggacttctaccaggtgtacttcctggccctggccgccgactggctgcaggccccctacctgtacaagctgtaccagcactactacttcctggagggccagatcgccatcctgtacgtgtgcggcctggccagcaccgtgctgttcggcctggtggccagcagcctggtggactggctgggcagaaagaacagctgcgtgctgttcagcctgacctacagcctgtgctgcctgaccaagctgagccaggactacttcgtgctgctggtgggcagagccctgggcggcctgagcaccgccctgctgttcagcgccttcgaggcctggtacatccacgagcacgtggagagacacgacttccccgccgagtggatccccgccaccttcgccagagccgccttctggaaccacgtgctggccgtggtggccggcgtggccgccgaggccgtggccagctggatcggcctgggccccgtggcccccttcgtggccgccatccccctgctggccctggccggcgccctggccctgagaaactggggcgagaactacgacagacagagagccttcagcagaacctgcgccggcggcctgagatgcctgctgagcgacagaagagtgctgctgctgggcaccatccaggccctgttcgagagcgtgatcttcatcttcgtgttcctgtggacccccgtgctggacccccacggcgcccccctgggcatcatcttcagcagcttcatggccgccagcctgctgggcagcagcctgtacagaatcgccaccagcaagagcgacagaaagaccggcaccagaaacatgttcagcatctgcagcgccgtgatggtgatggccctgctggccgtggtgggcctgttcaccgtggtgagacacgacgccgagctgagagtgcccagccccaccgaggagccctacgcccccgagctgtag

SEQ ID NO: 19263 - DNA, 1761 bp, Artificial Sequence
  Description of Artificial Sequence: Synthetic coding sequence
atgagcgccaaccccagatgggacatcagcagagccctgggcgtggccaagctgttccacctggtgtgcggcgtgagagaggcctgcgtgacccccttcctgaccctgtacctgagacagctgggcctggccgccccctgggtgggcaccctgatgggcaccaagcacctgatcgccgccttctgggcccccgtgtgcgccttcctggccaagagctacagaaagagaagagccctgctgatcggcagcctgctgggcagcgtgggcgccagcctgctgatggtgctggtgccccccgtggacaagaacagagtgcacttcccctgcaacggcagcagcggcctgaccagcaccgacgccctgcccggcgtgaccctgcccgtgaacatcaccagcgcccaggagagcgccagcagccaccccgccaagagaaccgccgaggtggagatgcccggcttcagaaacccccccggcgagagcgacagagagaccttcagagacctgcacgtgtacctggcccccagcgtggagggcgccagaaccaccagccaggccctgctgcaccccgtgaccagcggcctgaaggaccacccctgggaggtgaccttcgaggtggtgaagaccgccctgcccctgctgcccggcggcaagggccccggcaaccccgccaacctgagcggcaccaagggcaaggcctgggccttcgacctgagcctggaggccctgagaagaaccttcatcctgagcctgggcagcgtggccttctgggagctgctgaccgcccccctggagcaggtggccgacgacagcctgtacgagttcctggacttcgtggacgccaccgacagatacagaagcctgtgggtgtggagactgctgggcatgagcgccggcgtgtgcggcatcaccgccctggtgggccagctggactgcttcctgatgaccagcggccccagaggcgtggtgcacttctacggctacagcgtggtgagcaccctggccctgctggtgagcatcgccttccccatccccatctgccagcagtgggagcccagctacaagagagtgaaggccctgagcatcgtgggcggcgacccccacctgatcctgctggccagcaccaccgtgctggtgggcgccatcgtgagcaccgtgcagaacttcctgttctggcacatgaaggaccacggcagcggcgagctggtgatgggcttcagcgtggccctgagcctgctgggcgagatcctgctgcaccccttcaaggccaccctgctgagaaagctgagcagaaccggcctggtgggcctgggcctgagctgcctggccggccagctgctgtactacagcttcctgtggagctggtggagcgtgctgcccatccagatcctgagcgccatcagcaacagagccctgtggtgggccgtgggcgccagcgtggaggacctggccacccccagaatggagagagccctgagcgccctgttcagaggccacttctacggcagcggctgcagcctgggcagcttcgtgggcggcttcgtggtgatgagattcagcctggccgtgctgtaccaggcctgctgcgtggccctgctgctgtggctggccctgctgctgagcatccagagaagactgcccagagagagaaagatcaagtacagcaagctgctgagcatggaggtgagcgacaccagcgacagcgagcagggcaccgagcaggactggctggtgaaggccatgagagaggagcacagcgactag

SEQ ID NO: 19264 - DNA, 1680 bp, Artificial Sequence
  Description of Artificial Sequence: Synthetic coding sequence
atggccggccccaccgaggccgagaccggcctggccgagcccagagccctgtgcgcccagagaggccacagaacctacgccagaagatgggtgttcctgctggccatcagcctgctgaactgcagcaacgccaccctgtggctgagcttcgcccccgtggccgacgtgatcgccgaggacctggtgctgagcatggagcagatcaactggctgagcctggtgtacctggtggtgagcacccccttcggcgtggccgccatctggatcctggacagcgtgggcctgagagccgccaccatcctgggcgcctggctgaacttcgccggcagcgtgctgagaatggtgccctgcatggtggtgggcacccagaaccccttcgccttcctgatgggcggccagagcctgtgcgccctggcccagagcctggtgatcttcagccccgccaagctggccgccctgtggttccccgagcaccagagagccaccgccaacatgctggccaccatgagcaaccccctgggcgtgctggtggccaacgtgctgagccccgtgctggtgaagaagggcgaggacatccccctgatgctgggcgtgtacaccatccccgccggcgtggtgtgcctgctgagcaccatctgcctgtgggagagcgtgccccccaccccccccagcgccggcgccgccagcagcaccagcgagaagttcctggacggcctgaagctgctgatgtggaacaaggcctacgtgatcctggccgtgtgcctgggcggcatgatcggcatcagcgccagcttcagcgccctgctggagcagatcctgtgcgccagcggccacagcagcggcttcagcggcctgtgcggcgccctgttcatcaccttcggcatcctgggcgccctggccctgggcccctacgtggacagaaccaagcacttcaccgaggccaccaagatcggcctgtgcctgttcagcctggcctgcgtgcccttcgccctggtgagccagctgcagggccagaccctggccctggccgccacctgcagcctgctgggcctgttcggcttcagcgtgggccccgtggccatggagctggccgtggagtgcagcttccccgtgggcgagggcgccgccaccggcatgatcttcgtgctgggccaggccgagggcatcctgatcatgctggccatgaccgccctgaccgtgagaagaagcgagcccagcctgagcacctgccagcagggcgaggaccccctggactggaccgtgagcctgctgctgatggccggcctgtgcaccttcttcagctgcatcctggccgtgttcttccacaccccctacagaagactgcaggccgagagcggcgagccccccagcaccagaaacgccgtgggcggcgccgacagcggccccggcgtggacagaggcggcgccggcagagccggcgtgctgggccccagcaccgccacccccgagtgcaccgccagaggcgccagcctggaggaccccagaggccccggcagcccccaccccgcctgccacagagccacccccagagcccagggccccgccgccaccgacgcccccagcagacccggcagactggccggcagagtgcaggccagcagattcatcgaccccgccggcagccacagcagcttcagcagcccctgggtgatcacctag

SEQ ID NO: 19265 - DNA, 1326 bp, Artificial Sequence
  Description of Artificial Sequence: Synthetic coding sequence
atggccggccccaccgaggccgagaccggcctggccgagcccagagccctgtgcgcccagagaggccacagaacctacgccagaagatgggtgttcctgctggccatcagcctgctgaactgcagcaacgccaccatcaactggctgagcctggtgtacctggtggtgagcacccccttcggcgtggccgccatctggatcctggacagcgtgggcctgagagccgccctgggcgtgtacaccatccccgccggcgtggtgtgcctgctgagcaccatctgcctgtgggagagcgtgccccccaccccccccagcgccggcgccgccagcagcaccagcgagaagttcctggacggcctgaagctgcagctgatgtggaacaaggcctacgtgatcctggccgtgtgcctgggcggcatgatcggcatcagcgccagcttcagcgccctgctggagcagatcctgtgcgccagcggccacagcagcggcttcagcggcctgtgcggcgccctgttcatcaccttcggcatcctgggcgccctggccctgggcccctacgtggacagaaccaagcacttcaccgaggccaccaagatcggcctgtgcctgttcagcctggcctgcgtgcccttcgccctggtgagccagctgcagggccagaccctggccctggccgccacctgcagcctgctgggcctgttcggcttcagcgtgggccccgtggccatggagctggccgtggagtgcagcttccccgtgggcgagggcgccgccaccggcatgatcttcgtgctgggccaggccgagggcatcctgatcatgctggccatgaccgccctgaccgtgagaagaagcgagcccagcctgagcacctgccagcagggcgaggaccccctggactggaccgtgagcctgctgctgatggccggcctgtgcaccttcttcagctgcatcctggccgtgttcttccacaccccctacagaagactgcaggccgagagcggcgagccccccagcaccagaaacgccgtgggcggcgccgacagcggccccggcgtggacagaggcggcgccggcagagccggcgtgctgggccccagcaccgccacccccgagtgcaccgccagaggcgccagcctggaggaccccagaggccccggcagcccccaccccgcctgccacagagccacccccagagcccagggccccgccgccaccgacgcccccagcagacccggcagactggccggcagagtgcaggccagcagattcatcgaccccgccggcagccacagcagcttcagcagcccctgggtgatcacctag

SEQ ID NO: 19266 - DNA, 1683 bp, Artificial Sequence
  Description of Artificial Sequence: Synthetic coding sequence
atggccggccccaccgaggccgagaccggcctggccgagcccagagccctgtgcgcccagagaggccacagaacctacgccagaagatgggtgttcctgctggccatcagcctgctgaactgcagcaacgccaccctgtggctgagcttcgcccccgtggccgacgtgatcgccgaggacctggtgctgagcatggagcagatcaactggctgagcctggtgtacctggtggtgagcacccccttcggcgtggccgccatctggatcctggacagcgtgggcctgagagccgccaccatcctgggcgcctggctgaacttcgccggcagcgtgctgagaatggtgccctgcatggtggtgggcacccagaaccccttcgccttcctgatgggcggccagagcctgtgcgccctggcccagagcctggtgatcttcagccccgccaagctggccgccctgtggttccccgagcaccagagagccaccgccaacatgctggccaccatgagcaaccccctgggcgtgctggtggccaacgtgctgagccccgtgctggtgaagaagggcgaggacatccccctgatgctgggcgtgtacaccatccccgccggcgtggtgtgcctgctgagcaccatctgcctgtgggagagcgtgccccccaccccccccagcgccggcgccgccagcagcaccagcgagaagttcctggacggcctgaagctgcagctgatgtggaacaaggcctacgtgatcctggccgtgtgcctgggcggcatgatcggcatcagcgccagcttcagcgccctgctggagcagatcctgtgcgccagcggccacagcagcggcttcagcggcctgtgcggcgccctgttcatcaccttcggcatcctgggcgccctggccctgggcccctacgtggacagaaccaagcacttcaccgaggccaccaagatcggcctgtgcctgttcagcctggcctgcgtgcccttcgccctggtgagccagctgcagggccagaccctggccctggccgccacctgcagcctgctgggcctgttcggcttcagcgtgggccccgtggccatggagctggccgtggagtgcagcttccccgtgggcgagggcgccgccaccggcatgatcttcgtgctgggccaggccgagggcatcctgatcatgctggccatgaccgccctgaccgtgagaagaagcgagcccagcctgagcacctgccagcagggcgaggaccccctggactggaccgtgagcctgctgctgatggccggcctgtgcaccttcttcagctgcatcctggccgtgttcttccacaccccctacagaagactgcaggccgagagcggcgagccccccagcaccagaaacgccgtgggcggcgccgacagcggccccggcgtggacagaggcggcgccggcagagccggcgtgctgggccccagcaccgccacccccgagtgcaccgccagaggcgccagcctggaggaccccagaggccccggcagcccccaccccgcctgccacagagccacccccagagcccagggccccgccgccaccgacgcccccagcagacccggcagactggccggcagagtgcaggccagcagattcatcgaccccgccggcagccacagcagcttcagcagcccctgggtgatcacctag

SEQ ID NO: 19267 - DNA, 1425 bp, Artificial Sequence
  Description of Artificial Sequence: Synthetic coding sequence
atggagctgggcggccactgggacatgaacagcgcccccagactggtgagcgagaccgccgagagaaagcaggagcagaagaccggcaccgaggccgaggccgccgacagcggcgccgtgggcgccagaagattcctgctgtgcctgtacctggtgggcttcctggacctgttcggcgtgagcatggtggtgcccctgctgagcctgcacgtgaagagcctgggcgccagccccaccgtggccggcatcgtgggcagcagctacggcatcctgcagctgttcagcagcaccctggtgggctgctggagcgacgtggtgggcagaagaagcagcctgctggcctgcatcctgctgagcgccctgggctacctgctgctgggcgccgccaccaacgtgttcctgttcgtgctggccagagtgcccgccggcatcttcaagcacaccctgagcatcagcagagccctgctgagcgacgtggtgcccgagaaggagagacccctggtgatcggccacttcaacaccgccagcggcgtgggcttcatcctgggccccgtggtgggcggctacctgaccgagctggaggacggcttctacctgaccgccttcatctgcttcctggtgttcatcctgaacgccggcctggtgtggttcttcccctggagagaggccaagcccggcagcaccgagaagggcctgcccctgagaaagacccacgtgctgctgggcagaagccacgacaccgtgcaggaggccgccaccagcagaagagccagagccagcaagaagaccgcccagccctgggtggaggtggtgctggccctgagaaacatgaagaacctgctgttcagcgagatgtgggacatcttcctggtgagactgctgatggccatggccgtgatgctgtactacagcaacttcgtgctggccctggaggagagattcggcgtgagacccaaggtgaccggctacctgatcagctacagcagcatgctgggcgccgtggccggcctggccctgggccccatcctgagactgtacaagcacaacagccaggccctgctgctgcacagcagcatcctgacctgcaccctgctgctgctgtacagcctggcccccaccatgggcgccgtggtgctgagcagcaccctgctgagcttcagcaccgccatcggcagaacctgcatcaccgacctgcagctgaccgtgggcggcgcccaggccagcggcaccctgatcggcgtgggccagagcgtgaccgccgtgggcagaatcatcgcccccctgctgagcggcgtggcccaggaggtgagcccctgcggcccccccagcctgggcgccgtgctggccctggtggccatcttcatcatgagcctgaacaagagacacagcagcggcgacggcaacagcaagctgaagagcgagtag

SEQ ID NO: 19268 - DNA, 465 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccagagccagaccgacagagtggacctgggcaccctgagaggctactacaaccagagcgaggccggcagccacaccatccagatcatgtacggctgcgacgtgggcagcgacggcagattcctgagaggctacagactgagaagccccagcgccagcggcagaagacccatgagaagaagcagctag

SEQ ID NO: 19269 - DNA, 900 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccagagccagaccgacagagtggacctgggcaccctgagaggctactacaaccagagcgaggccggcagccacaccatccagatcatgtacggctgcgacgtgggcagcgacggcagattcctgagaggctacagacaggacgcctacgacggcaaggactacatcgccctgaacgaggacctgagaagctggaccgccgccgacatggccgcccagatcaccaagagaaagtgggaggccgcccacgaggccgagcagctgagagcctacctggacggcacctgcgtggagtggctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggtgtag

SEQ ID NO: 19270 - DNA, 1116 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccagagccagaccgacagagtggacctgggcaccctgagaggctactacaaccagagcgaggccggcagccacaccatccagatcatgtacggctgcgacgtgggcagcgacggcagattcctgagaggctacagacaggacgcctacgacggcaaggactacatcgccctgaacgaggacctgagaagctggaccgccgccgacatggccgcccagatcaccaagagaaagtgggaggccgcccacgaggccgagcagctgagagcctacctggacggcacctgcgtggagtggctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggagctgagcagccagcccaccatccccatcgtgggcatcatcgccggcctggtgctgctgggcgccgtgatcaccggcgccgtggtggccgccgtgatgtggagaagaaagagcagcggcggcgagggcgtgaaggacagaaagggcggcagctacacccaggccgccagcagcgacagcgcccagggcagcgacgtgagcctgaccgcctgcaaggtgtag

SEQ ID NO: 19271 - DNA, 1098 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccagagccagaccgacagagtggacctgggcaccctgagaggctactacaaccagagcgaggccggcagccacaccatccagatcatgtacggctgcgacgtgggcagcgacggcagattcctgagaggctacagacaggacgcctacgacggcaaggactacatcgccctgaacgaggacctgagaagctggaccgccgccgacatggccgcccagatcaccaagagaaagtgggaggccgcccacgaggccgagcagctgagagcctacctggacggcacctgcgtggagtggctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggagctgagcagccagcccaccatccccatcgtgggcatcatcgccggcctggtgctgctgggcgccgtgatcaccggcgccgtggtggccgccgtgatgtggagaagaaagagcagcgacagaaagggcggcagctacacccaggccgccagcagcgacagcgcccagggcagcgacgtgagcctgaccgcctgcaaggtgtag

SEQ ID NO: 19272 - DNA, 900 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttctacaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacagaaacaccagaaacgtgaaggcccacagccagaccgacagagccaacctgggcaccctgagaggctactacaaccagagcgaggacggcagccacaccatccagagaatgtacggctgcgacgtgggccccgacggcagattcctgagaggctaccagcaggacgcctacgacggcaaggactacatcgccctgaacgaggacctgagaagctggaccgccgccgacatggccgcccagatcacccagagaaagtgggagaccgcccacgaggccgagcagtggagagcctacctggagggcagatgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggtgtag

SEQ ID NO: 19273 - DNA, 1098 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttctacaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacagaaacaccagaaacgtgaaggcccacagccagaccgacagagccaacctgggcaccctgagaggctactacaaccagagcgaggacggcagccacaccatccagagaatgtacggctgcgacgtgggccccgacggcagattcctgagaggctaccagcaggacgcctacgacggcaaggactacatcgccctgaacgaggacctgagaagctggaccgccgccgacatggccgcccagatcacccagagaaagtgggagaccgcccacgaggccgagcagtggagagcctacctggagggcagatgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcgccggcgccgtggtggccgccgtgatgtggagaagaaagagcagcgacagaaagggcggcagctacagccaggccgccagcagcgacagcgcccagggcagcgacatgagcctgaccgcctgcaaggtgtag

SEQ ID NO: 19274 - DNA, 1116 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttctacaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacagaaacaccagaaacgtgaaggcccacagccagaccgacagagccaacctgggcaccctgagaggctactacaaccagagcgaggacggcagccacaccatccagagaatgtacggctgcgacgtgggccccgacggcagattcctgagaggctaccagcaggacgcctacgacggcaaggactacatcgccctgaacgaggacctgagaagctggaccgccgccgacatggccgcccagatcacccagagaaagtgggagaccgcccacgaggccgagcagtggagagcctacctggagggcagatgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcgccggcgccgtggtggccgccgtgatgtggagaagaaagagcagcggcggcgagggcatgaaggacagaaagggcggcagctacagccaggccgccagcagcgacagcgcccagggcagcgacatgagcctgaccgcctgcaaggtgtag

SEQ ID NO: 19275 - DNA, 1098 bp, Artificial Sequence; identical to SEQ ID NO: 19271
  Description of Artificial Sequence: Synthetic coding sequence

SEQ ID NO: 19276 - DNA, 900 bp, Artificial Sequence
  Description of Artificial Sequence: Synthetic coding sequence
tgagccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggtgtag

SEQ ID NO: 19277 - DNA, 900 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccacagccagaccgacagagagagcctgagaatcgccctgagatactacaaccagagcgaggccggcagccacaccatccagatgatgtacggctgcgacgtgggccccgacggcagactgctgagaggctaccagcaggacgcctacgacggcaaggactacatcgccctgaacgaggacctgagaagctggaccgccgccgacatggccgcccagatcacccagagaaagtgggaggccgccagagtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggtgtag

SEQ ID NO: 19278 - DNA, 900 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagaagatggagcccagagccccctggatcgagcaggagggccccgagtactgggaccaggagaccagaaacatgaaggcccacagccagaccgacagagccaacctgggcaccctgagaggctactacaaccagagcgaggacggcagccacaccatccagatcatgtacggctgcgacgtgggccccgacggcagattcctgagaggctacagacaggacgcctacgacggcaaggactacatcgccctgaacgaggacctgagaagctggaccgccgccgacatggccgcccagatcaccaagagaaagtgggaggccgtgcacgccgccgagcagagaagagtgtacctggagggcagatgcgtggacggcctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggtgtag

SEQ ID NO: 19279 - DNA, 1116 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagaagatggagcccagagccccctggatcgagcaggagggccccgagtactgggaccaggagaccagaaacatgaaggcccacagccagaccgacagagccaacctgggcaccctgagaggctactacaaccagagcgaggacggcagccacaccatccagatcatgtacggctgcgacgtgggccccgacggcagattcctgagaggctacagacaggacgcctacgacggcaaggactacatcgccctgaacgaggacctgagaagctggaccgccgccgacatggccgcccagatcaccaagagaaagtgggaggccgtgcacgccgccgagcagagaagagtgtacctggagggcagatgcgtggacggcctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggagctgagcagccagcccaccatccccatcgtgggcatcatcgccggcctggtgctgctgggcgccgtgatcaccggcgccgtggtggccgccgtgatgtggagaagaaagagcagcggcggcgagggcgtgaaggacagaaagggcggcagctacacccaggccgccagcagcgacagcgcccagggcagcgacgtgagcctgaccgcctgcaaggtgtag

SEQ ID NO: 19280 - DNA, 1098 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagaagatggagcccagagccccctggatcgagcaggagggccccgagtactgggaccaggagaccagaaacatgaaggcccacagccagaccgacagagccaacctgggcaccctgagaggctactacaaccagagcgaggacggcagccacaccatccagatcatgtacggctgcgacgtgggccccgacggcagattcctgagaggctacagacaggacgcctacgacggcaaggactacatcgccctgaacgaggacctgagaagctggaccgccgccgacatggccgcccagatcaccaagagaaagtgggaggccgtgcacgccgccgagcagagaagagtgtacctggagggcagatgcgtggacggcctgagaagatacctggagaacggcaaggagaccctgcagagaaccgacccccccaagacccacatgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggagctgagcagccagcccaccatccccatcgtgggcatcatcgccggcctggtgctgctgggcgccgtgatcaccggcgccgtggtggccgccgtgatgtggagaagaaagagcagcgacagaaagggcggcagctacacccaggccgccagcagcgacagcgcccagggcagcgacgtgagcctgaccgcctgcaaggtgtag

SEQ ID NO: 19281 - DNA, 1116 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcaccggcgccgtggtggccgccgtgatgtggagaagaaagagcagcggcggcgagggcgtgaaggacagaaagggcggcagctacagccaggccgccagcagcgacagcgcccagggcagcgacgtgagcctgaccgcctgcaaggtgtag

SEQ ID NO: 19282 - DNA, 900 bp, Artificial Sequence; identical to SEQ ID NO: 19278
  Description of Artificial Sequence: Synthetic coding sequence

SEQ ID NO: 19283 - DNA, 1098 bp, Artificial Sequence; identical to SEQ ID NO: 19280
  Description of Artificial Sequence: Synthetic coding sequence

SEQ ID NO: 19284 - DNA, 1116 bp, Artificial Sequence; identical to SEQ ID NO: 19279
  Description of Artificial Sequence: Synthetic coding sequence

SEQ ID NO: 19285 - DNA, 900 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcaccaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacctgcagaccagaaacgtgaaggcccagagccagaccgacagagccaacctgggcaccctgagaggctactacaaccagagcgaggccggcagccacaccatccagatgatgtacggctgcgacgtgggcagcgacggcagattcctgagaggctacagacaggacgcctacgacggcaaggactacatcgccctgaacgaggacctgagaagctggaccgccgccgacatggccgcccagatcacccagagaaagtgggaggccgccagagtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggtgtag

SEQ ID NO: 19286 - DNA, 1098 bp, Artificial Sequence
  Description of Artificial Sequence: Synthetic coding sequence
tgagccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcaccggcgccgtggtggccgccgtgatgtggagaagaaagagcagcgacagaaagggcggcagctacagccaggccgccagcagcgacagcgcccagggcagcgacgtgagcctgaccgcctgcaaggtgtag

SEQ ID NO: 19287 - DNA, 900 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggtgtag

SEQ ID NO: 19288 - DNA, 1098 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccacagccagaccgacagagagagcctgagaatcgccctgagatactacaaccagagcgaggccggcagccacaccatccagatgatgtacggctgcgacgtgggccccgacggcagactgctgagaggctaccagcaggacgcctacgacggcaaggactacatcgccctgaacgaggacctgagaagctggaccgccgccgacatggccgcccagatcacccagagaaagtgggaggccgccagagtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccatgttcgccggcgccgtggtggccgccgtgagatggagaagaaagagcagcgacagaaagggcggcagctacagccaggccgccagcagcgacagcgcccagggcagcgacatgagcctgaccgcctgcaaggtgtag

SEQ ID NO: 19289 - DNA, 1116 bp, Artificial Sequence
  Description of Artificial Sequence: Synthetic coding sequence
tgagccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcaccggcgccgtggtggccgccgtgatgtggagaagaaagagcagcggcggcgagggcgtgaaggacagaaagggcggcagctacagccaggccgccagcagcgacagcgcccagggcagcgacgtgagcctgaccgcctgcaaggtgtag

SEQ ID NO: 19290 - DNA, 1098 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcaccaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacctgcagaccagaaacgtgaaggcccagagccagaccgacagagccaacctgggcaccctgagaggctactacaaccagagcgaggccggcagccacaccatccagatgatgtacggctgcgacgtgggcagcgacggcagattcctgagaggctacagacaggacgcctacgacggcaaggactacatcgccctgaacgaggacctgagaagctggaccgccgccgacatggccgcccagatcacccagagaaagtgggaggccgccagagtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgttcgccggcgccgtggtggccgccgtgagatggagaagaaagagcagcgacagaaagggcggcagctacagccaggccgccagcagcgacagcgcccagggcagcgacatgagcctgaccgcctgcaaggtgtag

SEQ ID NO: 19291 - DNA, 1098 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcaccggcgccgtggtggccgccgtgatgtggagaagaaagagcagcgacagaaagggcggcagctacagccaggccgccagcagcgacagcgcccagggcagcgacgtgagcctgaccgcctgcaaggtgtag

SEQ ID NO: 19292 - DNA, 1029 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcaccaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacctgcagaccagaaacgtgaaggcccagagccagaccgacagagccaacctgggcaccctgagaggctactacaaccagagcgaggccggcagccacaccatccagatgatgtacggctgcgacgtgggcagcgacggcagattcctgagaggctacagacaggacgcctacgacggcaaggactacatcgccctgaacgaggacctgagaagctggaccgccgccgacatggccgcccagatcacccagagaaagtgggaggccgccagagtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgttcgccggcgccgtggtggccgccgtgagatggagaagaaagagcagcggcggcgtgaagggctag

SEQ ID NO: 19293 - DNA, 345 bp, Artificial Sequence
  Description of Artificial Sequence: Synthetic coding sequence
atgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccaagcccctgaccctgagatgggacagaaagggcggcagctacacccaggccgccagcagcgacagcgcccagggcagcgacgtgagcctgaccgcctgcaaggtgtag

SEQ ID NO: 19294 - DNA, 465 bp, Artificial Sequence
  Description of Artificial Sequence: Synthetic coding sequence
atggccgtgatggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagaagatggagcccagagccccctggatcgagcaggagggccccgagtactgggaccaggagaccagaaacatgaaggcccacagccagaccgacagagccaacctgggcaccctgagaggctactacaaccagagcgaggacggcagccacaccatccagatcatgtacggctgcgacgtgggccccgacggcagattcctgagaggctacagactgagaagccccagcgccagcggcagaagaagcatgagaagaagcagctag

SEQ ID NO: 19295 - DNA, 1098 bp, Artificial Sequence; identical to SEQ ID NO: 19291
  Description of Artificial Sequence: Synthetic coding sequence

SEQ ID NO: 19296 - DNA, 1089 bp, Artificial Sequence
  Description of Artificial Sequence: Synthetic coding sequence
atggcccccagaaccctgctgctgctgctgagcggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacggcgagaccagaaaggtgaaggcccacagccagacccacagagtggacctgggcaccctgagaggctactacaaccagagcgaggccggcagccacaccgtgcagagaatgtacggctgcgacgtgggcagcgactggagattcctgagaggctaccaccagtacgcctacgacggcaaggactacatcgccctgaaggaggacctgagaagctggaccgccgccgacatggccgcccagaccaccaagcacaagtgggaggccgcccacgtggccgagcagctgagagcctacctggagggcacctgcgtggagtggctgagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcaccggcgccgtggtggccgccgtgatgtggagaagaaagagcagcgacagaaagggcggcagctacagccaggccgccagcagcgacagcgcccagggcagcgacgtgagcctgaccgcctgcaaggtgtag

SEQ ID NO: 19297 - DNA, 1098 bp, Artificial Sequence; identical to SEQ ID NO: 19273
  Description of Artificial Sequence: Synthetic coding sequence

SEQ ID NO: 19298 - DNA, 888 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcaccaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacctgcagaccagaaacgtgaaggcccagagccagaccgacagagcctacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgttcgccggcgccgtggtggccgccgtgagatggagaagaaagagcagcggcggcgagggcatgaagggcggcagcgagatcagctgcctgaccgagggcagcaagacccaggtggaggtgtgccccgccagcctgctgggcagcaccatccacaactacggccccacccagcccggcccctgcgtgcccgccctgaccctgctgtag

SEQ ID NO: 19299 - DNA, 1098 bp, Artificial Sequence; identical to SEQ ID NO: 19280
  Description of Artificial Sequence: Synthetic coding sequence

SEQ ID NO: 19300 - DNA, 888 bp, Artificial Sequence
  Description of Artificial Sequence: Synthetic coding sequence
atggccgtgatggcccccagaaccctgctgctgctgctgctgggcgccctggccctgacccagacctgggccggcagccacagcatgagatacttcttcaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggaccaggagaccagaaacgtgaaggcccacagccagaccgacagaagatacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccatgttcgccggcgccgtggtggccgccgtgagatggagaagaaagagcagcggcggcgagggcatgaagggcggcagcgagatcagctgcctgaccgagggcagcaagacccaggtggaggtgtgccccgccagcctgctgggcagcaccatccacaactacggccccacccagcccggcccctgcgtgcccgccctgaccctgctgtag

SEQ ID NO: 19301 - DNA, 1098 bp, Artificial Sequence; identical to SEQ ID NO: 19290
  Description of Artificial Sequence: Synthetic coding sequence

SEQ ID NO: 19302 - DNA, 345 bp, Artificial Sequence; identical to SEQ ID NO: 19293
  Description of Artificial Sequence: Synthetic coding sequence

SEQ ID NO: 19303 - DNA, 888 bp, Artificial Sequence
  Description of Artificial Sequence: Synthetic coding sequence
atggccgtgatggcccccagaaccctggtgctgctgctgagcggcgccctggccctgacccagacctgggccggcagccacagcatgagatacttctacaccagcgtgagcagacccggcagaggcgagcccagattcatcgccgtgggctacgtggacgacacccagttcgtgagattcgacagcgacgccgccagccagagaatggagcccagagccccctggatcgagcaggagggccccgagtactgggacagaaacaccagaaacgtgaaggcccacagccagaccgacagagcctacctggagaacggcaaggagaccctgcagagaaccgacgcccccaagacccacatgacccaccacgccgtgagcgaccacgaggccaccctgagatgctgggccctgagcttctaccccgccgagatcaccctgacctggcagagagacggcgaggaccagacccaggacaccgagctggtggagaccagacccgccggcgacggcaccttccagaagtgggccagcgtggtggtgcccagcggccaggagcagagatacacctgccacgtgcagcacgagggcctgcccaagcccctgaccctgagatgggagcccagcagccagcccaccatccccatcgtgggcatcatcgccggcctggtgctgttcggcgccgtgatcgccggcgccgtggtggccgccgtgatgtggagaagaaagagcagcggcggcgagggcatgaagggcggcagcgagatcagctgcctgaccgagggcagcaagacccaggtggaggtgtgccccgccagcctgctgggcagcaccatccacaactacgagcccacccagcccggcccctgcgtgcccgccctgaccctgctgtag

SEQ ID NO: 19304 - DNA, 465 bp, Artificial Sequence; identical to SEQ ID NO: 19294
  Description of Artificial Sequence: Synthetic coding sequence

SEQ ID NO: 19305 - DNA, 1098 bp, Artificial Sequence; identical to SEQ ID NO: 19280
  Description of Artificial Sequence: Synthetic coding sequence

SEQ ID NO: 19306 - DNA, 1098 bp, Artificial Sequence; identical to SEQ ID NO: 19288
  Description of Artificial Sequence: Synthetic coding sequence

SEQ ID NO: 19307 - DNA, 345 bp, Artificial Sequence; identical to SEQ ID NO: 19293
  Description of Artificial Sequence: Synthetic coding sequence

SEQ ID NO: 19308 - DNA, 1089 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttccacaccagcgtgagcagacccggcagaggcgagcccagattcatcagcgtgggctacgtggacggcacccagttcgtgagattcgacagcgacgccgccagccccagaaccgagcccagagccccctggatcgagcaggagggccccgagtactgggacagaaacacccagatcagcaagaccaacacccagacctacagagagagcctgagaaacctgagaggctactacaaccagagcgaggccggcagccacaccctgcagagaatgtacggctgcgacgtgggccccgacggcagactgctgagaggccacgaccagagcgcctacgacggcaaggactacatcgccctgaacgaggacctgagcagctggaccgccgccgacaccgccgcccagatcacccagagaaagtgggaggccgccagagtggccgagcagctgagagcctacctggagggcacctgcgtggagtggctgagaagacacctggagaacggcaaggagaccctgcagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccatccccatcgtgggcatcgtggccggcctggccgtgctggccgtggtggtgatcggcgccgtggtggccaccgtgatgtgcagaagaaagagcagcggcggcaagggcggcagctacagccaggccgccagcagcgacagcgcccagggcagcgacgtgagcctgaccgcctag

SEQ ID NO: 19309 - DNA, 1089 bp, Artificial Sequence
  Description of Artificial Sequence: Synthetic coding sequence
atgctggtgatggcccccagaaccgtgctgctgctgctgagcgccgccctggccctgaccgagacctgggccggcagccacagcatgagatacttctacaccagcgtgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatctacaaggcccaggcccagaccgacagagagagcctgagaaacctgagaggctactacaaccagagcgaggccggcagccacaccctgcagagcatgtacggctgcgacgtgggccccgacggcagactgctgagaggccacgaccagtacgcctacgacggcaaggactacatcgccctgaacgaggacctgagaagctggaccgccgccgacaccgccgcccagatcacccagagaaagtgggaggccgccagagaggccgagcagagaagagcctacctggagggcgagtgcgtggagtggctgagaagatacctggagaacggcaaggacaagctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19310 - DNA, 726 bp, Artificial Sequence
  Description of Artificial Sequence: Synthetic coding sequence
tgacccgacggcagactgctgagaggccacaaccagtacgcctacgacggcaaggactacatcgccctgaacgaggacctgagaagctggaccgccgccgacaccgccgcccagatcacccagagaaagtgggaggccgccagagtggccgagcaggacagagcctacctggagggcacctgcgtggagtggctgagaagatacctggagaacggcaaggacaccctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggccacttcctgcccaccggcggcaagggcggcagctacagccaggccgcctgcagcgacagcgcccagggcagcgacgtgagcctgaccgcctag

SEQ ID NO: 19311 - DNA, 726 bp, Artificial Sequence
  Description of Artificial Sequence: Synthetic coding sequence
tgacccgacggcagactgctgagaggccacgaccagagcgcctacgacggcaaggactacatcgccctgaacgaggacctgagcagctggaccgccgccgacaccgccgcccagatcacccagagaaagtgggaggccgccagagtggccgagcagctgagagcctacctggagggcacctgcgtggagtggctgagaagacacctggagaacggcaaggagaccctgcagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccatccccatcgtgggcatcgtggccggcctggccgtgctggccgtggtggtgatcggcgccgtggtggccaccgtgatgtgcagaagaaagagcagcggccacttcctgcccaccggcggcaagggcggcagctacagccaggccgccagcagcgacagcgcccagggcagcgacgtgagcctgaccgcctag

SEQ ID NO: 19312 - DNA, 1089 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcaggacagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19313 - DNA, 726 bp, Artificial Sequence
  Description of Artificial Sequence: Synthetic coding sequence
tgacccgacggcagactgctgagaggccacgaccagagcgcctacgacggcaaggactacatcgccctgaacgaggacctgagcagctggaccgccgccgacaccgccgcccagatcacccagagaaagtgggaggccgccagagaggccgagcagtggagagcctacctggagggcctgtgcgtggagtggctgagaagatacctggagaacggcaaggagaccctgcagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccatccccatcgtgggcatcgtggccggcctggccgtgctggccgtggtggtgatcggcgccgtggtggccaccgtgatgtgcagaagaaagagcagcggccacttcctgcccaccggcggcaagggcggcagctacagccaggccgccagcagcgacagcgcccagggcagcgacgtgagcctgaccgcctag

SEQ ID NO: 19314 - DNA, 1089 bp, Artificial Sequence
  Description of Artificial Sequence: Synthetic coding sequence
atgctggtgatggcccccagaaccgtgctgctgctgctgagcgccgccctggccctgaccgagacctgggccggcagccacagcatgagatacttcgacaccgccatgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatcttcaagaccaacacccagaccgacagagagagcctgagaaacctgagaggctactacaaccagagcgaggccggcagccacaccctgcagagcatgtacggctgcgacgtgggccccgacggcagactgctgagaggccacaaccagtacgcctacgacggcaaggactacatcgccctgaacgaggacctgagaagctggaccgccgccgacaccgccgcccagatcacccagagaaagtgggaggccgccagagtggccgagcaggacagagcctacctggagggcacctgcgtggagtggctgagaagatacctggagaacggcaaggacaccctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19315 - DNA, 678 bp, Artificial Sequence
  Description of Artificial Sequence: Synthetic coding sequence
tgaatgctggtgatggcccccagaaccgtgctgctgctgctgagcgccgccctggccctgaccgagacctgggccggcagccacagcatgagatacttctacaccagcgtgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatctacaaggcccaggcccagaccgacagagagagcctgagaaacctgagaggctactacaaccagagcgaggccggcagccacaccctgcagagcatgtacggctgcgacgtgggccccgacggcagactgctgagaggccacgaccagtacgcctacgacggcaaggactacatcgccctgaacgaggacctgagaagctggaccgccgccgacaccgccgcccagatcacccagagaaagtgggaggccgccagagaggccgagcagagaagagcctacctggagggcgagtgcgtggagtggctgagaagatacctggagaacggcaaggacaagctggagagagccgaccaggagcagaagagcctgttccccgcccagagactggagctgagcaacgagtag

SEQ ID NO: 19316 - DNA, 726 bp, Artificial Sequence
  Description of Artificial Sequence: Synthetic coding sequence
atgtacggctgcgacgtgggccccgacggcagactgctgagaggccacgaccagtacgcctacgacggcaaggactacatcgccctgaacgaggacctgagaagctggaccgccgccgacaccgccgcccagatcacccagagaaagtgggaggccgccagagaggccgagcagagaagagcctacctggagggcgagtgcgtggagtggctgagaagatacctggagaacggcaaggacaagctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19317 - DNA, 741 bp, Artificial Sequence
  Description of Artificial Sequence: Synthetic coding sequence
atggccagcgtgggcagaagagagggcaccgccggcggcggcgccggccccggcgagcccagaagagaggagggcagagccggcctgagccccagcagcccccccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcagctgagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgcctag

SEQ ID NO: 19318 - DNA, 741 bp, Artificial Sequence
  Description of Artificial Sequence: Synthetic coding sequence
atggccagcgccggcagaagcgagggcaccgccggcggcggcgccggccccgaggagcccagaagagaggagggcagagccggcctgagccccagcagcccccccggcagccacagcatgagatacttctacaccagcgtgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatctacaaggcccaggcccagaccgacagagagagcctgagaaacctgagaggctactacaaccagagcgaggccggcagccacaccctgcagagcatgtacggctgcgacgtgggccccgacggcagactgctgagaggccacgaccagtacgcctacgacggcaaggactacatcgccctgaacgaggacctgagaagctggaccgccgccgacaccgccgcccagatcacccagagaaagtgggaggccgccagagaggccgagcagagaagagcctacctggagggcgagtgcgtggagtggctgagaagatacctggagaacggcaaggacaagctggagagagccgacccccccaagacccacgtgacccaccaccccatcagcgaccacgaggccaccctgagatgctgggccctgggcttctaccccgcctag

SEQ ID NO: 19319 - DNA, 1089 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcagctgagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19320 - DNA, 726 bp, Artificial Sequence
  Description of Artificial Sequence: Synthetic coding sequence
tgacccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcagctgagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggccacttcctgcccaccggcggcaagggcggcagctacagccaggccgcctgcagcgacagcgcccagggcagcgacgtgagcctgaccgcctag

SEQ ID NO: 19321 - DNA, 726 bp, Artificial Sequence
  Description of Artificial Sequence: Synthetic coding sequence
tgacccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcaggacagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggccacttcctgcccaccggcggcaagggcggcagctacagccaggccgcctgcagcgacagcgcccagggcagcgacgtgagcctgaccgcctag

SEQ ID NO: 19322 - DNA, 741 bp, Artificial Sequence
  Description of Artificial Sequence: Synthetic coding sequence
atggccagcgtgggcagaagcgagggcaccgccggcggcggcgccggccccggcgagcccagaagagaggagggcagagccggcctgagccccagcagcccccccggcagccacagcatgagatacttctacaccgccatgagcagacccggcagaggcgagcccagattcatcgccgtgggctacgtggacgacacccagttcgtgagattcgacagcgacgccgccagccccagaatggcccccagagccccctggatcgagcaggagggccccgagtactgggacagagagacccagatcagcaagaccaacacccagacctacagagagagcctgagaaacctgagaggctactacaaccagagcgaggccggcagccacaccctgcagagaatgtacggctgcgacgtgggccccgacggcagactgctgagaggccacgaccagagcgcctacgacggcaaggactacatcgccctgaacgaggacctgagcagctggaccgccgccgacaccgccgcccagatcacccagagaaagtgggaggccgccagagaggccgagcagtggagagcctacctggagggcctgtgcgtggagtggctgagaagatacctggagaacggcaaggagaccctgcagagagccgacccccccaagacccacgtgacccaccaccccatcagcgaccacgaggccaccctgagatgctgggccctgggcttctaccccgcctag

SEQ ID NO: 19323 - DNA, 741 bp, Artificial Sequence
  Description of Artificial Sequence: Synthetic coding sequence
atggccagcgccggcagaagcgagggcaccgccggcggcggcgccggccccgaggagcccagaagagaggagggcagagccggcctgagccccagcagcccccccggcagccacagcatgagatacttcgacaccgccatgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatcttcaagaccaacacccagaccgacagagagagcctgagaaacctgagaggctactacaaccagagcgaggccggcagccacaccctgcagagcatgtacggctgcgacgtgggccccgacggcagactgctgagaggccacaaccagtacgcctacgacggcaaggactacatcgccctgaacgaggacctgagaagctggaccgccgccgacaccgccgcccagatcacccagagaaagtgggaggccgccagagtggccgagcaggacagagcctacctggagggcacctgcgtggagtggctgagaagatacctggagaacggcaaggacaccctggagagagccgacccccccaagacccacgtgacccaccaccccatcagcgaccacgaggccaccctgagatgctgggccctgggcttctaccccgcctag

SEQ ID NO: 19324 - DNA, 741 bp, Artificial Sequence
  Description of Artificial Sequence: Synthetic coding sequence
atggccagcgtgggcagaagagagggcaccgccggcggcggcgccggccccggcgagcccagaagagaggagggcagagccggcctgagccccagcagcccccccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcaggacagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgcctag

SEQ ID NO: 19325 - DNA, 1089 bp, Artificial Sequence
  Description of Artificial Sequence: Synthetic coding sequence
atgagagtgaccgcccccagaaccgtgctgctgctgctgagcggcgccctggccctgaccgagacctgggccggcagccacagcatgagatacttctacaccgccatgagcagacccggcagaggcgagcccagattcatcgccgtgggctacgtggacgacacccagttcgtgagattcgacagcgacgccgccagccccagaatggcccccagagccccctggatcgagcaggagggccccgagtactgggacagagagacccagatcagcaagaccaacacccagacctacagagagagcctgagaaacctgagaggctactacaaccagagcgaggccggcagccacaccctgcagagaatgtacggctgcgacgtgggccccgacggcagactgctgagaggccacgaccagagcgcctacgacggcaaggactacatcgccctgaacgaggacctgagcagctggaccgccgccgacaccgccgcccagatcacccagagaaagtgggaggccgccagagaggccgagcagtggagagcctacctggagggcctgtgcgtggagtggctgagaagatacctggagaacggcaaggagaccctgcagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccatccccatcgtgggcatcgtggccggcctggccgtgctggccgtggtggtgatcggcgccgtggtggccaccgtgatgtgcagaagaaagagcagcggcggcaagggcggcagctacagccaggccgccagcagcgacagcgcccagggcagcgacgtgagcctgaccgcctag

SEQ ID NO: 19326 - DNA, 609 bp, Artificial Sequence
  Description of Artificial Sequence: Synthetic coding sequence
atgtacggctgcgacgtgggccccgacggcagactgctgagaggccacgaccagtacgcctacgacggcaaggactacatcgccctgaacgaggacctgagaagctggaccgccgccgacaccgccgcccagatcacccagagaaagtgggaggccgccagagaggccgagcagagaagagcctacctggagggcgagtgcgtggagtggctgagaagatacctggagaacggcaaggacaagctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatggggcggcaagggcggcagctacagccaggccgcctgcagcgacagcgcccagggcagcgacgtgagcctgaccgcctag

SEQ ID NO: 19327 - DNA, 675 bp, Artificial Sequence
  Description of Artificial Sequence: Synthetic coding sequence
atgctggtgatggcccccagaaccgtgctgctgctgctgagcgccgccctggccctgaccgagacctgggccggcagccacagcatgagatacttcgacaccgccatgagcagacccggcagaggcgagcccagattcatcagcgtgggctacgtggacgacacccagttcgtgagattcgacagcgacgccgccagccccagagaggagcccagagccccctggatcgagcaggagggccccgagtactgggacagaaacacccagatcttcaagaccaacacccagaccgacagagagagcctgagaaacctgagaggctactacaaccagagcgaggccggcagccacaccctgcagagcatgtacggctgcgacgtgggccccgacggcagactgctgagaggccacaaccagtacgcctacgacggcaaggactacatcgccctgaacgaggacctgagaagctggaccgccgccgacaccgccgcccagatcacccagagaaagtgggaggccgccagagtggccgagcaggacagagcctacctggagggcacctgcgtggagtggctgagaagatacctggagaacggcaaggacaccctggagagagccgaccaggagcagaagagcctgttccccgcccagagactggagctgagcaacgagtag

SEQ ID NO: 19328 - DNA, 675 bp, Artificial Sequence
  Description of Artificial Sequence: Synthetic coding sequence
atgagagtgaccgcccccagaaccgtgctgctgctgctgagcggcgccctggccctgaccgagacctgggccggcagccacagcatgagatacttctacaccgccatgagcagacccggcagaggcgagcccagattcatcgccgtgggctacgtggacgacacccagttcgtgagattcgacagcgacgccgccagccccagaatggcccccagagccccctggatcgagcaggagggccccgagtactgggacagagagacccagatcagcaagaccaacacccagacctacagagagagcctgagaaacctgagaggctactacaaccagagcgaggccggcagccacaccctgcagagaatgtacggctgcgacgtgggccccgacggcagactgctgagaggccacgaccagagcgcctacgacggcaaggactacatcgccctgaacgaggacctgagcagctggaccgccgccgacaccgccgcccagatcacccagagaaagtgggaggccgccagagaggccgagcagtggagagcctacctggagggcctgtgcgtggagtggctgagaagatacctggagaacggcaaggagaccctgcagagagccgaccaggagcagaagagcctgttccccgcccagagactggagctgagcaacgagtag

SEQ ID NO: 19329 - DNA, 675 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttccacaccagcgtgagcagacccggcagaggcgagcccagattcatcagcgtgggctacgtggacggcacccagttcgtgagattcgacagcgacgccgccagccccagaaccgagcccagagccccctggatcgagcaggagggccccgagtactgggacagaaacacccagatcagcaagaccaacacccagacctacagagagagcctgagaaacctgagaggctactacaaccagagcgaggccggcagccacaccctgcagagaatgtacggctgcgacgtgggccccgacggcagactgctgagaggccacgaccagagcgcctacgacggcaaggactacatcgccctgaacgaggacctgagcagctggaccgccgccgacaccgccgcccagatcacccagagaaagtgggaggccgccagagtggccgagcagctgagagcctacctggagggcacctgcgtggagtggctgagaagacacctggagaacggcaaggagaccctgcagagagccgaccaggagcagaagagcctgttccccgcccagagactggagctgagcaacgagtag

SEQ ID NO: 19330 - DNA, 675 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcagctgagagcctacctggagggcctgtgcgtggagagcctgagaagatacctggagaacggcaaggagaccctgcagagagccgaccaggagcagaagagcctgttccccgcccagagactggagctgagcaacgagtag

SEQ ID NO: 19331 - DNA, 675 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccagagcgaggccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcaggacagagcctacctggagggcctgtgcgtggagagcctgagaagatacctggagaacggcaaggagaccctgcagagagccgaccaggagcagaagagcctgttccccgcccagagactggagctgagcaacgagtag

SEQ ID NO: 19332 - DNA, 1302 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccccggcagaagaagcagactgcccatcccccacgtgagacccggcagccccagagtgagcggcagcgagatcagacccagaggcagaggcaccagacccgaccccagacccgccagagcccccggcgccttcaccagattccacttccagctgagacccaagagccccagagtgggcagaggcggcgccggcctgggcaccggcctgaccgccggccccggccccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcagctgagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19333 - DNA, 726 bp, Artificial Sequence
  Description of Artificial Sequence: Synthetic coding sequence
atgtacggctgcgacgtgggccccgacggcagactgctgagaggccacaaccagtacgcctacgacggcaaggactacatcgccctgaacgaggacctgagaagctggaccgccgccgacaccgccgcccagatcacccagagaaagtgggaggccgccagagtggccgagcaggacagagcctacctggagggcacctgcgtggagtggctgagaagatacctggagaacggcaaggacaccctggagagagccgacccccccaagacccacgtgacccaccaccccatcagcgaccacgaggccaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19334 - DNA, 1302 bp, Artificial Sequence
  Description of Artificial Sequence: Synthetic coding sequence
atgagagtgaccgcccccagaaccctgctgctgctgctgtggggcgccgtggccctgaccgagacctgggccggcagccacagcatgagatacttctacaccgccatgagcagacccggcagaggcgagcccagattcatcaccgtgggctacgtggacgacaccctgttcgtgagattcgacagcgacgccaccagccccagaaaggagcccagagccccctggatcgagcaggagggccccgagtactgggacagagagacccagatcagcaagaccaacacccagacctacagagagaacctgagaaccgccctgagatactacaaccccggcagaagaagcagactgcccatcccccacgtgagacccggcagccccagagtgagcggcagcgagatcagacccagaggcagaggcaccagacccgaccccagacccgccagagcccccggcgccttcaccagattccacttccagctgagacccaagagccccagagtgggcagaggcggcgccggcctgggcaccggcctgaccgccggccccggccccggcagccacatcatccagagaatgtacggctgcgacgtgggccccgacggcagactgctgagaggctacgaccaggacgcctacgacggcaaggactacatcgccctgaacgaggacctgagcagctggaccgccgccgacaccgccgcccagatcacccagagaaagtgggaggccgccagagtggccgagcaggacagagcctacctggagggcctgtgcgtggagagcctgagaagatacctggagaacggcaaggagaccctgcagagagccgacccccccaagacccacgtgacccaccaccccatcagcgaccacgaggtgaccctgagatgctgggccctgggcttctaccccgccgagatcaccctgacctggcagagagacggcgaggaccagacccaggacaccgagctggtggagaccagacccgccggcgacagaaccttccagaagtgggccgccgtggtggtgcccagcggcgaggagcagagatacacctgccacgtgcagcacgagggcctgcccaagcccctgaccctgagatgggagcccagcagccagagcaccgtgcccatcgtgggcatcgtggccggcctggccgtgctggccgtggtggtgatcggcgccgtggtggccgccgtgatgtgcagaagaaagagcagcggcggcaagggcggcagctacagccaggccgcctgcagcgacagcgcccagggcagcgacgtgagcctgaccgcctag

SEQ ID NO: 19335 - DNA, 1077 bp, Artificial Sequence
  Description of Artificial Sequence: Synthetic coding sequence
atggtggacggcaccctgctgctgctgctgagcgaggccctggccctgacccagacctgggccggcagccacagcctgaagtacttccacaccagcgtgagcagacccggcagaggcgagcccagattcatcagcgtgggctacgtggacgacacccagttcgtgagattcgacaacgacgccgccagccccagaatggtgcccagagccccctggatggagcaggagggcagcgagtactgggacagagagaccagaagcgccagagacaccgcccagatcttcagagtgaacctgagaaccctgagaggctactacaaccagagcgaggccggcagccacaccctgcagtggatgcacggctgcgagctgggccccgacggcagattcctgagaggctacgagcagttcgcctacgacggcaaggactacctgaccctgaacgaggacctgagaagctggaccgccgtggacaccgccgcccagatcagcgagcagaagagcaacgacgccagcgaggccgagcaccagagagcctacctggaggacacctgcgtggagtggctgcacaagtacctggagaagggcaaggagaccctgctgcacctggagccccccaagacccacgtgacccaccaccccatcagcgaccacgaggccaccctgagatgctgggccctgggcttctaccccgccgagatcaccctgacctggcagcaggacggcgagggccacacccaggacaccgagctggtggagaccagacccgccggcgacggcaccttccagaagtgggccgccgtggtggtgcccagcggcgaggagcagagatacacctgccacgtgcagcacgagggcctgcccgagcccgtgaccctgagatggaagcccgccagccagcccaccatccccatcgtgggcatcatcgccggcctggtgctgctgggcagcgtggtgagcggcgccgtggtggccgccgtgatctggagaaagaagagcagcggcggcaagggcggcagctacagcaaggccgagtggagcgacagcgcccagggcagcgagagccacagcctgtag

SEQ ID NO: 19336 - DNA, 1077 bp, Artificial Sequence
  Description of Artificial Sequence: Synthetic coding sequence
atggtggacggcaccctgctgctgctgctgagcgaggccctggccctgacccagacctgggccggcagccacagcctgaagtacttccacaccagcgtgagcagacccggcagaggcgagcccagattcatcagcgtgggctacgtggacgacacccagttcgtgagattcgacaacgacgccgccagccccagaatggtgcccagagccccctggatggagcaggagggcagcgagtactgggacagagagaccagaagcgccagagacaccgcccagatcttcagagtgaacctgagaaccctgagaggctactacaaccagagcgaggccggcagccacaccctgcagtggatgcacggctgcgagctgggccccgacagaagattcctgagaggctacgagcagttcgcctacgacggcaaggactacctgaccctgaacgaggacctgagaagctggaccgccgtggacaccgccgcccagatcagcgagcagaagagcaacgacgccagcgaggccgagcaccagagagcctacctggaggacacctgcgtggagtggctgcacaagtacctggagaagggcaaggagaccctgctgcacctggagccccccaagacccacgtgacccaccaccccatcagcgaccacgaggccaccctgagatgctgggccctgggcttctaccccgccgagatcaccctgacctggcagcaggacggcgagggccacacccaggacaccgagctggtggagaccagacccgccggcgacggcaccttccagaagtgggccgccgtggtggtgcccagcggcgaggagcagagatacacctgccacgtgcagcacgagggcctgcccgagcccgtgaccctgagatggaagcccgccagccagcccaccatccccatcgtgggcatcatcgccggcctggtgctgctgggcagcgtggtgagcggcgccgtggtggccgccgtgatctggagaaagaagagcagcggcggcaagggcggcagctacagcaaggccgagtggagcgacagcgcccagggcagcgagagccacagcctgtag

SEQ ID NO: 19337 - DNA, 1077 bp, Artificial Sequence; identical to SEQ ID NO: 19336
  Description of Artificial Sequence: Synthetic coding sequence

SEQ ID NO: 19338 - DNA, 1077 bp, Artificial Sequence; identical to SEQ ID NO: 19336
  Description of Artificial Sequence: Synthetic coding sequence

SEQ ID NO: 19339 - DNA, 1077 bp, Artificial Sequence; identical to SEQ ID NO: 19335
  Description of Artificial Sequence: Synthetic coding sequence

SEQ ID NO: 19340 - DNA, 1077 bp, Artificial Sequence; identical to SEQ ID NO: 19336
  Description of Artificial Sequence: Synthetic coding sequence

SEQ ID NO: 19341 - DNA, 1077 bp, Artificial Sequence; identical to SEQ ID NO: 19335
  Description of Artificial Sequence: Synthetic coding sequence

SEQ ID NO: 19342 - DNA, 1200 bp, Artificial Sequence
  Description of Artificial Sequence: Synthetic coding sequence
atggagcccagcttctacagcagcagaagaccctggcccctgcccagacccggcagagtgagcgccggcagcggctggaagagacccctgcccggcgtggagagaggcagacccggcggcggcgagggcctgggcgagcccagaagagaggagggcagagccgacctgagccccagcagcccccccggcagccacagcctgaagtacttccacaccagcgtgagcagacccggcagaggcgagcccagattcatcagcgtgggctacgtggacgacacccagttcgtgagattcgacaacgacgccgccagccccagaatggtgcccagagccccctggatggagcaggagggcagcgagtactgggacagagagaccagaagcgccagagacaccgcccagatcttcagagtgaacctgagaaccctgagaggctactacaaccagagcgaggccggcagccacaccctgcagtggatgcacggctgcgagctgggccccgacagaagattcctgagaggctacgagcagttcgcctacgacggcaaggactacctgaccctgaacgaggacctgagaagctggaccgccgtggacaccgccgcccagatcagcgagcagaagagcaacgacgccagcgaggccgagcaccagagagcctacctggaggacacctgcgtggagtggctgcacaagtacctggagaagggcaaggagaccctgctgcacctggagccccccaagacccacgtgacccaccaccccatcagcgaccacgaggccaccctgagatgctgggccctgggcttctaccccgccgagatcaccctgacctggcagcaggacggcgagggccacacccaggacaccgagctggtggagaccagacccgccggcgacggcaccttccagaagtgggccgccgtggtggtgcccagcggcgaggagcagagatacacctgccacgtgcagcacgagggcctgcccgagcccgtgaccctgagatggaagcccgccagccagcccaccatccccatcgtgggcatcatcgccggcctggtgctgctgggcagcgtggtgagcggcgccgtggtggccgccgtgatctggagaaagaagagcagcggcggcaagggcggcagctacagcaaggccgagtggagcgacagcgcccagggcagcgagagccacagcctgtag

SEQ ID NO: 19343 - DNA, 1329 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19344 - DNA, 1041 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19345 - DNA, 1041 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19346 - DNA, 765 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19347 - DNA, 1005 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagctag

SEQ ID NO: 19348 - DNA, 765 bp, Artificial Sequence; identical to SEQ ID NO: 19346
  Description of Artificial Sequence: Synthetic coding sequence

SEQ ID NO: 19349 - DNA, 1041 bp, Artificial Sequence; identical to SEQ ID NO: 19344
  Description of Artificial Sequence: Synthetic coding sequence

SEQ ID NO: 19350 - DNA, 765 bp, Artificial Sequence; identical to SEQ ID NO: 19346
  Description of Artificial Sequence: Synthetic coding sequence

SEQ ID NO: 19351 - DNA, 1329 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19352 - DNA, 1041 bp, Artificial Sequence; identical to SEQ ID NO: 19345
  Description of Artificial Sequence: Synthetic coding sequence

SEQ ID NO: 19353 - DNA, 1329 bp, Artificial Sequence; identical to SEQ ID NO: 19351
  Description of Artificial Sequence: Synthetic coding sequence

SEQ ID NO: 19354 - DNA, 1050 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggcccagctgctgagcgtgagcaccagccagaccagcatcctgatccaggagcagttcagccaccagagaaccctggccatgagcggcaagatgttctgctgccacgactggagcgaggaggaggtgctgcccgccagctgcggcgagtag

SEQ ID NO: 19355 - DNA, 396 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgtag

SEQ ID NO: 19356 - DNA, 396 bp, Artificial Sequence; identical to SEQ ID NO: 19355
  Description of Artificial Sequence: Synthetic coding sequence

SEQ ID NO: 19357 - DNA, 396 bp, Artificial Sequence; identical to SEQ ID NO: 19355
  Description of Artificial Sequence: Synthetic coding sequence

SEQ ID NO: 19358 - DNA, 642 bp, Artificial Sequence
  Description of Artificial Sequence: Synthetic coding sequence
tgacccgaccccccccccggcagagtgcccggcgccttcaccgagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagctag

SEQ ID NO: 19359 - DNA, 765 bp, Artificial Sequence; identical to SEQ ID NO: 19346
  Description of Artificial Sequence: Synthetic coding sequence

SEQ ID NO: 19360 - DNA, 396 bp, Artificial Sequence; identical to SEQ ID NO: 19355
  Description of Artificial Sequence: Synthetic coding sequence

SEQ ID NO: 19361 - DNA, 678 bp, Artificial Sequence
  Description of Artificial Sequence: Synthetic coding sequence
tgacccgaccccccccccggcagagtgcccggcgccttcaccgagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19362 - DNA, 1005 bp, Artificial Sequence; identical to SEQ ID NO: 19347
  Description of Artificial Sequence: Synthetic coding sequence

SEQ ID NO: 19363 - DNA, 1041 bp, Artificial Sequence; identical to SEQ ID NO: 19345
  Description of Artificial Sequence: Synthetic coding sequence

SEQ ID NO: 19364 - DNA, 375 bp, Artificial Sequence
  Description of Artificial Sequence: Synthetic coding sequence
tgagccgtgatgtggagaaagaagagcagcggccacttcctgcccatcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19365 - DNA, 375 bp, Artificial Sequence; identical to SEQ ID NO: 19364
  Description of Artificial Sequence: Synthetic coding sequence

SEQ ID NO: 19366 - DNA, 678 bp, Artificial Sequence; identical to SEQ ID NO: 19361
  Description of Artificial Sequence: Synthetic coding sequence

SEQ ID NO: 19367 - DNA, 1329 bp, Artificial Sequence; identical to SEQ ID NO: 19351
  Description of Artificial Sequence: Synthetic coding sequence

SEQ ID NO: 19368 - DNA, 678 bp, Artificial Sequence
  Description of Artificial Sequence: Synthetic coding sequence
tgacccgaccccccccccggcagagtgcccggcgccttcacccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19369 - DNA, 1329 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcctgctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19370 - DNA, 678 bp, Artificial Sequence; identical to SEQ ID NO: 19361
  Description of Artificial Sequence: Synthetic coding sequence

SEQ ID NO: 19371 - DNA, 765 bp, Artificial Sequence; identical to SEQ ID NO: 19346
  Description of Artificial Sequence: Synthetic coding sequence

SEQ ID NO: 19372 - DNA, 1041 bp, Artificial Sequence; identical to SEQ ID NO: 19345
  Description of Artificial Sequence: Synthetic coding sequence

SEQ ID NO: 19373 - DNA, 396 bp, Artificial Sequence; identical to SEQ ID NO: 19355
  Description of Artificial Sequence: Synthetic coding sequence

SEQ ID NO: 19374 - DNA, 33 bp, Artificial Sequence
  Description of Artificial Sequence: Synthetic coding sequence
tgagccgtgatgtggagaaagaagagcagctag

SEQ ID NO: 19375 - DNA, 780 bp, Artificial Sequence
  Description of Artificial Sequence: Synthetic coding sequence
atgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgcctacagcgtggtgagcggcaacctgatgatcacctggtggagcagcctgttcctgctgggcgtgctgttccagggctacctgggctgcctgagaagccacagcgtgctgggcagaagaaagcacttctag

SEQ ID NO: 19376 - DNA, 765 bp, Artificial Sequence; identical to SEQ ID NO: 19346
  Description of Artificial Sequence: Synthetic coding sequence

SEQ ID NO: 19377 - DNA, 729 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgagcagagcccccagcccaccatccccatcgtgggcatcgtggccggcctggtggtgctgggcgccgtggtgaccggcgccgtggtggccgccgtgatgtggagaaagaagagcagctag

SEQ ID NO: 19378 - DNA, 396 bp, Artificial Sequence; identical to SEQ ID NO: 19355
  Description of Artificial Sequence: Synthetic coding sequence

SEQ ID NO: 19379 - DNA, 375 bp, Artificial Sequence; identical to SEQ ID NO: 19364
  Description of Artificial Sequence: Synthetic coding sequence

SEQ ID NO: 19380 - DNA, 1041 bp, Artificial Sequence; identical to SEQ ID NO: 19345
  Description of Artificial Sequence: Synthetic coding sequence

SEQ ID NO: 19381 - DNA, 1329 bp, Artificial Sequence; identical to SEQ ID NO: 19351
  Description of Artificial Sequence: Synthetic coding sequence

SEQ ID NO: 19382 - DNA, 396 bp, Artificial Sequence; identical to SEQ ID NO: 19355
  Description of Artificial Sequence: Synthetic coding sequence

SEQ ID NO: 19383 - DNA, 375 bp, Artificial Sequence
  Description of Artificial Sequence: Synthetic coding sequence
tgagccgtgatgtggagaaagaagagcagcggccacttcctgcccatcgacagaaacagaggcagctacagccaggccgccgcctacagcgtggtgagcggcctgctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19384 - DNA, 1260 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgccccccggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19385 - DNA, 375 bp, Artificial Sequence; identical to SEQ ID NO: 19364
  Description of Artificial Sequence: Synthetic coding sequence

SEQ ID NO: 19386 - DNA, 678 bp, Artificial Sequence
  Description of Artificial Sequence: Synthetic coding sequence
tgacccgaccccccccccggcagagtgcccggcgccttcacccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgtgtag

SEQ ID NO: 19387 - DNA, 678 bp, Artificial Sequence; identical to SEQ ID NO: 19386
  Description of Artificial Sequence: Synthetic coding sequence

SEQ ID NO: 19388 - DNA, 375 bp, Artificial Sequence; identical to SEQ ID NO: 19364
  Description of Artificial Sequence: Synthetic coding sequence

SEQ ID NO: 19389 - DNA, 780 bp, Artificial Sequence
  Description of Artificial Sequence: Synthetic coding sequence
atgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgcctacagcgtggtgagcggcctgctgatgatcacctggtggagcagcctgttcctgctgggcgtgctgttccagggctacctgggctgcctgagaagccacagcgtgctgggcagaagaaagcacttctag

SEQ ID NO: 19390 - DNA, 1050 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggcccagctgctgagcgtgagcaccagccagaccagcatcctgatccaggagcagttcagccaccagagaaccctggccatgagcggcaagatgttctgctgccacgactggagcgaggagaaggtgctgcccgccagctgcggcgagtag

SEQ ID NO: 19391 - DNA, 1260 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19392 - DNA, 1050 bp, Artificial Sequence; identical to SEQ ID NO: 19390
  Description of Artificial Sequence: Synthetic coding sequence

SEQ ID NO: 19393 - DNA, 780 bp, Artificial Sequence
  Description of Artificial Sequence: Synthetic coding sequence
atgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgcctacagcgtggtgagcggcaacctgatgatcacctggtggagcagcctgttcctgctgggcgtgctgttccagggctacctgggctgcctgagaagccacagcgtgctgggcagaagaaagcacttctag

SEQ ID NO: 19394 - DNA, 780 bp, Artificial Sequence; identical to SEQ ID NO: 19393
  Description of Artificial Sequence: Synthetic coding sequence

SEQ ID NO: 19395 - DNA, 1260 bp, Artificial Sequence; identical to SEQ ID NO: 19391
  Description of Artificial Sequence: Synthetic coding sequence

SEQ ID NO: 19396 - DNA, 1050 bp, Artificial Sequence; identical to SEQ ID NO: 19390
  Description of Artificial Sequence: Synthetic coding sequence

SEQ ID NO: 19397 - DNA, 1308 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcctgctgatgatcacctggtggagcagcctgttcctgctgggcgtgctgttccagggctacctgggctgcctgagaagccacagcgtgctgggcagaagaaaggcccagctgctgagcgtgagcaccagccagaccagcatcctgatccaggagcagttcagccaccagagaaccctggccatgagcggcaagatgttctgctgccacgactggagcgaggaggaggtgctgcccgccagctgcggcgagtag

SEQ ID NO: 19398 - DNA, 1041 bp, Artificial Sequence; identical to SEQ ID NO: 19345
  Description of Artificial Sequence: Synthetic coding sequence

SEQ ID NO: 19399 - DNA, 780 bp, Artificial Sequence; identical to SEQ ID NO: 19393
  Description of Artificial Sequence: Synthetic coding sequence

SEQ ID NO: 19400 - DNA, 1041 bp, Artificial Sequence; identical to SEQ ID NO: 19345
  Description of Artificial Sequence: Synthetic coding sequence

SEQ ID NO: 19401 - DNA, 1050 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcaacctgatgatcacctggtggagcagcctgttcctgctgggcgtgctgttccagggctacctgggctgcctgagaagccacagcgtgctgggcagaagaaaggcccagctgctgagcgtgagcaccagccagaccagcatcctgatccaggagcagttcagccaccagagaaccctggccatgagcggcaagatgttctgctgccacgactggagcgaggaggaggtgctgcccgccagctgcggcgagtag

SEQ ID NO: 19402 - DNA, 1260 bp, Artificial Sequence; identical to SEQ ID NO: 19391
  Description of Artificial Sequence: Synthetic coding sequence

SEQ ID NO: 19403 - DNA, 780 bp, Artificial Sequence; identical to SEQ ID NO: 19393
  Description of Artificial Sequence: Synthetic coding sequence

SEQ ID NO: 19404 - DNA, 1260 bp, Artificial Sequence; identical to SEQ ID NO: 19391
  Description of Artificial Sequence: Synthetic coding sequence

SEQ ID NO: 19405 - DNA, 1041 bp, Artificial Sequence; identical to SEQ ID NO: 19345
  Description of Artificial Sequence: Synthetic coding sequence

SEQ ID NO: 19406 - DNA, 1041 bp, Artificial Sequence; identical to SEQ ID NO: 19345
  Description of Artificial Sequence: Synthetic coding sequence

SEQ ID NO: 19407 - DNA, 1017 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagtacgtggacgacacccagttcctgagattcgacagcgacgccgccatccccagaatggagcccagagagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcggcagaaagggctag

SEQ ID NO: 19408 - DNA, 1260 bp, Artificial Sequence
  Description of Artificial Sequence: Synthetic coding sequence
atggcccccagaagcctgctgctgctgctgagcggcgccctggccctgaccgacacctgggccggcagccacagcctgagatacttcagcaccgccgtgagcagacccggcagaggcgagcccagatacatcgccgtggagccctgggtggagcaggagggcccccagtactgggagtggaccaccggctacgccaaggccaacgcccagaccgacagagtggccctgagaaacctgctgagaagatacaaccagagcgaggccggcagccacaccctgcagggcatgaacggctgcgacatgggccccgacggcagactgctgagaggctaccaccagcacgcctacgacggcaaggactacatcagcctgaacgaggacctgagaagctggaccgccgccgacaccgtggcccagatcacccagagattctacgaggccgaggagtacgccgaggagttcagaacctacctggagggcgagtgcctggagctgctgagaagatacctggagaacggcaaggagaccctgcagagagccgacccccccaaggcccacgtggcccaccaccccatcagcgaccacgaggccaccctgagatgctgggccctgggcttctaccccgccgagatcaccctgacctggcagagagacggcgaggagcagacccaggacaccgagctggtggagaccagacccgccggcgacggcaccttccagaagtgggccgccgtggtggtgcccagcggcgaggagcagagatacacctgccacgtgcagcacgagggcctgccccagcccctgatcctgagatgggagcagagcccccagcccaccatccccatcgtgggcatcgtggccggcctggtggtgctgggcgccgtggtgaccggcgccgtggtggccgccgtgatgtggagaaagaagagcagcgacagaaacagaggcagctacagccaggccgccgcctacagcgtggtgagcggcctgctgatgatcacctggtggagcagcctgttcctgctgggcgtgctgttccagggctacctgggctgcctgagaagccacagcgtgctgggcagaagaaaggtgggcgacatgtggatcctgttcttcctgtggctgtggaccagcttcaacaccgccttcctggccctgcagagcctgagattcggcttcggcttcagaagaggcagaagcttcctgctgagaagctggcaccacctgatgaagagagtgcagatcaagatcttcgactag

SEQ ID NO: 19409 - DNA, 1017 bp, Artificial Sequence
  Description of Artificial Sequence: Synthetic coding sequence
atggtggtgatggcccccagaaccctgttcctgctgctgagcggcgccctgaccctgaccgagacctgggccggcagccacagcatgagatacttcagcgccgccgtgagcagacccggcagaggcgagcccagattcatcgccatgggctacgtggacgacacccagttcgtgagattcgacagcgacagcgcctgccccagaatggagcccagagccccctgggtggagcaggagggccccgagtactgggaggaggagaccagaaacaccaaggcccacgcccagaccgacagaatgaacctgcagaccctgagaggctactacaaccagagcgaggccagcagccacaccctgcagtggatgatcggctgcgacctgggcagcgacggcagactgctgagaggctacgagcagtacgcctacgacggcaaggactacctggccctgaacgaggacctgagaagctggaccgccgccgacaccgccgcccagatcagcaagagaaagtgcgaggccgccaacgtggccgagcagagaagagcctacctggagggcacctgcgtggagtggctgcacagatacctggagaacggcaaggagatgctgcagagagccgacccccccaagacccacgtgacccaccaccccgtgttcgactacgaggccaccctgagatgctgggccctgggcttctaccccgccgagatcatcctgacctggcagagagacggcgaggaccagacccaggacgtggagctggtggagaccagacccgccggcgacggcaccttccagaagtgggccgccgtggtggtgcccagcggcgaggagcagagatacacctgccacgtgcagcacgagggcctgcccgagcccctgatgctgagatggaagcagagcagcctgcccaccatccccatcatgggcatcgtggccggcctggtggtgctggccgccgtggtgaccggcgccgccgtggccgccgtgctgtggagaaagaagagcagcgactag

SEQ ID NO: 19410 - DNA, 465 bp, Artificial Sequence
  Description of Artificial Sequence: Synthetic coding sequence
atggtggtgatggcccccagaaccctgttcctgctgctgagcggcgccctgaccctgaccgagacctgggccggcagccacagcatgagatacttcagcgccgccgtgagcagacccggcagaggcgagcccagattcatcgccatgggctacgtggacgacacccagttcgtgagattcgacagcgacagcgcctgccccagaatggagcccagagccccctgggtggagcaggagggccccgagtactgggaggaggagaccagaaacaccaaggcccacgcccagaccgacagaatgaacctgcagaccctgagaggctactacaaccagagcgaggccaagcagagcagcctgcccaccatccccatcatgggcatcgtggccggcctggtggtgctggccgccgtggtgaccggcgccgccgtggccgccgtgctgtggagaaagaagagcagcgactag

SEQ ID NO: 19411 - DNA, 741 bp, Artificial Sequence
  Description of Artificial Sequence: Synthetic coding sequence
atggtggtgatggcccccagaaccctgttcctgctgctgagcggcgccctgaccctgaccgagacctgggccggcagccacagcatgagatacttcagcgccgccgtgagcagacccggcagaggcgagcccagattcatcgccatgggctacgtggacgacacccagttcgtgagattcgacagcgacagcgcctgccccagaatggagcccagagccccctgggtggagcaggagggccccgagtactgggaggaggagaccagaaacaccaaggcccacgcccagaccgacagaatgaacctgcagaccctgagaggctactacaaccagagcgaggccaacccccccaagacccacgtgacccaccaccccgtgttcgactacgaggccaccctgagatgctgggccctgggcttctaccccgccgagatcatcctgacctggcagagagacggcgaggaccagacccaggacgtggagctggtggagaccagacccgccggcgacggcaccttccagaagtgggccgccgtggtggtgcccagcggcgaggagcagagatacacctgccacgtgcagcacgagggcctgcccgagcccctgatgctgagatggaagcagagcagcctgcccaccatccccatcatgggcatcgtggccggcctggtggtgctggccgccgtggtgaccggcgccgccgtggccgccgtgctgtggagaaagaagagcagcgactag

SEQ ID NO: 19412 - DNA, 1032 bp, Artificial Sequence
  Description of Artificial Sequence: Synthetic coding sequence
atgaagacccccagaatggtggtgatggcccccagaaccctgttcctgctgctgagcggcgccctgaccctgaccgagacctgggccggcagccacagcatgagatacttcagcgccgccgtgagcagacccggcagaggcgagcccagattcatcgccatgggctacgtggacgacacccagttcgtgagattcgacagcgacagcgcctgccccagaatggagcccagagccccctgggtggagcaggagggccccgagtactgggaggaggagaccagaaacaccaaggcccacgcccagaccgacagaatgaacctgcagaccctgagaggctactacaaccagagcgaggccagcagccacaccctgcagtggatgatcggctgcgacctgggcagcgacggcagactgctgagaggctacgagcagtacgcctacgacggcaaggactacctggccctgaacgaggacctgagaagctggaccgccgccgacaccgccgcccagatcagcaagagaaagtgcgaggccgccaacgtggccgagcagagaagagcctacctggagggcacctgcgtggagtggctgcacagatacctggagaacggcaaggagatgctgcagagagccgacccccccaagacccacgtgacccaccaccccgtgttcgactacgaggccaccctgagatgctgggccctgggcttctaccccgccgagatcatcctgacctggcagagagacggcgaggaccagacccaggacgtggagctggtggagaccagacccgccggcgacggcaccttccagaagtgggccgccgtggtggtgcccagcggcgaggagcagagatacacctgccacgtgcagcacgagggcctgcccgagcccctgatgctgagatggaagcagagcagcctgcccaccatccccatcatgggcatcgtggccggcctggtggtgctggccgccgtggtgaccggcgccgccgtggccgccgtgctgtggagaaagaagagcagcgactag

SEQ ID NO: 19413 - DNA, 1017 bp, Artificial Sequence; identical to SEQ ID NO: 19409
  Description of Artificial Sequence: Synthetic coding sequence

SEQ ID NO: 19414 - DNA, 465 bp, Artificial Sequence; identical to SEQ ID NO: 19410
  Description of Artificial Sequence: Synthetic coding sequence

SEQ ID NO: 19415 - DNA, 741 bp, Artificial Sequence; identical to SEQ ID NO: 19411
  Description of Artificial Sequence: Synthetic coding sequence

SEQ ID NO: 19416 - DNA, 1032 bp, Artificial Sequence; identical to SEQ ID NO: 19412
  Description of Artificial Sequence: Synthetic coding sequence

SEQ ID NO: 19417 - DNA, 1032 bp, Artificial Sequence; identical to SEQ ID NO: 19412
  Description of Artificial Sequence: Synthetic coding sequence

SEQ ID NO: 19418 - DNA, 741 bp, Artificial Sequence; identical to SEQ ID NO: 19411
  Description of Artificial Sequence: Synthetic coding sequence

SEQ ID NO: 19419 - DNA, 465 bp, Artificial Sequence; identical to SEQ ID NO: 19410
  Description of Artificial Sequence: Synthetic coding sequence

SEQ ID NO: 19420 - DNA, 1032 bp, Artificial Sequence; identical to SEQ ID NO: 19412
  Description of Artificial Sequence: Synthetic coding sequence

SEQ ID NO: 19421 - DNA, 1032 bp, Artificial Sequence; identical to SEQ ID NO: 19412
  Description of Artificial Sequence: Synthetic coding sequence

SEQ ID NO: 19422 - DNA, 1017 bp, Artificial Sequence; identical to SEQ ID NO: 19409
  Description of Artificial Sequence: Synthetic coding sequence

SEQ ID NO: 19423 - DNA, 1017 bp, Artificial Sequence; identical to SEQ ID NO: 19409
  Description of Artificial Sequence: Synthetic coding sequence

SEQ ID NO: 19424 - DNA, 741 bp, Artificial Sequence; identical to SEQ ID NO: 19411
  Description of Artificial Sequence: Synthetic coding sequence

SEQ ID NO: 19425 - DNA, 1017 bp, Artificial Sequence; identical to SEQ ID NO: 19409
  Description of Artificial Sequence: Synthetic coding sequence

SEQ ID NO: 19426 - DNA, 1017 bp, Artificial Sequence; identical to SEQ ID NO: 19409
  Description of Artificial Sequence: Synthetic coding sequence

SEQ ID NO: 19427 - DNA, 465 bp, Artificial Sequence; identical to SEQ ID NO: 19410
  Description of Artificial Sequence: Synthetic coding sequence

SEQ ID NO: 19428 - DNA, 741 bp, Artificial Sequence; identical to SEQ ID NO: 19411
  Description of Artificial Sequence: Synthetic coding sequence

SEQ ID NO: 19429 - DNA, 1032 bp, Artificial Sequence; identical to SEQ ID NO: 19412
  Description of Artificial Sequence: Synthetic coding sequence

SEQ ID NO: 19430 - DNA, 741 bp, Artificial Sequence; identical to SEQ ID NO: 19411
  Description of Artificial Sequence: Synthetic coding sequence

SEQ ID NO: 19431 - DNA, 1017 bp, Artificial Sequence; identical to SEQ ID NO: 19409
  Description of Artificial Sequence: Synthetic coding sequence

SEQ ID NO: 19432 - DNA, 465 bp, Artificial Sequence; identical to SEQ ID NO: 19410
  Description of Artificial Sequence: Synthetic coding sequence

SEQ ID NO: 19433 - DNA, 465 bp, Artificial Sequence; identical to SEQ ID NO: 19410
  Description of Artificial Sequence: Synthetic coding sequence

SEQ ID NO: 19434 - DNA, 1017 bp, Artificial Sequence; identical to SEQ ID NO: 19409
  Description of Artificial Sequence: Synthetic coding sequence

SEQ ID NO: 19435 - DNA, 1032 bp, Artificial Sequence; identical to SEQ ID NO: 19412
  Description of Artificial Sequence: Synthetic coding sequence

SEQ ID NO: 19436 - DNA, 741 bp, Artificial Sequence; identical to SEQ ID NO: 19411
  Description of Artificial Sequence: Synthetic coding sequence

SEQ ID NO: 19437 - DNA, 741 bp, Artificial Sequence; identical to SEQ ID NO: 19411
  Description of Artificial Sequence: Synthetic coding sequence

SEQ ID NO: 19438 - DNA, 465 bp, Artificial Sequence; identical to SEQ ID NO: 19410
  Description of Artificial Sequence: Synthetic coding sequence

SEQ ID NO: 19439 - DNA, 741 bp, Artificial Sequence; identical to SEQ ID NO: 19411
  Description of Artificial Sequence: Synthetic coding sequence

SEQ ID NO: 19440 - DNA, 741 bp, Artificial Sequence; identical to SEQ ID NO: 19411
  Description of Artificial Sequence: Synthetic coding sequence

SEQ ID NO: 19441 - DNA, 741 bp, Artificial Sequence; identical to SEQ ID NO: 19411
  Description of Artificial Sequence: Synthetic coding sequence

SEQ ID NO: 19442 - DNA, 741 bp, Artificial Sequence; identical to SEQ ID NO: 19411
  Description of Artificial Sequence: Synthetic coding sequence

SEQ ID NO: 19443 - DNA, 741 bp, Artificial Sequence; identical to SEQ ID NO: 19411
  Description of Artificial Sequence: Synthetic coding sequence

SEQ ID NO: 19444 - DNA, 741 bp, Artificial Sequence; identical to SEQ ID NO: 19411
  Description of Artificial Sequence: Synthetic coding sequence

SEQ ID NO: 19445 - DNA, 1017 bp, Artificial Sequence; identical to SEQ ID NO: 19409
  Description of Artificial Sequence: Synthetic coding sequence

SEQ ID NO: 19446 - DNA, 1017 bp, Artificial Sequence; identical to SEQ ID NO: 19409
  Description of Artificial Sequence: Synthetic coding sequence

SEQ ID NO: 19447 - DNA, 1017 bp, Artificial Sequence; identical to SEQ ID NO: 19409
  Description of Artificial Sequence: Synthetic coding sequence

SEQ ID NO: 19448 - DNA, 1017 bp, Artificial Sequence; identical to SEQ ID NO: 19409
  Description of Artificial Sequence: Synthetic coding sequence

SEQ ID NO: 19449 - DNA, 1017 bp, Artificial Sequence; identical to SEQ ID NO: 19409
  Description of Artificial Sequence: Synthetic coding sequence

SEQ ID NO: 19450 - DNA, 1017 bp, Artificial Sequence; identical to SEQ ID NO: 19409
  Description of Artificial Sequence: Synthetic coding sequence

SEQ ID NO: 19451 - DNA, 372 bp, Artificial Sequence
  Description of Artificial Sequence: Synthetic coding sequence
atgggccacgagcagatgctgcccctgctgtggctgctgccccacagctgggccgtgcccgaggcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggccaggagttcagcggcgagtag

SEQ ID NO: 19452 - DNA, 786 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgaggcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcgtgcccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19453 - DNA, 684 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgaggcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagagtgaactggcagcaccacagcgtgcccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19454 - DNA, 501 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgagggcttccccatcgccgaggtgttcaccctgaagcccctggagttcggcaagcccaacaccctggtgtgcttcgtgagcaacctgttcccccccatgctgaccgtgaactggcagcaccacagcgtgcccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19455 - DNA, 786 bp, Artificial Sequence; identical to SEQ ID NO: 19452
  Description of Artificial Sequence: Synthetic coding sequence

SEQ ID NO: 19456 - DNA, 684 bp, Artificial Sequence; identical to SEQ ID NO: 19453
  Description of Artificial Sequence: Synthetic coding sequence

SEQ ID NO: 19457 - DNA, 501 bp, Artificial Sequence; identical to SEQ ID NO: 19454
  Description of Artificial Sequence: Synthetic coding sequence

SEQ ID NO: 19458 - DNA, 726 bp, Artificial Sequence
  Description of Artificial Sequence: Synthetic coding sequence
atgaagtggctgaagaagtgcctggacaccgcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcgtgcccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggctag

SEQ ID NO: 19459 - DNA, 510 bp, Artificial Sequence
  Description of Artificial Sequence: Synthetic coding sequence
atgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcgtgcccgtggagggcttcggccccaccttcgtgagcgccgtggacggcctgagcttccaggccttcagctacctgaacttcacccccgagcccagcgacatcttcagctgctag

SEQ ID NO: 19460 - DNA, 873 bp, Artificial Sequence
  Description of Artificial Sequence: Synthetic coding sequence
gtgagctgctggctgagcgacagctgccaggagctgcagagaagaggcatcatcctgtgcagctacggcgtgaccagccccatcgccgtgttcggcagacccggcagactgagaaacagaagacacttcgagagaagactggtgcccatgaagtggctgaagaagtgcctggacaccgcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcgtgcccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggctag

SEQ ID NO: 19461 - DNA, 510 bp, Artificial Sequence; identical to SEQ ID NO: 19459
  Description of Artificial Sequence: Synthetic coding sequence

SEQ ID NO: 19462 - DNA, 684 bp, Artificial Sequence; identical to SEQ ID NO: 19453
  Description of Artificial Sequence: Synthetic coding sequence

SEQ ID NO: 19463 - DNA, 510 bp, Artificial Sequence; identical to SEQ ID NO: 19459
  Description of Artificial Sequence: Synthetic coding sequence

SEQ ID NO: 19464 - DNA, 501 bp, Artificial Sequence; identical to SEQ ID NO: 19454
  Description of Artificial Sequence: Synthetic coding sequence

SEQ ID NO: 19465 - DNA, 684 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgaggcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagagtgaactggcagcaccacagcatccccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19466 - DNA, 873 bp, Artificial Sequence; identical to SEQ ID NO: 19460
  Description of Artificial Sequence: Synthetic coding sequence

SEQ ID NO: 19467 - DNA, 510 bp, Artificial Sequence; identical to SEQ ID NO: 19459
  Description of Artificial Sequence: Synthetic coding sequence

SEQ ID NO: 19468 - DNA, 510 bp, Artificial Sequence; identical to SEQ ID NO: 19459
  Description of Artificial Sequence: Synthetic coding sequence

SEQ ID NO: 19469 - DNA, 684 bp, Artificial Sequence; identical to SEQ ID NO: 19453
  Description of Artificial Sequence: Synthetic coding sequence

SEQ ID NO: 19470 - DNA, 873 bp, Artificial Sequence; identical to SEQ ID NO: 19460
  Description of Artificial Sequence: Synthetic coding sequence

SEQ ID NO: 19471 - DNA, 786 bp, Artificial Sequence; identical to SEQ ID NO: 19452
  Description of Artificial Sequence: Synthetic coding sequence

SEQ ID NO: 19472 - DNA, 501 bp, Artificial Sequence; identical to SEQ ID NO: 19454
  Description of Artificial Sequence: Synthetic coding sequence

SEQ ID NO: 19473 - DNA, 510 bp, Artificial Sequence; identical to SEQ ID NO: 19459
  Description of Artificial Sequence: Synthetic coding sequence

SEQ ID NO: 19474 - DNA, 786 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgaggcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcatccccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19475 - DNA, 873 bp, Artificial Sequence; identical to SEQ ID NO: 19460
  Description of Artificial Sequence: Synthetic coding sequence

SEQ ID NO: 19476 - DNA, 510 bp, Artificial Sequence
  Description of Artificial Sequence: Synthetic coding sequence
atgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcatccccgtggagggcttcggccccaccttcgtgagcgccgtggacggcctgagcttccaggccttcagctacctgaacttcacccccgagcccagcgacatcttcagctgctag

SEQ ID NO: 19477 - DNA, 786 bp, Artificial Sequence; identical to SEQ ID NO: 19452
  Description of Artificial Sequence: Synthetic coding sequence

SEQ ID NO: 19478 - DNA, 501 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgagggcttccccatcgccgaggtgttcaccctgaagcccctggagttcggcaagcccaacaccctggtgtgcttcgtgagcaacctgttcccccccatgctgaccgtgaactggcagcaccacagcatccccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggcgactag

SEQ ID NO: 19479 - DNA, 786 bp, Artificial Sequence; identical to SEQ ID NO: 19452
  Description of Artificial Sequence: Synthetic coding sequence

SEQ ID NO: 19480 - DNA, 684 bp, Artificial Sequence; identical to SEQ ID NO: 19453
  Description of Artificial Sequence: Synthetic coding sequence

SEQ ID NO: 19481 - DNA, 501 bp, Artificial Sequence; identical to SEQ ID NO: 19454
  Description of Artificial Sequence: Synthetic coding sequence

SEQ ID NO: 19482 - DNA, 684 bp, Artificial Sequence; identical to SEQ ID NO: 19453
  Description of Artificial Sequence: Synthetic coding sequence

SEQ ID NO: 19483 - DNA, 684 bp, Artificial Sequence; identical to SEQ ID NO: 19453
  Description of Artificial Sequence: Synthetic coding sequence

SEQ ID NO: 19484 - DNA, 786 bp, Artificial Sequence; identical to SEQ ID NO: 19452
  Description of Artificial Sequence: Synthetic coding sequence

SEQ ID NO: 19485 - DNA, 501 bp, Artificial Sequence; identical to SEQ ID NO: 19454
  Description of Artificial Sequence: Synthetic coding sequence

SEQ ID NO: 19486 - DNA, 786 bp, Artificial Sequence; identical to SEQ ID NO: 19452
  Description of Artificial Sequence: Synthetic coding sequence

SEQ ID NO: 19487 - DNA, 873 bp, Artificial Sequence; identical to SEQ ID NO: 19460
  Description of Artificial Sequence: Synthetic coding sequence

SEQ ID NO: 19488 - DNA, 873 bp, Artificial Sequence
  Description of Artificial Sequence: Synthetic coding sequence
gtgagctgctggctgagcgacagctgccaggagctgcagagaagaggcatcatcctgtgcagctacggcgtgaccagccccatcgccgtgttcggcagacccggcagactgagaaacagaagacacttcgagagaagactggtgcccatgaagtggctgaagaagtgcctggacaccgcccccacccccatgtggcccgacgacctgcagaaccacaccttcctgcacaccgtgtactgccaggacggcagccccagcgtgggcctgagcgaggcctacgacgaggaccagctgttcttcttcgacttcagccagaacaccagagtgcccagactgcccgagttcgccgactgggcccaggagcagggcgacgcccccgccatcctgttcgacaaggagttctgcgagtggatgatccagcagatcggccccaagctggacggcaagatccccgtgagcagaggcttccccatcgccgaggtgttcaccctgaagcccctggagttcggcaagcccaacaccctggtgtgcttcgtgagcaacctgttcccccccatgctgaccgtgaactggcagcaccacagcatccccgtggagggcttcggccccaccttcgtgagcgccgtggacggcctgagcttccaggccttcagctacctgaacttcacccccgagcccagcgacatcttcagctgcatcgtgacccacgagatcgacagatacaccgccatcgcctactgggtgcccagaaacgccctgcccagcgacctgctggagaacgtgctgtgcggcgtggccttcggcctgggcgtgctgggcatcatcgtgggcatcgtgctgatcatctacttcagaaagccctgcagcggctag

SEQ ID NO: 19489 - DNA, 873 bp, Artificial Sequence; identical to SEQ ID NO: 19460
  Description of Artificial Sequence: Synthetic coding sequence

SEQ ID NO: 19490 - DNA, 501 bp, Artificial Sequence; identical to SEQ ID NO: 19454
  Description of Artificial Sequence: Synthetic coding sequence

SEQ ID NO: 19491 - DNA, 510 bp, Artificial Sequence; identical to SEQ ID NO: 19459
  Description of Artificial Sequence: Synthetic coding sequence

SEQ ID NO: 19492 - DNA, 792 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagctacacccccctgcccggcagcaactacagcgagggctggcacatcagctag

SEQ ID NO: 19493 - DNA, 792 bp, Artificial Sequence; identical to SEQ ID NO: 19492
  Description of Artificial Sequence: Synthetic coding sequence

SEQ ID NO: 19494 - DNA, 792 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacaccggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagctacacccccctgcccggcagcaactacagcgagggctggcacatcagctag

SEQ ID NO: 19495 - DNA, 426 bp, Artificial Sequence
  Description of Artificial Sequence: Synthetic coding sequence
tgaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagatggcacatcagctag

SEQ ID NO: 19496 - DNA, 774 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagcgacctgatcatcagcctgctgttcatcctgtag

SEQ ID NO: 19497 - DNA, 321 bp, Artificial Sequence
  Description of Artificial Sequence: Synthetic coding sequence
gtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacaccggcgcccccgagcccatcctgagagactggagctacacccccctgcccggcagcaactacagcgagggctggcacatcagctag

SEQ ID NO: 19498 - DNA, 426 bp, Artificial Sequence
  Description of Artificial Sequence: Synthetic coding sequence
tgaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacaccggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagatggcacatcagctag

SEQ ID NO: 19499 - DNA, 528 bp, Artificial Sequence
  Description of Artificial Sequence: Synthetic coding sequence
atgggccacgagcagaaccagggcgccgccctgctgcagatgctgcccctgctgtggctgctgccccacagctgggccgtgcccgaggagcagagcatgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgcctag

SEQ ID NO: 19500 - DNA, 528 bp, Artificial Sequence; identical to SEQ ID NO: 19499
  Description of Artificial Sequence: Synthetic coding sequence

SEQ ID NO: 19501 - DNA, 651 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacaccggcgcccccgagcccatcctgagagactggagcaagtgcatggccgacggctggaactag

SEQ ID NO: 19502 - DNA, 792 bp, Artificial Sequence; identical to SEQ ID NO: 19494
  Description of Artificial Sequence: Synthetic coding sequence

SEQ ID NO: 19503 - DNA, 774 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacaccggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagcgacctgatcatcagcctgctgttcatcctgtag

SEQ ID NO: 19504 - DNA, 321 bp, Artificial Sequence
  Description of Artificial Sequence: Synthetic coding sequence
gtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggagctacacccccctgcccggcagcaactacagcgagggctggcacatcagctag

SEQ ID NO: 19505 - DNA, 792 bp, Artificial Sequence; identical to SEQ ID NO: 19494
  Description of Artificial Sequence: Synthetic coding sequence

SEQ ID NO: 19506 - DNA, 426 bp, Artificial Sequence; identical to SEQ ID NO: 19498
  Description of Artificial Sequence: Synthetic coding sequence

SEQ ID NO: 19507 - DNA, 792 bp, Artificial Sequence; identical to SEQ ID NO: 19492
  Description of Artificial Sequence: Synthetic coding sequence

SEQ ID NO: 19508 - DNA, 774 bp, Artificial Sequence; identical to SEQ ID NO: 19496
  Description of Artificial Sequence: Synthetic coding sequence

SEQ ID NO: 19509 - DNA, 528 bp, Artificial Sequence; identical to SEQ ID NO: 19499
  Description of Artificial Sequence: Synthetic coding sequence

SEQ ID NO: 19510 - DNA, 528 bp, Artificial Sequence; identical to SEQ ID NO: 19499
  Description of Artificial Sequence: Synthetic coding sequence

SEQ ID NO: 19511 - DNA, 321 bp, Artificial Sequence; identical to SEQ ID NO: 19504
  Description of Artificial Sequence: Synthetic coding sequence

SEQ ID NO: 19512 - DNA, 426 bp, Artificial Sequence; identical to SEQ ID NO: 19498
  Description of Artificial Sequence: Synthetic coding sequence

SEQ ID NO: 19513 - DNA, 528 bp, Artificial Sequence; identical to SEQ ID NO: 19499
  Description of Artificial Sequence: Synthetic coding sequence

SEQ ID NO: 19514 - DNA, 321 bp, Artificial Sequence; identical to SEQ ID NO: 19497
  Description of Artificial Sequence: Synthetic coding sequence

SEQ ID NO: 19515 - DNA, 321 bp, Artificial Sequence; identical to SEQ ID NO: 19504
  Description of Artificial Sequence: Synthetic coding sequence

SEQ ID NO: 19516 - DNA, 321 bp, Artificial Sequence; identical to SEQ ID NO: 19504
  Description of Artificial Sequence: Synthetic coding sequence

SEQ ID NO: 19517 - DNA, 426 bp, Artificial Sequence; identical to SEQ ID NO: 19495
  Description of Artificial Sequence: Synthetic coding sequence

SEQ ID NO: 19518 - DNA, 321 bp, Artificial Sequence; identical to SEQ ID NO: 19497
  Description of Artificial Sequence: Synthetic coding sequence

SEQ ID NO: 19519 - DNA, 774 bp, Artificial Sequence; identical to SEQ ID NO: 19503
  Description of Artificial Sequence: Synthetic coding sequence

SEQ ID NO: 19520 - DNA, 792 bp, Artificial Sequence; identical to SEQ ID NO: 19492
  Description of Artificial Sequence: Synthetic coding sequence

SEQ ID NO: 19521 - DNA, 321 bp, Artificial Sequence; identical to SEQ ID NO: 19497
  Description of Artificial Sequence: Synthetic coding sequence

SEQ ID NO: 19522 - DNA, 426 bp, Artificial Sequence; identical to SEQ ID NO: 19498
  Description of Artificial Sequence: Synthetic coding sequence

SEQ ID NO: 19523 - DNA, 774 bp, Artificial Sequence; identical to SEQ ID NO: 19503
  Description of Artificial Sequence: Synthetic coding sequence

SEQ ID NO: 19524 - DNA, 774 bp, Artificial Sequence; identical to SEQ ID NO: 19496
  Description of Artificial Sequence: Synthetic coding sequence

SEQ ID NO: 19525 - DNA, 528 bp, Artificial Sequence; identical to SEQ ID NO: 19499
  Description of Artificial Sequence: Synthetic coding sequence

SEQ ID NO: 19526 - DNA, 426 bp, Artificial Sequence; identical to SEQ ID NO: 19495
  Description of Artificial Sequence: Synthetic coding sequence

SEQ ID NO: 19527 - DNA, 528 bp, Artificial Sequence; identical to SEQ ID NO: 19499
  Description of Artificial Sequence: Synthetic coding sequence

SEQ ID NO: 19528 - DNA, 528 bp, Artificial Sequence; identical to SEQ ID NO: 19499
  Description of Artificial Sequence: Synthetic coding sequence

SEQ ID NO: 19529 - DNA, 792 bp, Artificial Sequence; identical to SEQ ID NO: 19494
  Description of Artificial Sequence: Synthetic coding sequence

SEQ ID NO: 19530 - DNA, 426 bp, Artificial Sequence; identical to SEQ ID NO: 19495
  Description of Artificial Sequence: Synthetic coding sequence

SEQ ID NO: 19531 - DNA, 774 bp, Artificial Sequence; identical to SEQ ID NO: 19496
  Description of Artificial Sequence: Synthetic coding sequence

SEQ ID NO: 19532 - DNA, 774 bp, Artificial Sequence; identical to SEQ ID NO: 19503
  Description of Artificial Sequence: Synthetic coding sequence

SEQ ID NO: 19533 - DNA, 651 bp, Artificial Sequence
  Description of Artificial Sequence: Synthetic coding sequence
atgatcaccttcctgcccctgctgctgggcctgagcctgggctgcaccggcgccggcggcttcgtggcccacgtggagagcacctgcctgctggacgacgccggcacccccaaggacttcacctactgcatcagcttcaacaaggacctgctgacctgctgggaccccgaggagaacaagatggccccctgcgagttcggcgtgctgaacagcctggccaacgtgctgagccagcacctgaaccagaaggacaccctgatgcagagactgagaaacggcctgcagaactgcgccacccacacccagcccttctggggcagcctgaccaacagaaccagaccccccagcgtgcaggtggccaagaccacccccttcaacaccagagagcccgtgatgctggcctgctacgtgtggggcttctaccccgccgaggtgaccatcacctggagaaagaacggcaagctggtgatgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggagcaagtgcatggccgacggctggaactag

SEQ ID NO: 19534 - DNA, 171 bp, Artificial Sequence
  Description of Artificial Sequence: Synthetic coding sequence
atgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggagatggcacatcagctag

SEQ ID NO: 19535 - DNA, 171 bp, Artificial Sequence; identical to SEQ ID NO: 19534
  Description of Artificial Sequence: Synthetic coding sequence

SEQ ID NO: 19536 - DNA, 651 bp, Artificial Sequence; identical to SEQ ID NO: 19501
  Description of Artificial Sequence: Synthetic coding sequence

SEQ ID NO: 19537 - DNA, 207 bp, Artificial Sequence
  Description of Artificial Sequence: Synthetic coding sequence
atgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggagctacacccccctgcccggcagcaactacagcgagggctggcacatcagctag

SEQ ID NO: 19538 - DNA, 171 bp, Artificial Sequence; identical to SEQ ID NO: 19534
  Description of Artificial Sequence: Synthetic coding sequence

SEQ ID NO: 19539 - DNA, 288 bp, Artificial Sequence
  Description of Artificial Sequence: Synthetic coding sequence
atgccccacagcagcgcccacaagaccgcccagcccaacggcgactggacctaccagaccctgagccacctggccctgacccccagctacggcgacacctacacctgcgtggtggagcacatcggcgcccccgagcccatcctgagagactggacccccggcctgagccccatgcagaccctgaaggtgagcgtgagcgccgtgaccctgggcctgggcctgatcatcttcagcctgggcgtgatcagctggagaagagccggccacagcagatggcacatcagctag

SEQ ID NO: 19540 - DNA, 207 bp, Artificial Sequence; identical to SEQ ID NO: 19537
  Description of Artificial Sequence: Synthetic coding sequence

SEQ ID NO: 19541 - DNA, 207 bp, Artificial Sequence; identical to SEQ ID NO: 19537
  Description of Artificial Sequence: Synthetic coding sequence

SEQ ID NO: 19542 - DNA, 288 bp, Artificial Sequence; identical to SEQ ID NO: 19539
  Description of Artificial Sequence: Synthetic coding sequence

SEQ ID NO: 19543 - DNA, 651 bp, Artificial Sequence; identical to SEQ ID NO: 19533
  Description of Artificial Sequence: Synthetic coding sequence

SEQ ID NO: 19544 - DNA, 207 bp, Artificial Sequence; identical to SEQ ID NO: 19537
  Description of Artificial Sequence: Synthetic coding sequence

SEQ ID NO: 19545 - DNA, 651 bp, Artificial Sequence; identical to SEQ ID NO: 19501
  Description of Artificial Sequence: Synthetic coding sequence

SEQ ID NO: 19546 - DNA, 651 bp, Artificial Sequence; identical to SEQ ID NO: 19501
  Description of Artificial Sequence: Synthetic coding sequence

SEQ ID NO: 19547 - DNA, 171 bp, Artificial Sequence; identical to SEQ ID NO: 19534
  Description of Artificial Sequence: Synthetic coding sequence

SEQ ID NO: 19548 - DNA, 651 bp, Artificial Sequence; identical to SEQ ID NO: 19533
  Description of Artificial Sequence: Synthetic coding sequence

SEQ ID NO: 19549 - DNA, 288 bp, Artificial Sequence; identical to SEQ ID NO: 19539
  Description of Artificial Sequence: Synthetic coding sequence

SEQ ID NO: 19550 - DNA, 288 bp, Artificial Sequence; identical to SEQ ID NO: 19539
  Description of Artificial Sequence: Synthetic coding sequence

SEQ ID NO: 19551 - DNA, 651 bp, Artificial Sequence; identical to SEQ ID NO: 19533
  Description of Artificial Sequence: Synthetic coding sequence

SEQ ID NO: 19552 - DNA, 465 bp, Artificial Sequence
  Description of Artificial Sequence: Synthetic coding sequence
atggccggcggcggcccccaggccaaccccgactacctgttccacgtgatcttcctgggcgacagcaacgtgggcaagaccagcttcctgcacctgctgcaccagaacagcttcgccaccggcctgaccgccaccgtgctgcaccccagcctgtgcgtgctgggcgtggacttcagagtgaagaccctgctggtggacaacaagtgcttcgtgctgcagctgtgggacaccgccggccaggagagataccacagcatgaccagacagctgctgagaaaggccgacggcgtggtgctgatgtacgacatcaccagccaggagagcttcgcccacgtgagatactggctggactgcctgcaggacgccggcagcgacggcgtggtgatcctgctgctgggcaacaagatggactgcgaggaggagagacaggtgagcgtggaggccggccagcagctggcccagtag

SEQ ID NO: 19553 - DNA, 261 bp, Artificial Sequence
  Description of Artificial Sequence: Synthetic coding sequence
atggccctgagagccggcctggtgctgggcttccacaccctgatgaccctgctgagcccccaggaggccggcgccaccaagggcagagccggcagacacagaagaaaccagagccccagcggccaccccggcggcgccctgcagccccagcagagccaccagagagccagcaccggcgacagagccccccaggtgagcggcggcgccggccccgcccagcacccccacctgcacagaggccagcacctgcccccctgctag

SEQ ID NO: 19554 - DNA, 261 bp, Artificial Sequence; identical to SEQ ID NO: 19553
  Description of Artificial Sequence: Synthetic coding sequence

SEQ ID NO: 19555 - DNA, 753 bp, Artificial Sequence
  Description of Artificial Sequence: Synthetic coding sequence
atggccctgagagccggcctggtgctgggcttccacaccctgatgaccctgctgagcccccaggaggccggcgccaccaaggccgaccacatgggcagctacggccccgccttctaccagagctacggcgccagcggccagttcacccacgagttcgacgaggagcagctgttcagcgtggacctgaagaagagcgaggccgtgtggagactgcccgagttcggcgacttcgccagattcgacccccagggcggcctggccggcatcgccgccatcaaggcccacctggacatcctggtggagagaagcaacagaagcagagccatcaacgtgccccccagagtgaccgtgctgcccaagagcagagtggagctgggccagcccaacatcctgatctgcatcgtggacaacatcttcccccccgtgatcaacatcacctggctgagaaacggccagaccgtgaccgagggcgtggcccagaccagcttctacagccagcccgaccacctgttcagaaagttccactacctgcccttcgtgcccagcgccgaggacgtgtacgactgccaggtggagcactggggcctggacgcccccctgctgagacactgggagctgcaggtgcccatccccccccccgacgccatggagaccctggtgtgcgccctgggcctggccatcggcctggtgggcttcctggtgggcaccgtgctgatcatcatgggcacctacgtgagcagcgtgcccagatag

SEQ ID NO: 19556 - DNA, 261 bp, Artificial Sequence
  Description of Artificial Sequence: Synthetic coding sequence
atggccctgagagccggcctggtgctgggcttccacaccctgatgaccctgctgagcccccaggaggccggcgccaccaagggctgggccggcagacacagaagaaaccagagccccagcggccaccccggcggcgccctgcagccccagcagagccaccagagagccagcaccggcgacagagccccccaggtgagcggcggcgccggccccgcccagcacccccacctgcacagaggccagcacctgcccccctgctag

SEQ ID NO: 19557 - DNA, 261 bp, Artificial Sequence; identical to SEQ ID NO: 19553
  Description of Artificial Sequence: Synthetic coding sequence

SEQ ID NO: 19558 - DNA, 753 bp, Artificial Sequence; identical to SEQ ID NO: 19555
  Description of Artificial Sequence: Synthetic coding sequence

SEQ ID NO: 19559 - DNA, 753 bp, Artificial Sequence; identical to SEQ ID NO: 19555
  Description of Artificial Sequence: Synthetic coding sequence

SEQ ID NO: 19560 - DNA, 186 bp, Artificial Sequence
  Description of Artificial Sequence: Synthetic coding sequence
atggccctgagagccggcctggtgctgggcttccacaccctgatgaccctgctgagcccccaggaggccggcgccaccaaggccgaccacatgggcagctacggcccccccagcaccagcctgaccgcccccagagccagcagccccatgaacctgatgagaaacagctgcagcctgtggacctag

SEQ ID NO: 19561 - DNA, 753 bp, Artificial Sequence; identical to SEQ ID NO: 19555
  Description of Artificial Sequence: Synthetic coding sequence

SEQ ID NO: 19562 - DNA, 753 bp, Artificial Sequence; identical to SEQ ID NO: 19555
  Description of Artificial Sequence: Synthetic coding sequence

SEQ ID NO: 19563 - DNA, 261 bp, Artificial Sequence; identical to SEQ ID NO: 19553
  Description of Artificial Sequence: Synthetic coding sequence

SEQ ID NO: 19564 - DNA, 615 bp, Artificial Sequence
  Description of Artificial Sequence: Synthetic coding sequence
atgggcagctacggccccgccttctaccagagctacggcgccagcggccagttcacccacgagttcgacgaggagcagctgttcagcgtggacctgaagaagagcgaggccgtgtggagactgcccgagttcggcgacttcgccagattcgacccccagggcggcctggccggcatcgccgccatcaaggcccacctggacatcctggtggagagaagcaacagaagcagagccatcaacgtgccccccagagtgaccgtgctgcccaagagcagagtggagctgggccagcccaacatcctgatctgcatcgtggacaacatcttcccccccgtgatcaacatcacctggctgagaaacggccagaccgtgaccgagggcgtggcccagaccagcttctacagccagcccgaccacctgttcagaaagttccactacctgcccttcgtgcccagcgccgaggacgtgtacgactgccaggtggagcactggggcctggacgcccccctgctgagacactggggcaacgaccccagcgagagaaacgacctgtgggagaccccctgcagaagcagctgggtgtgcgacagcccctgcgtgctgagcgccctgtag

SEQ ID NO: 19565 - DNA, 753 bp, Artificial Sequence; identical to SEQ ID NO: 19555
  Description of Artificial Sequence: Synthetic coding sequence

SEQ ID NO: 19566 - DNA, 261 bp, Artificial Sequence; identical to SEQ ID NO: 19556
  Description of Artificial Sequence: Synthetic coding sequence

SEQ ID NO: 19567 - DNA, 261 bp, Artificial Sequence; identical to SEQ ID NO: 19553
  Description of Artificial Sequence: Synthetic coding sequence

SEQ ID NO: 19568 - DNA, 186 bp, Artificial Sequence; identical to SEQ ID NO: 19560
  Description of Artificial Sequence: Synthetic coding sequence

SEQ ID NO: 19569 - DNA, 186 bp, Artificial Sequence; identical to SEQ ID NO: 19560
  Description of Artificial Sequence: Synthetic coding sequence

SEQ ID NO: 19570 - DNA, 615 bp, Artificial Sequence; identical to SEQ ID NO: 19564
  Description of Artificial Sequence: Synthetic coding sequence

SEQ ID NO: 19571 - DNA, 615 bp, Artificial Sequence; identical to SEQ ID NO: 19564
  Description of Artificial Sequence: Synthetic coding sequence

SEQ ID NO: 19572 - DNA, 615 bp, Artificial Sequence; identical to SEQ ID NO: 19564
  Description of Artificial Sequence: Synthetic coding sequence

SEQ ID NO: 19573 - DNA, 186 bp, Artificial Sequence; identical to SEQ ID NO: 19560
  Description of Artificial Sequence: Synthetic coding sequence

SEQ ID NO: 19574 - DNA, 615 bp, Artificial Sequence; identical to SEQ ID NO: 19564
  Description of Artificial Sequence: Synthetic coding sequence

SEQ ID NO: 19575 - DNA, 615 bp, Artificial Sequence; identical to SEQ ID NO: 19564
  Description of Artificial Sequence: Synthetic coding sequence

SEQ ID NO: 19576 - DNA, 186 bp, Artificial Sequence; identical to SEQ ID NO: 19560
  Description of Artificial Sequence: Synthetic coding sequence

SEQ ID NO: 19577 - DNA, 186 bp, Artificial Sequence; identical to SEQ ID NO: 19560
  Description of Artificial Sequence: Synthetic coding sequence

SEQ ID NO: 19578 - DNA, 186 bp, Artificial Sequence; identical to SEQ ID NO: 19560
  Description of Artificial Sequence: Synthetic coding sequence

SEQ ID NO: 19579 - DNA, 615 bp, Artificial Sequence; identical to SEQ ID NO: 19564
  Description of Artificial Sequence: Synthetic coding sequence

SEQ ID NO: 19580 - DNA, 549 bp, Artificial Sequence
  Description of Artificial Sequence: Synthetic coding sequence
tgaaacctgaccagactggacagcagcatgacccagggcaccgacagccccgaggacttcgtgatccaggccaaggccgactgctacttcaccaacggcaccgagaaggtgcagttcgtggtgagattcatcttcaacctggaggagtacgtgagattcgacagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggaggtgaccgtgtaccccgagagaacccccctgctgcaccagcacaacctgctgcactgcagcgtgaccggcttctaccccggcgacatcaagatcaagtggttcctgaacggccaggaggagagagccggcgtgatgagcaccggccccatcagaaacggcgactggaccttccagaccgtggtgatgctggagatgacccccgagctgggccacgtgtacacctag

SEQ ID NO: 19581 - DNA, 822 bp, Artificial Sequence
  Description of Artificial Sequence: Synthetic coding sequence
atgggcagcggctgggtgccctgggtggtggccctgctggtgaacctgaccagactggacagcagcatgacccagggcaccgacagccccgaggacttcgtgatccaggccaaggccgactgctacttcaccaacggcaccgagaaggtgcagttcgtggtgagattcatcttcaacctggaggagtacgtgagattcgacagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggtgcagcccgaggtgaccgtgtaccccgagagaacccccctgctgcaccagcacaacctgctgcactgcagcgtgaccggcttctaccccggcgacatcaagatcaagtggttcctgaacggccaggaggagagagccggcgtgatgagcaccggccccatcagaaacggcgactggaccttccagaccgtggtgatgctggagatgacccccgagctgggccacgtgtacacctgcctggtggaccacagcagcctgctgagccccgtgagcgtggagtggagagcccagagcgagtacagctggagaaagatgctgagcggcatcgccgccttcctgctgggcctgatcttcctgctggtgggcatcgtgatccagctgagagcccagaagggctacgtgagaacccagatgagcggcaacgaggtgagcagagccgtgctgctgccccagagctgctag

SEQ ID NO: 19582 - DNA, 822 bp, Artificial Sequence; identical to SEQ ID NO: 19581
  Description of Artificial Sequence: Synthetic coding sequence

SEQ ID NO: 19583 - DNA, 549 bp, Artificial Sequence; identical to SEQ ID NO: 19580
  Description of Artificial Sequence: Synthetic coding sequence

SEQ ID NO: 19584 - DNA, 822 bp, Artificial Sequence; identical to SEQ ID NO: 19581
  Description of Artificial Sequence: Synthetic coding sequence

SEQ ID NO: 19585 - DNA, 549 bp, Artificial Sequence; identical to SEQ ID NO: 19580
  Description of Artificial Sequence: Synthetic coding sequence

SEQ ID NO: 19586 - DNA, 549 bp, Artificial Sequence; identical to SEQ ID NO: 19580
  Description of Artificial Sequence: Synthetic coding sequence

SEQ ID NO: 19587 - DNA, 549 bp, Artificial Sequence; identical to SEQ ID NO: 19580
  Description of Artificial Sequence: Synthetic coding sequence

SEQ ID NO: 19588 - DNA, 822 bp, Artificial Sequence
  Description of Artificial Sequence: Synthetic coding sequence
atgggcagcggctgggtgccctgggtggtggccctgctggtgaacctgaccagactggacagcagcatgacccagggcaccgacagccccgaggacttcgtgatccaggccaaggccgactgctacttcaccaacggcaccgagaaggtgcagttcgtggtgagattcatcttcaacctggaggagtacgtgagattcgacagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggtgcagcccgaggtgaccgtgtaccccgagagaacccccctgctgcaccagcacaacctgctgcactgcagcgtgaccggcttctaccccggcgacatcaagatcaagtggttcctgaacggccaggaggagagagccggcgtgatgagcaccggccccatcagaaacggcgactggaccttccagaccgtggtgatgctggagatgacccccgagctgggccacgtgtacacctgcctggtggaccacagcagcctgctgagccccatcagcgtggagtggagagcccagagcgagtacagctggagaaagatgctgagcggcatcgccgccttcctgctgggcctgatcttcctgctggtgggcatcgtgatccagctgagagcccagaagggctacgtgagaacccagatgagcggcaacgaggtgagcagagccgtgctgctgccccagagctgctag

SEQ ID NO: 19589 - DNA, 822 bp, Artificial Sequence; identical to SEQ ID NO: 19581
  Description of Artificial Sequence: Synthetic coding sequence

SEQ ID NO: 19590 - DNA, 549 bp, Artificial Sequence; identical to SEQ ID NO: 19580
  Description of Artificial Sequence: Synthetic coding sequence

SEQ ID NO: 19591 - DNA, 822 bp, Artificial Sequence; identical to SEQ ID NO: 19581
  Description of Artificial Sequence: Synthetic coding sequence

SEQ ID NO: 19592 - DNA, 411 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagactggtgaccagatacatctacaacagagaggagtacgccagattcgacagcgacgtgggcgtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagaggcaccgtgaccggccccagcagaagctggtag

SEQ ID NO: 19593 - DNA, 840 bp, Artificial Sequence
  Description of Artificial Sequence: Synthetic coding sequence
atgagctggaagatggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagagcccagagcgagagcgcccagagcaagatgctgggcggcgtgggcggcttcgtgctgggcctgatcttcctgggcctgggcctgatcatcagacacagaggccagaagggccccagaggccccccccccgccggcaacatcagcgccatgatccagagcggcgagagagcccaggcctag

SEQ ID NO: 19594 - DNA, 696 bp, Artificial Sequence
  Description of Artificial Sequence: Synthetic coding sequence
atgagctggaagatggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagacccagaggccccccccccgccggcctgctgcactag

SEQ ID NO: 19595 - DNA, 807 bp, Artificial Sequence
  Description of Artificial Sequence: Synthetic coding sequence
atgagctggaagatggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagagcccagagcgagagcgcccagagcaagatgctgggcggcgtgggcggcttcgtgctgggcctgatcttcctgggcctgggcctgatcatcagacacagaggccagaagggccccagaggccccccccccgccggcctgctgcactag

SEQ ID NO: 19596 - DNA, 684 bp, Artificial Sequence
  Description of Artificial Sequence: Synthetic coding sequence
atggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagacccagaggccccccccccgccggcctgctgcactag

SEQ ID NO: 19597 - DNA, 828 bp, Artificial Sequence
  Description of Artificial Sequence: Synthetic coding sequence
atggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagagcccagagcgagagcgcccagagcaagatgctgagcggcatcggcggcttcgtgctgggcctgatcttcctgggcctgggcctgatcatcagacacagaggccagaagggccccagaggccccccccccgccggcaacatcagcgccatgatccagagcggcgagagagcccaggcctag

SEQ ID NO: 19598 - DNA, 657 bp, Artificial Sequence
  Description of Artificial Sequence: Synthetic coding sequence
tgactgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagactgctgcactag

SEQ ID NO: 19599 - DNA, 696 bp, Artificial Sequence; identical to SEQ ID NO: 19594
  Description of Artificial Sequence: Synthetic coding sequence

SEQ ID NO: 19600 - DNA, 657 bp, Artificial Sequence
  Description of Artificial Sequence: Synthetic coding sequence
tgactgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagactgctgcactag

SEQ ID NO: 19601 - DNA, 657 bp, Artificial Sequence; identical to SEQ ID NO: 19598
  Description of Artificial Sequence: Synthetic coding sequence

SEQ ID NO: 19602 - DNA, 840 bp, Artificial Sequence; identical to SEQ ID NO: 19593
  Description of Artificial Sequence: Synthetic coding sequence

SEQ ID NO: 19603 - DNA, 795 bp, Artificial Sequence
  Description of Artificial Sequence: Synthetic coding sequence
atggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagagcccagagcgagagcgcccagagcaagatgctgagcggcatcggcggcttcgtgctgggcctgatcttcctgggcctgggcctgatcatcagacacagaggccagaagggccccagaggccccccccccgccggcctgctgcactag

SEQ ID NO: 19604 - DNA, 657 bp, Artificial Sequence; identical to SEQ ID NO: 19600
  Description of Artificial Sequence: Synthetic coding sequence

SEQ ID NO: 19605 - DNA, 657 bp, Artificial Sequence; identical to SEQ ID NO: 19598
  Description of Artificial Sequence: Synthetic coding sequence

SEQ ID NO: 19606 - DNA, 684 bp, Artificial Sequence; identical to SEQ ID NO: 19596
  Description of Artificial Sequence: Synthetic coding sequence

SEQ ID NO: 19607 - DNA, 657 bp, Artificial Sequence; identical to SEQ ID NO: 19600
  Description of Artificial Sequence: Synthetic coding sequence

SEQ ID NO: 19608 - DNA, 696 bp, Artificial Sequence; identical to SEQ ID NO: 19594
  Description of Artificial Sequence: Synthetic coding sequence

SEQ ID NO: 19609 - DNA, 795 bp, Artificial Sequence; identical to SEQ ID NO: 19603
  Description of Artificial Sequence: Synthetic coding sequence

SEQ ID NO: 19610 - DNA, 795 bp, Artificial Sequence; identical to SEQ ID NO: 19603
  Description of Artificial Sequence: Synthetic coding sequence

SEQ ID NO: 19611 - DNA, 807 bp, Artificial Sequence; identical to SEQ ID NO: 19595
  Description of Artificial Sequence: Synthetic coding sequence

SEQ ID NO: 19612 - DNA, 807 bp, Artificial Sequence; identical to SEQ ID NO: 19595
  Description of Artificial Sequence: Synthetic coding sequence

SEQ ID NO: 19613 - DNA, 696 bp, Artificial Sequence; identical to SEQ ID NO: 19594
  Description of Artificial Sequence: Synthetic coding sequence

SEQ ID NO: 19614 - DNA, 840 bp, Artificial Sequence; identical to SEQ ID NO: 19593
  Description of Artificial Sequence: Synthetic coding sequence

SEQ ID NO: 19615 - DNA, 657 bp, Artificial Sequence; identical to SEQ ID NO: 19600
  Description of Artificial Sequence: Synthetic coding sequence

SEQ ID NO: 19616 - DNA, 828 bp, Artificial Sequence; identical to SEQ ID NO: 19597
  Description of Artificial Sequence: Synthetic coding sequence

SEQ ID NO: 19617 - DNA, 795 bp, Artificial Sequence; identical to SEQ ID NO: 19603
  Description of Artificial Sequence: Synthetic coding sequence

SEQ ID NO: 19618 - DNA, 684 bp, Artificial Sequence; identical to SEQ ID NO: 19596
  Description of Artificial Sequence: Synthetic coding sequence

SEQ ID NO: 19619 - DNA, 840 bp, Artificial Sequence; identical to SEQ ID NO: 19593
  Description of Artificial Sequence: Synthetic coding sequence

SEQ ID NO: 19620 - DNA, 828 bp, Artificial Sequence; identical to SEQ ID NO: 19597
  Description of Artificial Sequence: Synthetic coding sequence

SEQ ID NO: 19621 - DNA, 657 bp, Artificial Sequence; identical to SEQ ID NO: 19598
  Description of Artificial Sequence: Synthetic coding sequence

SEQ ID NO: 19622 - DNA, 828 bp, Artificial Sequence; identical to SEQ ID NO: 19597
  Description of Artificial Sequence: Synthetic coding sequence

SEQ ID NO: 19623 - DNA, 684 bp, Artificial Sequence; identical to SEQ ID NO: 19596
  Description of Artificial Sequence: Synthetic coding sequence

SEQ ID NO: 19624 - DNA, 807 bp, Artificial Sequence; identical to SEQ ID NO: 19595
  Description of Artificial Sequence: Synthetic coding sequence

SEQ ID NO: 19625 - DNA, 627 bp, Artificial Sequence
  Description of Artificial Sequence: Synthetic coding sequence
atgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagacccagaggccccccccccgccggcctgctgcactag

SEQ ID NO: 19626 - DNA, 828 bp, Artificial Sequence
  Description of Artificial Sequence: Synthetic coding sequence
atggccctgcagatccccggcggcttctgggccgccgccgtgaccgtgatgctggtgatgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgcagtggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagagcccagagcgagagcgcccagagcaagatgctgggcggcgtgggcggcttcgtgctgggcctgatcttcctgggcctgggcctgatcatcagacacagaggccagaagggccccagaggccccccccccgccggcaacatcagcgccatgatccagagcggcgagagagcccaggcctag

SEQ ID NO: 19627 - DNA, 627 bp, Artificial Sequence
  Description of Artificial Sequence: Synthetic coding sequence
atgctgagcacccccgtggccgaggccagagacttccccaaggacttcctggtgcagttcaagggcatgtgctacttcaccaacggcaccgagagagtgagaggcgtggccagatacatctacaacagagaggagtacggcagattcgacagcgacgtgggcgagttccaggccgtgaccgagctgggcagaagcatcgaggactggaacaactacaaggacttcctggagcaggagagagccgccgtggacaaggtgtgcagacacaactacgaggccgagctgagaaccaccctgcagagacaggtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcaccagcctgatcagaaacggcgactggaccttccagatcctggtgatgctggagatcaccccccagagaggcgacatctacacctgccaggtggagcaccccagcctgcagagccccatcaccgtggagtggagacccagaggccccccccccgccggcctgctgcactag

SEQ ID NO: 19628 - DNA, 627 bp, Artificial Sequence; identical to SEQ ID NO: 19625
  Description of Artificial Sequence: Synthetic coding sequence

SEQ ID NO: 19629 - DNA, 627 bp, Artificial Sequence; identical to SEQ ID NO: 19625
  Description of Artificial Sequence: Synthetic coding sequence

SEQ ID NO: 19630 - DNA, 627 bp, Artificial Sequence; identical to SEQ ID NO: 19627
  Description of Artificial Sequence: Synthetic coding sequence

SEQ ID NO: 19631 - DNA, 627 bp, Artificial Sequence; identical to SEQ ID NO: 19625
  Description of Artificial Sequence: Synthetic coding sequence

SEQ ID NO: 19632 - DNA, 828 bp, Artificial Sequence; identical to SEQ ID NO: 19626
  Description of Artificial Sequence: Synthetic coding sequence

SEQ ID NO: 19633 - DNA, 627 bp, Artificial Sequence; identical to SEQ ID NO: 19627
  Description of Artificial Sequence: Synthetic coding sequence

SEQ ID NO: 19634 - DNA, 828 bp, Artificial Sequence; identical to SEQ ID NO: 19626
  Description of Artificial Sequence: Synthetic coding sequence

SEQ ID NO: 19635 - DNA, 828 bp, Artificial Sequence; identical to SEQ ID NO: 19626
  Description of Artificial Sequence: Synthetic coding sequence

SEQ ID NO: 19636 - DNA, 690 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgacaagttcaccccccccgtggtgaacgtgacctggctgagaaacggcaagcccgtgaccaccggcgtgagcgagaccgtgttcctgcccagagaggaccacctgttcagaaagttccactacctgcccttcctgcccagcaccgaggacgtgtacgactgcagagtggagcactggggcctggacgagcccctgctgaagcactgggagttcgacgcccccagccccctgcccgagaccaccgagaacgtggtgtgcgccctgggcctgaccgtgggcctggtgggcatcatcatcggcaccatcttcatcatcaagggcctgagaaagagcaacgccgccgagagaagaggccccctgtag

SEQ ID NO: 19637 - DNA, 765 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgtgccccccgaggtgaccgtgctgaccaacagccccgtggagctgagagagcccaacgtgctgatctgcttcatcgacaagttcaccccccccgtggtgaacgtgacctggctgagaaacggcaagcccgtgaccaccggcgtgagcgagaccgtgttcctgcccagagaggaccacctgttcagaaagttccactacctgcccttcctgcccagcaccgaggacgtgtacgactgcagagtggagcactggggcctggacgagcccctgctgaagcactgggagttcgacgcccccagccccctgcccgagaccaccgagaacgtggtgtgcgccctgggcctgaccgtgggcctggtgggcatcatcatcggcaccatcttcatcatcaagggcctgagaaagagcaacgccgccgagagaagaggccccctgtag

SEQ ID NO: 19638 - DNA, 690 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgacaagttcaccccccccgtggtgaacgtgacctggctgagaaacggcaagcccgtgaccaccggcgtgagcgagaccgtgttcctgcccagagaggaccacctgttcagaaagttccactacctgcccttcctgcccagcaccgaggacgtgtacgactgcagagtggagcactggggcctggacgagcccctgctgaagcactgggagttcgacgcccccagccccctgcccgagaccaccgagaacgtggtgtgcgccctgggcctgaccgtgggcctggtgggcatcatcatcggcaccatcttcatcatcaagggcgtgagaaagagcaacgccgccgagagaagaggccccctgtag

SEQ ID NO: 19639 - DNA, 765 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgtgccccccgaggtgaccgtgctgaccaacagccccgtggagctgagagagcccaacgtgctgatctgcttcatcgacaagttcaccccccccgtggtgaacgtgacctggctgagaaacggcaagcccgtgaccaccggcgtgagcgagaccgtgttcctgcccagagaggaccacctgttcagaaagttccactacctgcccttcctgcccagcaccgaggacgtgtacgactgcagagtggagcactggggcctggacgagcccctgctgaagcactgggagttcgacgcccccagccccctgcccgagaccaccgagaacgtggtgtgcgccctgggcctgaccgtgggcctggtgggcatcatcatcggcaccatcttcatcatcaagggcgtgagaaagagcaacgccgccgagagaagaggccccctgtag

SEQ ID NO: 19640 - DNA, 765 bp, Artificial Sequence; identical to SEQ ID NO: 19637
  Description of Artificial Sequence: Synthetic coding sequence

SEQ ID NO: 19641 - DNA, 690 bp, Artificial Sequence; identical to SEQ ID NO: 19638
  Description of Artificial Sequence: Synthetic coding sequence

SEQ ID NO: 19642 - DNA, 765 bp, Artificial Sequence; identical to SEQ ID NO: 19639
  Description of Artificial Sequence: Synthetic coding sequence

SEQ ID NO: 19643 - DNA, 765 bp, Artificial Sequence; identical to SEQ ID NO: 19639
  Description of Artificial Sequence: Synthetic coding sequence

SEQ ID NO: 19644 - DNA, 690 bp, Artificial Sequence; identical to SEQ ID NO: 19638
  Description of Artificial Sequence: Synthetic coding sequence

SEQ ID NO: 19645 - DNA, 765 bp, Artificial Sequence; identical to SEQ ID NO: 19639
  Description of Artificial Sequence: Synthetic coding sequence

SEQ ID NO: 19646 - DNA, 690 bp, Artificial Sequence; identical to SEQ ID NO: 19638
  Description of Artificial Sequence: Synthetic coding sequence

SEQ ID NO: 19647 - DNA, 690 bp, Artificial Sequence; identical to SEQ ID NO: 19638
  Description of Artificial Sequence: Synthetic coding sequence

SEQ ID NO: 19648 - DNA, 690 bp, Artificial Sequence; identical to SEQ ID NO: 19636
  Description of Artificial Sequence: Synthetic coding sequence

SEQ ID NO: 19649 - DNA, 765 bp, Artificial Sequence; identical to SEQ ID NO: 19639
  Description of Artificial Sequence: Synthetic coding sequence

SEQ ID NO: 19650 - DNA, 543 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaagcccagccccagagactacagagagagaggcgtgtgccccggccccgactgcggcagcggcggccaccactactgggaccacctgcaccaccagggcatcgcccagaagcagtgcagcagaacccagggcgccagcgtgagacacatggaggtgatggtgttcctgagagagaagatcaccgaggagaccagcgccctgatggccctgcagagctggcagtactacaacccctag

SEQ ID NO: 19651 - DNA, 714 bp, Artificial Sequence
  Description of Artificial Sequence: Synthetic coding sequence
atgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgtgccccccgaggtgaccgtgctgaccaacagccccgtggagctgagagagcccaacgtgctgatctgcttcatcgacaagttcaccccccccgtggtgaacgtgacctggctgagaaacggcaagcccgtgaccaccggcgtgagcgagaccgtgttcctgcccagagaggaccacctgttcagaaagttccactacctgcccttcctgcccagcaccgaggacgtgtacgactgcagagtggagcactggggcctggacgagcccctgctgaagcactgggagttcgacgcccccagccccctgcccgagaccaccgagaacgtggtgtgcgccctgggcctgaccgtgggcctggtgggcatcatcatcggcaccatcttcatcatcaagggcgtgagaaagagcaacgccgccgagagaagaggccccctgtag

SEQ ID NO: 19652 - DNA, 498 bp, Artificial Sequence
  Description of Artificial Sequence: Synthetic coding sequence
atggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgtgccccccgaggtgaccgtgctgaccaacagccccgtggagctgagagagcccaacgtgctgatctgcttcatcgacaagttcaccccccccgtggtgaacgtgacctggctgagaaacggcaagcccgtgaccaccggcgtgagcgagaccgtgttcctgagcatcgccttcagctgcatctacttccccctgttccccatcatcctgctgagcccctgcaacgccagcggcatcaagcacaccggcgtgtgcctgtgctacggcatgccccacggcgccagcctggtgtacctgctgttcaaggtgagcagcaactgcgacttcagcgagcacaacaagctgttctag

SEQ ID NO: 19653 - DNA, 453 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaactacacccccatcaccaacgtgccccccgaggtgaccgtgctgaccaacagccccgtggagctgagagagcccaacgtgctgatctgcttcatcatcaagggcgtgagaaagagcaacgccgccgagagaagaggccccctgtag

SEQ ID NO: 19654 - DNA, 543 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaagcccagccccagagactacagagagagaggcgtgtgccccggccccgactgcggcagcggcggccaccactactgggaccacctgcaccaccagggcagcgcccagaagcagtgcagcagaacccagggcgccagcgtgagacacatggaggtgatggtgttcctgagagagaagatcaccgaggagaccagcgccctgatgaccctgcagagctggcagtactacaacccctag

SEQ ID NO: 19655 - DNA, 543 bp, Artificial Sequence; identical to SEQ ID NO: 19654
  Description of Artificial Sequence: Synthetic coding sequence

SEQ ID NO: 19656 - DNA, 498 bp, Artificial Sequence; identical to SEQ ID NO: 19652
  Description of Artificial Sequence: Synthetic coding sequence

SEQ ID NO: 19657 - DNA, 543 bp, Artificial Sequence; identical to SEQ ID NO: 19654
  Description of Artificial Sequence: Synthetic coding sequence

SEQ ID NO: 19658 - DNA, 498 bp, Artificial Sequence; identical to SEQ ID NO: 19652
  Description of Artificial Sequence: Synthetic coding sequence

SEQ ID NO: 19659 - DNA, 714 bp, Artificial Sequence; identical to SEQ ID NO: 19651
  Description of Artificial Sequence: Synthetic coding sequence

SEQ ID NO: 19660 - DNA, 543 bp, Artificial Sequence; identical to SEQ ID NO: 19654
  Description of Artificial Sequence: Synthetic coding sequence

SEQ ID NO: 19661 - DNA, 498 bp, Artificial Sequence; identical to SEQ ID NO: 19652
  Description of Artificial Sequence: Synthetic coding sequence

SEQ ID NO: 19662 - DNA, 498 bp, Artificial Sequence; identical to SEQ ID NO: 19652
  Description of Artificial Sequence: Synthetic coding sequence

SEQ ID NO: 19663 - DNA, 714 bp, Artificial Sequence; identical to SEQ ID NO: 19651
  Description of Artificial Sequence: Synthetic coding sequence

SEQ ID NO: 19664 - DNA, 543 bp, Artificial Sequence
  Description of Artificial Sequence: Synthetic coding sequence
atggccatcagcggcgtgcccgtgctgggcttcttcatcatcgccgtgctgatgagcgcccaggagagctgggccatcaaggaggagcacgtgatcatccaggccgagttctacctgaaccccgaccagagcggcgagttcatgttcgacttcgacggcgacgagatcttccacgtggacatggccaagaaggagaccgtgtggagactggaggagttcggcagattcgccagcttcgaggcccagggcgccctggccaacatcgccgtggacaaggccaacctggagatcatgaccaagagaagcaagcccagccccagagactacagagagtgcggcgtgtgccccggccccgactgcggcagcggcggccaccactactgggaccacctgcaccaccagggcagcgcccagaagcagtgcagcagaacccagggcgccagcgtgagacacatggaggtgatgatgttcctgagagagaagatcaccgaggagaccagcgccctgatgaccctgcagagctggcagtactacaacccctag

SEQ ID NO: 19665 - DNA, 498 bp, Artificial Sequence; identical to SEQ ID NO: 19652
  Description of Artificial Sequence: Synthetic coding sequence

SEQ ID NO: 19666 - DNA, 714 bp, Artificial Sequence; identical to SEQ ID NO: 19651
  Description of Artificial Sequence: Synthetic coding sequence

SEQ ID NO: 19667 - DNA, 801 bp, Artificial Sequence
  Description of Artificial Sequence: Synthetic coding sequence
atggtgtgcctgaagctgcccggcggcagctgcatggccgccctgaccgtgaccctgaccgtgctgagcagccccctggccctggccggcgacacccagcccagattcctggagcaggccaagtgcgagtgccacttcctgaacggcaccgagagagtgtggaacctgatcagatacatctacaaccaggaggagtacgccagatacaacagcgacctgggcgagtaccaggccgtgaccgagctgggcagacccgacgccgagtactggaacagccagaaggacctgctggagagaagaagagccgaggtggacacctactgcagatacaactacggcgtggtggagagcttcaccgtgcagagaagagtgcagcccaaggtgaccgtgtaccccagcaagacccagcccctgcagcaccacaacctgctggtgtgcagcgtgaacggcttctaccccggcagcatcgaggtgagatggttcagaaacggccaggaggagaaggccggcgtggtgagcaccggcctgatccagaacggcgactggaccttccagaccctggtgatgctggagaccgtgcccagaagcggcgaggtgtacacctgccaggtggagcaccccagcatgatgagccccctgaccgtgcagtggagcgccagaagcgagagcgcccagagcaagatgctgagcggcgtgggcggcttcgtgctgggcctgctgttcctgggcaccggcctgttcatctacttcagaaaccagaagggccacagcggcctgcagcccaccggcctgctgagctag

SEQ ID NO: 19668 - DNA, 801 bp, Artificial Sequence
  Description of Artificial Sequence: Synthetic coding sequence
atggtgtgcctgaagctgcccggcggcagctgcatggccgccctgaccgtgaccctgaccgtgctgagcagccccctggccctggccggcgacacccagcccagattcctggagcaggccaagtgcgagtgccacttcctgaacggcaccgagagagtgtggaacctgatcagatacatctacaaccaggaggagtacgccagatacaacagcgacctgggcgagtaccaggccgtgaccgagctgggcagacccgacgccgagtactggaacagccagaaggacctgctggagagaagaagagccgaggtggacacctactgcagatacaactacggcgtggtggagagcttcaccgtgcagagaagagtgcagcccaaggtgaccgtgtaccccagcaagacccagcccctgcagcaccacaacctgctggtgtgcagcgtgaacggcttctaccccggcagcatcgaggtgagatggttcagaaacagccaggaggagaaggccggcgtggtgagcaccggcctgatccagaacggcgactggaccttccagaccctggtgatgctggagaccgtgcccagaagcggcgaggtgtacacctgccaggtggagcaccccagcatgatgagccccctgaccgtgcagtggagcgccagaagcgagagcgcccagagcaagatgctgagcggcgtgggcggcttcgtgctgggcctgctgttcctgggcaccggcctgttcatctacttcagaaaccagaagggccacagcggcctgcagcccaccggcctgctgagctag

SEQ ID NO: 19669 - DNA, 801 bp, Artificial Sequence; identical to SEQ ID NO: 19667
  Description of Artificial Sequence: Synthetic coding sequence

SEQ ID NO: 19670 - DNA, 1173 bp, Artificial Sequence
  Description of Artificial Sequence: Synthetic coding sequence
atgagcgtgagagtggccagagtggcctgggtgagaggcctgggcgccagctacagaagaggcgccagcagcttccccgtgcccccccccggcgcccagggcgtggccgagctgctgagagacgccaccggcgccgaggaggaggccccctgggccgccaccgagagaagaatgcccggccagtgcagcgtgctgctgttccccggccagggcagccaggtggtgggcatgggcagaggcctgctgaactaccccagagtgagagagctgtacgccgccgccagaagagtgctgggctacgacctgctggagctgagcctgcacggcccccaggagaccctggacagaaccgtgcactgccagcccgccatcttcgtggccagcctggccgccgtggagaagctgcaccacctgcagcccagcgtgatcgagaactgcgtggccgccgccggcttcagcgtgggcgagttcgccgccctggtgttcgccggcgccatggagttcgccgagggcctgtacgccgtgaagatcagagccgaggccatgcaggaggccagcgaggccgtgcccagcggcatgctgagcgtgctgggccagccccagagcaagttcaacttcgcctgcctggaggccagagagcactgcaagagcctgggcatcgagaaccccgtgtgcgaggtgagcaactacctgttccccgactgcagagtgatcagcggccaccaggaggccctgagattcctgcagaagaacagcagcaagttccacttcagaagaaccagaatgctgcccgtgagcggcgccttccacaccagactgatggagcccgccgtggagcccctgacccaggccctgaaggccgtggacatcaagaagcccctggtgagcgtgtacagcaacgtgcacgcccacagatacagacaccccggccacatccacaagctgctggcccagcagctggtgagccccgtgaagtgggagcagaccatgcacgccatctacgagagaaagaagggcagaggcttcccccagaccttcgaggtgggccccggcagacagctgggcgccatcctgaagagctgcaacatgcaggcctggaagagctacagcgccgtggacgtgctgcagaccctggagcacgtggacctggacccccaggagccccccagatag

SEQ ID NO: 19671 - DNA, 543 bp, Artificial Sequence
  Description of Artificial Sequence: Synthetic coding sequence
atgagcgtgagagtggccagagtggcctgggtgagaggcctgggcgccagctacagaagaggcgccagcagcttccccgtgcccccccccggcgcccagggcgtggccgagctgctgagagacgccaccggcgccgaggaggaggccccctgggccgccaccgagagaagaatgcccggccagtgcagcgtgctgctgttccccggccagggcagccaggtggtgggcatgggcagaggcctgctgaactaccccagagtgagagagctgtacgccgccgccagaagagtgctgggctacgacctgctggagctgagcctgcacggcccccaggagaccctggacagaaccgtgcactgccagcccgccatcttcgtggccagcctggccgccgtggagaagctgcaccacctgcagcccagcgtgatcgagaactgcgtggccgccgccggcttcagcgtgggcgagttcgccgccctggtgttcgccggcgccatggagttcgccgagggcagcaccgtgagccccgaggagttcctgtag

SEQ ID NO: 19672 - DNA, 3414 bp, Artificial Sequence
  Description of Artificial Sequence: Synthetic coding sequence
atgcccctgagcagccacctgctgcccgccctggtgctgttcctggccggcagcagcggctgggcctgggtgcccaaccactgcagaagccccggccaggccgtgtgcaacttcgtgtgcgactgcagagactgcagcgacgaggcccagtgcggctaccacggcgccagccccaccctgggcgcccccttcgcctgcgacttcgagcaggacccctgcggctggagagacatcagcaccagcggctacagctggctgagagacagagccggcgccgccctggagggccccggcccccacagcgaccacaccctgggcaccgacctgggctggtacatggccgtgggcacccacagaggcaaggaggccagcaccgccgccctgagaagccccaccctgagagaggccgccagcagctgcaagctgagactgtggtaccacgccgccagcggcgacgtggccgagctgagagtggagctgacccacggcgccgagaccctgaccctgtggcagagcaccggcccctggggccccggctggcaggagctggccgtgaccaccggcagaatcagaggcgacttcagagtgaccttcagcgccaccagaaacgccacccacagaggcgccgtggccctggacgacctggagttctgggactgcggcctgcccaccccccaggccaactgcccccccggccaccaccactgccagaacaaggtgtgcgtggagccccagcagctgtgcgacggcgaggacaactgcggcgacctgagcgacgagaaccccctgacctgcggcagacacatcgccaccgacttcgagaccggcctgggcccctggaacagaagcgagggctggagcagaaaccacagagccggcggccccgagagacccagctggcccagaagagaccacagcagaaacagcgcccagggcagcttcctggtgagcgtggccgagcccggcacccccgccatcctgagcagccccgagttccaggccagcggcaccagcaactgcagcctggtgttctaccagtacctgagcggcagcgaggccggctgcctgcagctgttcctgcagaccctgggccccggcgcccccagagcccccgtgctgctgagaagaagaagaggcgagctgggcaccgcctgggtgagagacagagtggacatccagagcgcctaccccttccagatcctgctggccggccagaccggccccggcggcgtggtgggcctggacgacctgatcctgagcgaccactgcagacccgtgagcgaggtgagcaccctgcagcccctgccccccggccccagagcccccgccccccagcccctgccccccagcagcagactgcaggacagctgcaagcagggccacctggcctgcggcgacctgtgcgtgccccccgagcagctgtgcgacttcgaggagcagtgcgccggcggcgaggacgagcaggcctgcggcaccaccgacttcgagagccccgaggccggcggctgggaggacgccagcgtgggcagactgcagtggagaagagtgagcgcccaggagagccagggcagcagcgccgccgccgccggccacttcctgagcctgcagagagcctggggccagctgggcgccgaggccagagtgctgacccccctgctgggccccagcggccccagctgcgagctgcacctggcctactacctgcagagccagcccagagaggtgagctgcaacttcgagagagacacctgcagctggtaccccggccacctgagcgacacccactggagatgggtggagagcagaggccccgaccacgaccacaccaccggccagggccacttcgtgctgctggaccccaccgaccccctggcctggggccacagcgcccacctgctgagcagaccccaggtgcccgccgcccccaccgagtgcctgagcttctggtaccacctgcacggcccccagatcggcaccctgagactggccatgagaagagagggcgaggagacccacctgtggagcagaagcggcacccagggcaacagatggcacgaggcctgggccaccctgagccaccagcccggcagccacgcccagtaccagctgctgttcgagggcctgagagacggctaccacggcaccatggccctggacgacgtggccgtgagacccggcccctgctgggcccccaactactgcagcttcgaggacagcgactgcggcttcagccccggcggccagggcctgtggagaagacaggccaacgccagcggccacgccgcctggggcccccccaccgaccacaccaccgagaccgcccagggccactacatggtggtggacaccagccccgacgccctgcccagaggccagaccgccagcctgaccagcaaggagcacagacccctggcccagcccgcctgcctgaccttctggtaccacggcagcctgagaagccccggcaccctgagagtgtacctggaggagagaggcagacaccaggtgctgagcctgagcgcccacggcggcctggcctggagactgggcagcatggacgtgcaggccgagagagcctggagagtggtgttcgaggccgtggccgccggcgtggcccacagctacgtggccctggacgacctgctgctgcaggacggcccctgcccccagcccggcagctgcgacttcgagagcggcctgtgcggctggagccacctggcctggcccggcctgggcggctacagctgggactggggcggcggcgccacccccagcagatacccccagccccccgtggaccacaccctgggcaccgaggccggccacttcgccttcttcgagaccggcgtgctgggccccggcggcagagccgcctggctgagaagcgagcccctgcccgccacccccgccagctgcctgagattctggtaccacatgggcttccccgagcacttctacaagggcgagctgaaggtgctgctgcacagcgcccagggccagctggccgtgtggggcgccggcggccacagaagacaccagtggctggaggcccaggtggaggtggccagcgccaaggagttccagatcgtgttcgaggccaccctgggcggccagcccgccctgggccccatcgccctggacgacgtggagtacctggccggccagcactgccagcagcccgcccccagccccggcaacaccgccgcccccggcagcgtgcccgccgtggtgggcagcgccctgctgctgctgatgctgctggtgctgctgggcctgggcggcagaagatggctgcagaagaagggcagctgccccttccagagcaacaccgaggccaccgcccccggcttcgacaacatcctgttcaacgccgacggcgtgaccctgcccgccagcgtgaccagcgacccctag

SEQ ID NO: 19673 - DNA, 3609 bp, Artificial Sequence
  Description of Artificial Sequence: Synthetic coding sequence
tgaggctgggcctgggtgcccaaccactgcagaagccccggccaggccgtgtgcaacttcgtgtgcgactgcagagactgcagcgacgaggcccagtgcggctaccacggcgccagccccaccctgggcgcccccttcgcctgcgacttcgagcaggacccctgcggctggagagacatcagcaccagcggctacagctggctgagagacagagccggcgccgccctggagggccccggcccccacagcgaccacaccctgggcaccgacctgggctggtacatggccgtgggcacccacagaggcaaggaggccagcaccgccgccctgagaagccccaccctgagagaggccgccagcagctgcaagctgagactgtggtaccacgccgccagcggcgacgtggccgagctgagagtggagctgacccacggcgccgagaccctgaccctgtggcagagcaccggcccctggggccccggctggcaggagctggccgtgaccaccggcagaatcagaggcgacttcagagtgaccttcagcgccaccagaaacgccacccacagaggcgccgtggccctggacgacctggagttctgggactgcggcctgcccaccccccaggccaactgcccccccggccaccaccactgccagaacaaggtgtgcgtggagccccagcagctgtgcgacggcgaggacaactgcggcgacctgagcgacgagaaccccctgacctgcggcagacacatcgccaccgacttcgagaccggcctgggcccctggaacagaagcgagggctggagcagaaaccacagagccggcggccccgagagacccagctggcccagaagagaccacagcagaaacagcgcccagggcagcttcctggtgagcgtggccgagcccggcacccccgccatcctgagcagccccgagttccaggccagcggcaccagcaactgcagcctggtgttctaccagtacctgagcggcagcgaggccggctgcctgcagctgttcctgcagaccctgggccccggcgcccccagagcccccgtgctgctgagaagaagaagaggcgagctgggcaccgcctgggtgagagacagagtggacatccagagcgcctaccccttccagatcctgctggccggccagaccggccccggcggcgtggtgggcctggacgacctgatcctgagcgaccactgcagacccgtgagcgaggtgagcaccctgcagcccctgccccccggccccagagcccccgccccccagcccctgccccccagcagcagactgcaggacagctgcaagcagggccacctggcctgcggcgacctgtgcgtgccccccgagcagctgtgcgacttcgaggagcagtgcgccggcggcgaggacgagcaggcctgcggcaccaccgacttcgagagccccgaggccggcggctgggaggacgccagcgtgggcagactgcagtggagaagagtgagcgcccaggagagccagggcagcagcgccgccgccgccggcgaggcccagggccacttcctgagcctgcagagagcctggggccagctgggcgccgaggccagagtgctgacccccctgctgggccccagcggccccagctgcgagctgcacctggcctactacctgcagagccagcccagaggcttcctggccctggtggtggtggacaacggcagcagagagctggcctggcaggccctgagcagcagcgccggcatctggaaggtggacaaggtgctgctgggcgccagaagaagacccttcagactggagttcgtgggcctggtggacctggacggccccgaccagcagggcgccggcgtggacaacgtgaccctgagagactgcagccccaccgtgaccaccgagagagacagagaggtgagctgcaacttcgagagagacacctgcagctggtaccccggccacctgagcgacacccactggagatgggtggagagcagaggccccgaccacgaccacaccaccggccagggccacttcgtgctgctggaccccaccgaccccctggcctggggccacagcgcccacctgctgagcagaccccaggtgcccgccgcccccaccgagtgcctgagcttctggtaccacctgcacggcccccagatcggcaccctgagactggccatgagaagagagggcgaggagacccacctgtggagcagaagcggcacccagggcaacagatggcacgaggcctgggccaccctgagccaccagcccggcagccacgcccagtaccagctgctgttcgagggcctgagagacggctaccacggcaccatggccctggacgacgtggccgtgagacccggcccctgctgggcccccaactactgcagcttcgaggacagcgactgcggcttcagccccggcggccagggcctgtggagaagacaggccaacgccagcggccacgccgcctggggcccccccaccgaccacaccaccgagaccgcccagggccactacatggtggtggacaccagccccgacgccctgcccagaggccagaccgccagcctgaccagcaaggagcacagacccctggcccagcccgcctgcctgaccttctggtaccacggcagcctgagaagccccggcaccctgagagtgtacctggaggagagaggcagacaccaggtgctgagcctgagcgcccacggcggcctggcctggagactgggcagcatggacgtgcaggccgagagagcctggagagtggtgttcgaggccgtggccgccggcgtggcccacagctacgtggccctggacgacctgctgctgcaggacggcccctgcccccagcccggcagctgcgacttcgagagcggcctgtgcggctggagccacctggcctggcccggcctgggcggctacagctgggactggggcggcggcgccacccccagcagatacccccagccccccgtggaccacaccctgggcaccgaggccggccacttcgccttcttcgagaccggcgtgctgggccccggcggcagagccgcctggctgagaagcgagcccctgcccgccacccccgccagctgcctgagattctggtaccacatgggcttccccgagcacttctacaagggcgagctgaaggtgctgctgcacagcgcccagggccagctggccgtgtggggcgccggcggccacagaagacaccagtggctggaggcccaggtggaggtggccagcgccaaggagttccagatcgtgttcgaggccaccctgggcggccagcccgccctgggccccatcgccctggacgacgtggagtacctggccggccagcactgccagcagcccgcccccagccccggcaacaccgccgcccccggcagcgtgcccgccgtggtgggcagcgccctgctgctgctgatgctgctggtgctgctgggcctgggcggcagaagatggctgcagaagaagggcagctgccccttccagagcaacaccgaggccaccgcccccggcttcgacaacatcctgttcaacgccgacggcgtgaccctgcccgccagcgtgaccagcgacccctag

SEQ ID NO: 19674 - DNA, 3651 bp, Artificial Sequence
  Description of Artificial Sequence: Synthetic coding sequence
atgcccctgagcagccacctgctgcccgccctggtgctgttcctggccggcagcagcggctgggcctgggtgcccaaccactgcagaagccccggccaggccgtgtgcaacttcgtgtgcgactgcagagactgcagcgacgaggcccagtgcggctaccacggcgccagccccaccctgggcgcccccttcgcctgcgacttcgagcaggacccctgcggctggagagacatcagcaccagcggctacagctggctgagagacagagccggcgccgccctggagggccccggcccccacagcgaccacaccctgggcaccgacctgggctggtacatggccgtgggcacccacagaggcaaggaggccagcaccgccgccctgagaagccccaccctgagagaggccgccagcagctgcaagctgagactgtggtaccacgccgccagcggcgacgtggccgagctgagagtggagctgacccacggcgccgagaccctgaccctgtggcagagcaccggcccctggggccccggctggcaggagctggccgtgaccaccggcagaatcagaggcgacttcagagtgaccttcagcgccaccagaaacgccacccacagaggcgccgtggccctggacgacctggagttctgggactgcggcctgcccaccccccaggccaactgcccccccggccaccaccactgccagaacaaggtgtgcgtggagccccagcagctgtgcgacggcgaggacaactgcggcgacctgagcgacgagaaccccctgacctgcggcagacacatcgccaccgacttcgagaccggcctgggcccctggaacagaagcgagggctggagcagaaaccacagagccggcggccccgagagacccagctggcccagaagagaccacagcagaaacagcgcccagggcagcttcctggtgagcgtggccgagcccggcacccccgccatcctgagcagccccgagttccaggccagcggcaccagcaactgcagcctggtgttctaccagtacctgagcggcagcgaggccggctgcctgcagctgttcctgcagaccctgggccccggcgcccccagagcccccgtgctgctgagaagaagaagaggcgagctgggcaccgcctgggtgagagacagagtggacatccagagcgcctaccccttccagatcctgctggccggccagaccggccccggcggcgtggtgggcctggacgacctgatcctgagcgaccactgcagacccgtgagcgaggtgagcaccctgcagcccctgccccccggccccagagcccccgccccccagcccctgccccccagcagcagactgcaggacagctgcaagcagggccacctggcctgcggcgacctgtgcgtgccccccgagcagctgtgcgacttcgaggagcagtgcgccggcggcgaggacgagcaggcctgcggcaccaccgacttcgagagccccgaggccggcggctgggaggacgccagcgtgggcagactgcagtggagaagagtgagcgcccaggagagccagggcagcagcgccgccgccgccggccacttcctgagcctgcagagagcctggggccagctgggcgccgaggccagagtgctgacccccctgctgggccccagcggccccagctgcgagctgcacctggcctactacctgcagagccagcccagaggcttcctggccctggtggtggtggacaacggcagcagagagctggcctggcaggccctgagcagcagcgccggcatctggaaggtggacaaggtgctgctgggcgccagaagaagacccttcagactggagttcgtgggcctggtggacctggacggccccgaccagcagggcgccggcgtggacaacgtgaccctgagagactgcagccccaccgtgaccaccgagagagacagagaggtgagctgcaacttcgagagagacacctgcagctggtaccccggccacctgagcgacacccactggagatgggtggagagcagaggccccgaccacgaccacaccaccggccagggccacttcgtgctgctggaccccaccgaccccctggcctggggccacagcgcccacctgctgagcagaccccaggtgcccgccgcccccaccgagtgcctgagcttctggtaccacctgcacggcccccagatcggcaccctgagactggccatgagaagagagggcgaggagacccacctgtggagcagaagcggcacccagggcaacagatggcacgaggcctgggccaccctgagccaccagcccggcagccacgcccagtaccagctgctgttcgagggcctgagagacggctaccacggcaccatggccctggacgacgtggccgtgagacccggcccctgctgggcccccaactactgcagcttcgaggacagcgactgcggcttcagccccggcggccagggcctgtggagaagacaggccaacgccagcggccacgccgcctggggcccccccaccgaccacaccaccgagaccgcccagggccactacatggtggtggacaccagccccgacgccctgcccagaggccagaccgccagcctgaccagcaaggagcacagacccctggcccagcccgcctgcctgaccttctggtaccacggcagcctgagaagccccggcaccctgagagtgtacctggaggagagaggcagacaccaggtgctgagcctgagcgcccacggcggcctggcctggagactgggcagcatggacgtgcaggccgagagagcctggagagtggtgttcgaggccgtggccgccggcgtggcccacagctacgtggccctggacgacctgctgctgcaggacggcccctgcccccagcccggcagctgcgacttcgagagcggcctgtgcggctggagccacctggcctggcccggcctgggcggctacagctgggactggggcggcggcgccacccccagcagatacccccagccccccgtggaccacaccctgggcaccgaggccggccacttcgccttcttcgagaccggcgtgctgggccccggcggcagagccgcctggctgagaagcgagcccctgcccgccacccccgccagctgcctgagattctggtaccacatgggcttccccgagcacttctacaagggcgagctgaaggtgctgctgcacagcgcccagggccagctggccgtgtggggcgccggcggccacagaagacaccagtggctggaggcccaggtggaggtggccagcgccaaggagttccagatcgtgttcgaggccaccctgggcggccagcccgccctgggccccatcgccctggacgacgtggagtacctggccggccagcactgccagcagcccgcccccagccccggcaacaccgccgcccccggcagcgtgcccgccgtggtgggcagcgccctgctgctgctgatgctgctggtgctgctgggcctgggcggcagaagatggctgcagaagaagggcagctgccccttccagagcaacaccgaggccaccgcccccggcttcgacaacatcctgttcaacgccgacggcgtgaccctgcccgccagcgtgaccagcgacccctag

SEQ ID NO: 19675 - DNA, 1353 bp, Artificial Sequence
  Description of Artificial Sequence: Synthetic coding sequence
atgatgcagttcgcctggcagagctacaagagatacgccatgggcaagaacgagctgagacccctgaccaaggacggctacgagggcaacatgttcggcggcctgagcggcgccaccgtgatcgacagcctggacaccctgtacctgatggagctgaaggaggagttccaggaggccaaggcctgggtgggcgagagcttccacctgaacgtgagcggcgaggccagcctgttcgaggtgaacatcagatacatcggcggcctgctgagcgccttctacctgaccggcgaggaggtgttcagaatcaaggccatcagactgggcgagaagctgctgcccgccttcaacacccccaccggcatccccaagggcgtggtgagcttcaagagcggcaactggggctgggccaccgccggcagcagcagcatcctggccgagttcggcagcctgcacctggagttcctgcacctgaccgagctgagcggcaaccaggtgttcgccgagaaggtgagaaacatcagaaaggtgctgagaaagatcgagaagcccttcggcctgtaccccaacttcctgagccccgtgagcggcaactgggtgcagcaccacgtgagcgtgggcggcctgggcgacagcttctacgagtacctgatcaagagctggctgatgagcggcaagaccgacatggaggccaagaacatgtactacgaggccctggaggccatcgagacctacctgctgaacgtgagccccggcggcctgacctacatcgccgagtggagaggcggcatcctggaccacaagatgggccacctggcctgcttcagcggcggcatgatcgccctgggcgccgaggacgccaaggaggagaagagagcccactacagagagctggccgcccagatcaccaagacctgccacgagagctacgccagaagcgacaccaagctgggccccgaggccttctggttcaacagcggcagagaggccgtggccacccagctgagcgagagctactacatcctgagacccgaggtggtggagagctacatgtacctgtggagacagacccacaaccccatctacagagagtggggctgggaggtggtgctggccctggagaagtactgcagaaccgaggccggcttcagcggcatccaggacgtgtacagcagcacccccaaccacgacaacaagcagcagagcttcttcctggccgagaccctgaagtacctgtacctgctgttcagcgaggacgacctgctgagcctggaggactgggtgttcaacaccgaggcccaccccctgcccgtgaaccacagcgacagcagcggcagagcctggggcagacactag

SEQ ID NO: 19676 - DNA, 1206 bp, Artificial Sequence
  Description of Artificial Sequence: Synthetic coding sequence
atggagctgaaggaggagttccaggaggccaaggcctgggtgggcgagagcttccacctgaacgtgagcggcgaggccagcctgttcgaggtgaacatcagatacatcggcggcctgctgagcgccttctacctgaccggcgaggaggtgttcagaatcaaggccatcagactgggcgagaagctgctgcccgccttcaacacccccaccggcatccccaagggcgtggtgagcttcaagagcggcaactggggctgggccaccgccggcagcagcagcatcctggccgagttcggcagcctgcacctggagttcctgcacctgaccgagctgagcggcaaccaggtgttcgccgagaaggtgagaaacatcagaaaggtgctgagaaagatcgagaagcccttcggcctgtaccccaacttcctgagccccgtgagcggcaactgggtgcagcaccacgtgagcgtgggcggcctgggcgacagcttctacgagtacctgatcaagagctggctgatgagcggcaagaccgacatggaggccaagaacatgtactacgaggccctggaggccatcgagacctacctgctgaacgtgagccccggcggcctgacctacatcgccgagtggagaggcggcatcctggaccacaagatgggccacctggcctgcttcagcggcggcatgatcgccctgggcgccgaggacgccaaggaggagaagagagcccactacagagagctggccgcccagatcaccaagacctgccacgagagctacgccagaagcgacaccaagctgggccccgaggccttctggttcaacagcggcagagaggccgtggccacccagctgagcgagagctactacatcctgagacccgaggtggtggagagctacatgtacctgtggagacagacccacaaccccatctacagagagtggggctgggaggtggtgctggccctggagaagtactgcagaaccgaggccggcttcagcggcatccaggacgtgtacagcagcacccccaaccacgacaacaagcagcagagcttcttcctggccgagaccctgaagtacctgtacctgctgttcagcgaggacgacctgctgagcctggaggactgggtgttcaacaccgaggcccaccccctgcccgtgaaccacagcgacagcagcggcagagcctggggcagacactag

SEQ ID NO: 19677 - DNA, 1170 bp, Artificial Sequence
  Description of Artificial Sequence: Synthetic coding sequence
atgatgcagttcgcctggcagagctacaagagatacgccatgggcaagaacgagctgagacccctgaccaaggacggctacgagggcaacatgttcggcggcctgagcggcgccaccgtgatcgacagcctggacaccctgtacctgatggagctgaaggaggagttccaggaggccaaggcctgggtgggcgagagcttccacctgaacgtgagcggcgaggccagcctgttcgaggtgaacatcagatacatcggcggcctgctgagcgccttctacctgaccggcgaggaggtgttcagaatcaaggccatcagactgggcgagaagctgctgcccgccttcaacacccccaccggcatccccaagggcgtggtgagcttcaagagcggcaactggggctgggccaccgccggcagcagcagcatcctggccgagttcggcagcctgcacctggagttcctgcacctgaccgagctgagcggcaaccaggtgttcgccgagaaggtgagaaacatcagaaaggtgctgagaaagatcgagaagcccttcggcctgtaccccaacttcctgagccccgtgagcggcaactgggtgcagcaccacgtgagcgtgggcggcctgggcgacagcttctacgagtacctgatcaagagctggctgatgagcggcaagaccgacatggaggccaagaacatgtactacgaggccctggaggccatcgagacctacctgctgaacgtgagccccggcggcctgacctacatcgccgagtggagaggcggcatcctggaccacaagatgggccacctggcctgcttcagcggcggcatgatcgccctgggcgccgaggacgccaaggaggagaagagagcccactacagagagctggccgcccagatcaccaagacctgccacgagagctacgccagaagcgacaccaagctgggccccgaggccttctggttcaacagcggcagagaggccgtggccacccagctgagcgagagctactacatcctgagacccgaggtggtggagagctacatgtacctgtggagacagacccacaaccccatctacagagagtggggctgggagggcgccggcctgggcgagatcctgagcgacagaagcagattcctgtgggaccccagaagagtgcagtag

SEQ ID NO: 19678 - DNA, 1893 bp, Artificial Sequence
  Description of Artificial Sequence: Synthetic coding sequence
atgctgatgagaaaggtgcccggcttcgtgcccgccagcccctggggcctgagactgccccagaagttcctgttcctgctgttcctgagcggcctggtgaccctgtgcttcggcgccctgttcctgctgccccacagcagcagactgaagagactgttcctggcccccagaacccagcagcccggcctggaggtggtggccgagatcgccggccacgcccccgccagagagcaggagcccccccccaaccccgcccccgccgcccccgcccccggcgaggacgaccccagcagctgggccagccccagaagaagaaagggcggcctgagaagaaccagacccaccggccccagagaggaggccaccgccgccagaggcaacagcatccccgccagcagacccggcgacgagggcgtgcccttcagattcgacttcaacgccttcagaagcagactgagacaccccgtgctgggcaccagagccgacgagagccaggagccccagagccaggtgagagcccagagagagaagatcaaggagatgatgcagttcgcctggcagagctacaagagatacgccatgggcaagaacgagctgagacccctgaccaaggacggctacgagggcaacatgttcggcggcctgagcggcgccaccgtgatcgacagcctggacaccctgtacctgatggagctgaaggaggagttccaggaggccaaggcctgggtgggcgagagcttccacctgaacgtgagcggcgaggccagcctgttcgaggtgaacatcagatacatcggcggcctgctgagcgccttctacctgaccggcgaggaggtgttcagaatcaaggccatcagactgggcgagaagctgctgcccgccttcaacacccccaccggcatccccaagggcgtggtgagcttcaagagcggcaactggggctgggccaccgccggcagcagcagcatcctggccgagttcggcagcctgcacctggagttcctgcacctgaccgagctgagcggcaaccaggtgttcgccgagaaggtgagaaacatcagaaaggtgctgagaaagatcgagaagcccttcggcctgtaccccaacttcctgagccccgtgagcggcaactgggtgcagcaccacgtgagcgtgggcggcctgggcgacagcttctacgagtacctgatcaagagctggctgatgagcggcaagaccgacatggaggccaagaacatgtactacgaggccctggaggccatcgagacctacctgctgaacgtgagccccggcggcctgacctacatcgccgagtggagaggcggcatcctggaccacaagatgggccacctggcctgcttcagcggcggcatgatcgccctgggcgccgaggacgccaaggaggagaagagagcccactacagagagctggccgcccagatcaccaagacctgccacgagagctacgccagaagcgacaccaagctgggccccgaggccttctggttcaacagcggcagagaggccgtggccacccagctgagcgagagctactacatcctgagacccgaggtggtggagagctacatgtacctgtggagacagacccacaaccccatctacagagagtggggctgggaggtggtgctggccctggagaagtactgcagaaccgaggccggcttcagcggcatccaggacgtgtacagcagcacccccaaccacgacaacaagcagcagagcttcttcctggccgagaccctgaagtacctgtacctgctgttcagcgaggacgacctgctgagcctggaggactgggtgttcaacaccgaggcccaccccctgcccgtgaaccacagcgacagcagcggcagagcctggggcagacactag

SEQ ID NO: 19679 - DNA, 258 bp, Artificial Sequence
  Description of Artificial Sequence: Synthetic coding sequence
atggccagcgacctggacttcagcccccccgaggtgcccgagcccaccttcctggagaacctgctgagatacggcctgttcctgggcgccatcttccagctgatctgcgtgctggccatcatcgtgcccatccccaagagccacgaggccgaggccgagcccagcgagcccagaagcgccgaggtgaccagaaagcccaaggccgccgtgcccagcgtgaacaagagacccaagaaggagaccaagaagaagagatag

SEQ ID NO: 19680 - DNA, 258 bp, Artificial Sequence; identical to SEQ ID NO: 19679
  Description of Artificial Sequence: Synthetic coding sequence

SEQ ID NO: 19681 - DNA, 171 bp, Artificial Sequence
  Description of Artificial Sequence: Synthetic coding sequence
atggccagcgacctggacttcagcccccccgaggtgcccgagcccaccttcctggagaacctgctgagatacggcctgttcctgggcgccatcttccagctgatctgcgtgctggccatcatcgtgcccatccccaagagccacgaggccgagttccacgtggaggcctag

SEQ ID NO: 19682 - DNA, 258 bp, Artificial Sequence; identical to SEQ ID NO: 19679
  Description of Artificial Sequence: Synthetic coding sequence

SEQ ID NO: 19683 - DNA, 258 bp, Artificial Sequence; identical to SEQ ID NO: 19679
  Description of Artificial Sequence: Synthetic coding sequence

SEQ ID NO: 19684 - DNA, 258 bp, Artificial Sequence; identical to SEQ ID NO: 19679
  Description of Artificial Sequence: Synthetic coding sequence

SEQ ID NO: 19685 - DNA, 708 bp, Artificial Sequence
  Description of Artificial Sequence: Synthetic coding sequence
atgatcaccggcagcccccagatgacctggtgcccccccttctggaccccccccatcagcaccgccagcagatacggcagccacggcgccttctacagatacaagaacagcatgggcaagagcctgcccctgttctacatctacgacagctacctgaccagccccgaggcctgggcccacctgctgacccccaacggcccccacagcatcagaaacaccccctacgacggcgtgttcatcgccctgctggtggaggagggccacacccacgacatcctggccgccggcttcgacggcatgtacacctacttcgccagcaacggcttcagcttcggcagcagccaccagaactggaaggccgtgaagaacttctgcgacgccaacaacctgatgttcatccccagcgtgggccccggctacatcgacaccagcatcagaccctggaacaaccacaacaccagaaacagagtgaacggcaagtactacgagaccgccctgcaggccgccctgaccgtgagacccgagatcgtgagcatcaccagcttcaacgagtggcacgagggcacccagatcgagaaggccatccccaagaagacccccaccagactgtacctggactacctgccccaccagcccagcctgtacctggagctgaccagaagatgggccgagcacttcatcaaggagaaggagcagtggctgatgtag

SEQ ID NO: 19686 - DNA, 1374 bp, Artificial Sequence
  Description of Artificial Sequence: Synthetic coding sequence
atggccagaagaagaagaagagcctgcatcgccctgttcctggtgctgctgttcgccttcggcaccctgatgggcctgagaaccctgaaggcccccgacggcctgcccgccctgggccccggcctggagctggcccccttcgagagaagacccgagggcgcccccgcccccgccgccagagcccccgccgcccccgccgccccccccccccccccccccccccccagaaccgccgaccccggcggcagccccggccccgcccccgccgaggccgagcccgcccccgtgcagagcctgagagtgtacagcgacctgcacgccttctactacagctggtacggcagccccagaagagagggccactacatccactgggaccacgtgatggtgccccactgggaccccaagatcagcgccagctaccccagaggcagacacagcccccccgacgacctgggcagcagcttctaccccgagctgggcccctacagcagcagagaccccgaggtgctgagagagcacatgacccagctgaaggaggccgccatcggcgtgctggtgctgagctggtacccccccggcatggccgacgacaacggcgagcccagcgacgacctggtgcccgccatcctggacaccgcccaccagtacagcatccaggtggccttccacatccagccctacaagggcagagacgacatcaccgtgcacgacaacatcaagtacatcatcgacacctacggcagccacggcgccttctacagatacaagaacagcatgggcaagagcctgcccctgttctacatctacgacagctacctgaccagccccgaggcctgggcccacctgctgacccccaacggcccccacagcatcagaaacaccccctacgacggcgtgttcatcgccctgctggtggaggagggccacacccacgacatcctggccgccggcttcgacggcatgtacacctacttcgccagcaacggcttcagcttcggcagcagccaccagaactggaaggccgtgaagaacttctgcgacgccaacaacctgatgttcatccccagcgtgggccccggctacatcgacaccagcatcagaccctggaacaaccacaacaccagaaacagagtgaacggcaagtactacgagaccgccctgcaggccgccctgaccgtgagacccgagatcgtgagcatcaccagcttcaacgagtggcacgagggcacccagatcgagaaggccatccccaagaagacccccaccagactgtacctggactacctgccccaccagcccagcctgtacctggagctgaccagaagatgggccgagcacttcatcaaggagaaggagcagtggctgatgtag

SEQ ID NO: 19687 - DNA, 753 bp, Artificial Sequence
  Description of Artificial Sequence: Synthetic coding sequence
atggccagaagaagaagaagagcctgcatcgccctgttcctggtgctgctgttcgccttcggcaccctgatgggcctgagaaccctgaaggcccccgacggcctgcccgccctgggccccggcctggagctggcccccttcgagagaagacccgagggcgcccccgcccccgccgccagagcccccgccgcccccgccgccccccccccccccccccccccccccagaaccgccgaccccggcggcagccccggccccgcccccgccgaggccgagcccgcccccgtgcagagcctgagagtgtacagcgacctgcacgccttctactacagctggtacggcagccccagaagagagggccactacatccactgggaccacgtgatggtgccccactgggaccccaagatcagcgccagctaccccagaggcagacacagcccccccgacgacctgggcagcagcttctaccccgagctgggcccctacagcagcagagaccccgaggtgctgagagagcacatgacccagctgaaggaggccgccatcggcgtgctggtgctgagctggtacccccccggcatggccgacgacaacggcgagcccagcgacgacctggtgcccgccatcctggacaccgcccaccagtacagcatccaggtggccttccacatccagccctacaagggcagagacgacatcaccgtgcacgacaacatcaagtacatcatcgacaccaccggcaagctgtag

SEQ ID NO: 19688 - DNA, 1437 bp, Artificial Sequence
  Description of Artificial Sequence: Synthetic coding sequence
atgttcaagttccaccagatgaagcacatcttcgagatcctggacaagatgagatgcctgagaaagagaagcaccgtgagcttcctgggcgtgctggtgatcttcctgctgttcatgaacctgtacatcgaggacagctacgtgctggagggcgacaagcagctgatcagagagaccagcacccaccagctgaacagcgagagatacgtgcacaccttcaaggacctgagcaacttcagcggcgccatcaacgtgacctacagatacctggccgccacccccctgcagagaaagagatacctgaccatcggcctgagcagcgtgaagagaaagaagggcaactacctgctggagaccatcaagagcatcttcgagcagagcagctacgaggagctgaaggagatcagcgtggtggtgcacctggccgacttcaacagcagctggagagacgccatggtgcaggacatcacccagaagttcgcccaccacatcatcgccggcagactgatggtgatccacgcccccgaggagtactaccccatcctggacggcctgaagagaaactacaacgaccccgaggacagagtgaagttcagaagcaagcagaacgtggactacgccttcctgctgaacttctgcgccaacaccagcgactactacgtgatgctggaggacgacgtgagatgcagcaagaacttcctgaccgccatcaagaaggtgatcgccagcctggagggcacctactgggtgaccctggagttcagcaagctgggctacatcggcaagctgtaccacagccacgacctgcccagactggcccacttcctgctgatgttctaccaggagatgccctgcgactggctgctgacccacttcagaggcctgctggcccagaagaacgtgatcagattcaagcccagcctgttccagcacatgggctactacagcagctacaagggcaccgagaacaagctgaaggacgacgacttcgaggaggagagcttcgacatccccgacaacccccccgccagcctgtacaccaacatgaacgtgttcgagaactacgaggccagcaaggcctacagcagcgtggacgagtacttctggggcaagccccccagcaccggcgacgtgttcgtgatcgtgttcgagaaccccatcatcatcaagaagatcaaggtgaacaccggcaccgaggacagacagaacgacatcctgcaccacggcgccctggacgtgggcgagaacgtgatgcccagcaagcagagaagacagtgcagcacctacctgagactgggcgagttcaagaacggcaacttcgagatgagcggcgtgaaccagaagatccccttcgacatccactgcatgagaatctacgtgaccaagacccagaaggagtggctgatcatcagaagcatcagcatctggaccagctag

SEQ ID NO: 19689 - DNA, 1524 bp, Artificial Sequence
  Description of Artificial Sequence: Synthetic coding sequence
atgctgggcaaggacatggtgagattcgtggtgagaaagaccgtgcagagaagcgtggccaagggcagcagaagatgcaagaagagaatgttcaagttccaccagatgaagcacatcttcgagatcctggacaagatgagatgcctgagaaagagaagcaccgtgagcttcctgggcgtgctggtgatcttcctgctgttcatgaacctgtacatcgaggacagctacgtgctggagggcgacaagcagctgatcagagagaccagcacccaccagctgaacagcgagagatacgtgcacaccttcaaggacctgagcaacttcagcggcgccatcaacgtgacctacagatacctggccgccacccccctgcagagaaagagatacctgaccatcggcctgagcagcgtgaagagaaagaagggcaactacctgctggagaccatcaagagcatcttcgagcagagcagctacgaggagctgaaggagatcagcgtggtggtgcacctggccgacttcaacagcagctggagagacgccatggtgcaggacatcacccagaagttcgcccaccacatcatcgccggcagactgatggtgatccacgcccccgaggagtactaccccatcctggacggcctgaagagaaactacaacgaccccgaggacagagtgaagttcagaagcaagcagaacgtggactacgccttcctgctgaacttctgcgccaacaccagcgactactacgtgatgctggaggacgacgtgagatgcagcaagaacttcctgaccgccatcaagaaggtgatcgccagcctggagggcacctactgggtgaccctggagttcagcaagctgggctacatcggcaagctgtaccacagccacgacctgcccagactggcccacttcctgctgatgttctaccaggagatgccctgcgactggctgctgacccacttcagaggcctgctggcccagaagaacgtgatcagattcaagcccagcctgttccagcacatgggctactacagcagctacaagggcaccgagaacaagctgaaggacgacgacttcgaggaggagagcttcgacatccccgacaacccccccgccagcctgtacaccaacatgaacgtgttcgagaactacgaggccagcaaggcctacagcagcgtggacgagtacttctggggcaagccccccagcaccggcgacgtgttcgtgatcgtgttcgagaaccccatcatcatcaagaagatcaaggtgaacaccggcaccgaggacagacagaacgacatcctgcaccacggcgccctggacgtgggcgagaacgtgatgcccagcaagcagagaagacagtgcagcacctacctgagactgggcgagttcaagaacggcaacttcgagatgagcggcgtgaaccagaagatccccttcgacatccactgcatgagaatctacgtgaccaagacccagaaggagtggctgatcatcagaagcatcagcatctggaccagctag

SEQ ID NO: 19690 - DNA, 1197 bp, Artificial Sequence
  Description of Artificial Sequence: Synthetic coding sequence
atgttcaagttccaccagatgaagcacatcttcgagatcctggacaagatgagatgcctgagaaagagaagcaccgtgagcttcctgggcgtgctggtgatcttcctgctgttcatgaacctgtacatcgaggacagctacgtgctggagggcgacaagcagctgatcagagagaccagcacccaccagctgaacagcgagagatacgtgcacaccttcaaggacctgagcaacttcagcggcgccatcaacgtgacctacagatacctggccgccacccccctgcagagaaagagatacctgaccatcggcctgagcagcgtgaagagaaagaagggcaactacctgctggagaccatcaagagcatcttcgagcagagcagctacgaggagctgaaggagatcagcgtggtggtgcacctggccgacttcaacagcagctggagagacgccatggtgcaggacatcacccagaagttcgcccaccacatcatcgccggcagactgatggtgatccacgcccccgaggagtactaccccatcctggacggcctgaagagaaactacaacgaccccgaggacagagtgaagttcagaagcaagcagaacgtggactacgccttcctgctgaacttctgcgccaacaccagcgactactacgtgatgctggaggacgacgtgagatgcagcaagaacttcctgaccgccatcaagaaggtgatcgccagcctggagggcacctactgggtgaccctggagttcagcaagctgggctacatcggcaagctgtaccacagccacgacctgcccagactggcccacttcctgctgatgttctaccaggagatgccctgcgactggctgctgacccacttcagaggcctgctggcccagaagaacgtgatcagattcaagcccagcctgttccagcacatgggctactacagcagctacaagggcaccgagaacaagctgaaggacgacgacttcgaggaggagagcttcgacatccccgacaacccccccgccagcctgtacaccaacatgaacgtgttcgagaactacgaggccagcaaggcctacagcagcgtggacgagtacttctggggcaagccccccagcaccggcgacgtgttcgtgatcgtgttcgagaaccccatcatcatcaagaagatcaaggtgaacaccggcacctag

SEQ ID NO: 19691 - DNA, 1437 bp, Artificial Sequence; identical to SEQ ID NO: 19688
  Description of Artificial Sequence: Synthetic coding sequence

SEQ ID NO: 19692 - DNA, 1437 bp, Artificial Sequence; identical to SEQ ID NO: 19688
  Description of Artificial Sequence: Synthetic coding sequence

SEQ ID NO: 19693 - DNA, 1437 bp, Artificial Sequence; identical to SEQ ID NO: 19688
  Description of Artificial Sequence: Synthetic coding sequence

SEQ ID NO: 19694 - DNA, 1437 bp, Artificial Sequence; identical to SEQ ID NO: 19688
  Description of Artificial Sequence: Synthetic coding sequence

SEQ ID NO: 19695 - DNA, 810 bp, Artificial Sequence
  Description of Artificial Sequence: Synthetic coding sequence
atggccagagccagcagcggcaacggcagcgaggaggcctggggcgccctgagagccccccagcagcagctgagagagctgtgccccggcgtgaacaaccagccctacctgtgcgagagcggccactgctgcggcgagaccggctgctgcacctactactacgagctgtggtggttctggctgctgtggaccgtgctgatcctgttcagctgctgctgcgccttcagacacagaagagccaagctgagactgcagcagcagcagagacagagagagatcaacctgctggcctaccacggcgcctgccacggcgccggccccttccccaccggcagcctgctggacctgagattcctgagcaccttcaagccccccgcctacgaggacgtggtgcacagacccggcacccccccccccccctacaccgtggcccccggcagacccctgaccgccagcagcgagcagacctgctgcagcagcagcagcagctgccccgcccacttcgagggcaccaacgtggagggcgtgagcagccaccagagcgcccccccccaccaggagggcgagcccggcgccggcgtgacccccgccagcaccccccccagctgcagatacagaagactgaccggcgacagcggcatcgagctgtgcccctgccccgccagcggcgagggcgagcccgtgaaggaggtgagagtgagcgccaccctgcccgacctggaggactacagcccctgcgccctgccccccgagagcgtgccccagatcttccccatgggcctgagcagcagcgagggcgacatcccctag

SEQ ID NO: 19696 - DNA, 2196 bp, Artificial Sequence
  Description of Artificial Sequence: Synthetic coding sequence
atgaagaccagaagccccaagcccctgctgaccggcctgatgtgggcccagcagggcaccacccccggcacccccaagctgagacacacctgcgagcagggcgacggcgtgggcccctacggctgggagttccacgacggcctgagcttcggcagacagcacatccaggacggcgccctgagactgaccaccgagttcgtgaagagacccggcggccagcacggcggcgactggagctggagagtgaccgtggagccccaggacagcggcaccagcgccctgcccctggtgagcctgttcttctacgtggtgaccgacggcaaggaggtgctgctgcccgaggtgggcgccaagggccagctgaagttcatcagcggccacaccagcgagctgggcgacttcagattcaccctgctgccccccaccagccccggcgacaccgcccccaagtacggcagctacaacgtgttctggaccagcaaccccggcctgcccctgctgaccgagatggtgaagagcagactgaacagctggttccagcacagaccccccggcgccccccccgagagatacctgggcctgcccggcagcctgaagtgggaggacagaggccccagcggccagggccagggccagttcctgatccagcaggtgaccctgaagatccccatcagcatcgagttcgtgttcgagagcggcagcgcccaggccggcggcaaccaggccctgcccagactggccggcagcctgctgacccaggccctggagagccacgccgagggcttcagagagagattcgagaagaccttccagctgaaggagaagggcctgagcagcggcgagcaggtgctgggccaggccgccctgagcggcctgctgggcggcatcggctacttctacggccagggcctggtgctgcccgacatcggcgtggagggcagcgagcagaaggtggaccccgccctgttcccccccgtgcccctgttcaccgccgtgcccagcagaagcttcttccccagaggcttcctgtgggacgagggcttccaccagctggtggtgcagagatgggaccccagcctgaccagagaggccctgggccactggctgggcctgctgaacgccgacggctggatcggcagagagcagatcctgggcgacgaggccagagccagagtgccccccgagttcctggtgcagagagccgtgcacgccaacccccccaccctgctgctgcccgtggcccacatgctggaggtgggcgaccccgacgacctggccttcctgagaaaggccctgcccagactgcacgcctggttcagctggctgcaccagagccaggccggccccctgcccctgagctacagatggagaggcagagaccccgccctgcccaccctgctgaaccccaagaccctgcccagcggcctggacgactaccccagagccagccaccccagcgtgaccgagagacacctggacctgagatgctgggtggccctgggcgccagagtgctgaccagactggccgagcacctgggcgaggccgaggtggccgccgagctgggccccctggccgccagcctggaggccgccgagagcctggacgagctgcactgggcccccgagctgggcgtgttcgccgacttcggcaaccacaccaaggccgtgcagctgaagcccagacccccccagggcctggtgagagtggtgggcagaccccagccccagctgcagtacgtggacgccctgggctacgtgagcctgttccccctgctgctgagactgctggaccccaccagcagcagactgggccccctgctggacatcctggccgacagcagacacctgtggagccccttcggcctgagaagcctggccgccagcagcagcttctacggccagagaaacagcgagcacgaccccccctactggagaggcgccgtgtggctgaacgtgaactacctggccctgggcgccctgcaccactacggccacctggagggcccccaccaggccagagccgccaagctgcacggcgagctgagagccaacgtggtgggcaacgtgtggagacagtaccaggccaccggcttcctgtgggagcagtacagcgacagagacggcagaggcatgggctgcagacccttccacggctggaccagcctggtgctgctggccatggccgaggactactag

SEQ ID NO: 19697 - DNA, 480 bp, Artificial Sequence
  Description of Artificial Sequence: Synthetic coding sequence
atggccagaggcgagagaagaagaagagccgtgcccgccgagggcgtgagaaccgccgagagagccgccagaggcggccccggcagaagagacggcagaggcggcggccccagaagcaccgccggcggcgtggccctggccgtggtggtgctgagcctggccctgggcatgagcggcagatgggtgctggcctggtacagagccagaagagccgtgaccctgcacagcgccccccccgtgctgcccgccgacagcagcagccccgccgtggcccccgacctgttctggggcacctacagaccccacgtgtacttcggcatgaagaccagaagccccaagcccctgctgaccggcctgagatacttctgcccccccttcggcctgcccgtgctgctgtgcggcgacagatggcagggcagccccaccaccagaggctggggccagggcgccgtggaggtgtaccagtgggcccaccagtag

SEQ ID NO: 19698 - DNA, 1296 bp, Artificial Sequence
  Description of Artificial Sequence: Synthetic coding sequence
atgttcttcggcggcgagggcagcctgacctacaccctggtgatcatctgcttcctgaccctgagactgagcgccagccagaactgcctgaagaagagcctggaggacgtggtgatcgacatccagagcagcctgagcaagggcatcagaggcaacgagcccgtgtacaccagcacccaggaggactgcatcaacagctgctgcagcaccaagaacatcagcggcgacaaggcctgcaacctgatgatcttcgacaccagaaagaccgccagacagcccaactgctacctgttcttctgccccaacgaggaggcctgccccctgaagcccgccaagggcctgatgagctacagaatcatcaccgacttccccagcctgaccagaaacctgcccagccaggagctgccccaggaggacagcctgctgcacggccagttcagccaggccgtgacccccctggcccaccaccacaccgactacagcaagcccaccgacatcagctggagagacaccctgagccagaagttcggcagcagcgaccacctggagaagctgttcaagatggacgaggccagcgcccagctgctggcctacaaggagaagggccacagccagagcagccagttcagcagcgaccaggagatcgcccacctgctgcccgagaacgtgagcgccctgcccgccaccgtggccgtggccagcccccacaccaccagcgccacccccaagcccgccaccctgctgcccaccaacgccagcgtgacccccagcggcaccagccagccccagctggccaccaccgccccccccgtgaccaccgtgaccagccagccccccaccaccctgatcagcaccgtgttcaccagagccgccgccaccctgcaggccatggccaccaccgccgtgctgaccaccaccttccaggcccccaccgacagcaagggcagcctggagaccatccccttcaccgagatcagcaacctgaccctgaacaccggcaacgtgtacaaccccaccgccctgagcatgagcaacgtggagagcagcaccatgaacaagaccgccagctgggagggcagagaggccagccccggcagcagcagccagggcagcgtgcccgagaaccagtacggcctgcccttcgagaagtggctgctgatcggcagcctgctgttcggcgtgctgttcctggtgatcggcctggtgctgctgggcagaatcctgagcgagagcctgagaagaaagagatacagcagactggactacctgatcaacggcatctacgtggacatctag

SEQ ID NO: 19699 - DNA, 174 bp, Artificial Sequence
  Description of Artificial Sequence: Synthetic coding sequence
atgttcttcggcggcgagggcagcctgacctacaccctggtgatcatctgcttcctgaccctgagactgagcgccagccagaactgcctgaagaagagcctggaggacgtggtgatcgacatccagagcagcctgagcaagggcatcagaggcaacgagcccgtgtacacctag

SEQ ID NO: 19700 - DNA, 615 bp, Artificial Sequence
  Description of Artificial Sequence: Synthetic coding sequence
atggaggcccccgccgagctgctggccgccctgcccgccctggccaccgccctggccctgctgctggcctggctgctggtgagaagaggcgccgccgccagccccgagcccgccagagccccccccgagcccgccccccccgccgaggccaccggcgcccccgcccccagcagaccctgcgcccccgagcccgccgccagccccgccggccccgaggagcccggcgagcccgccggcctgggcgagctgggcgagcccgccggccccggcgagcccgagggccccggcgaccccgccgccgcccccgccgaggccgaggagcaggccgtggaggccagacaggaggaggagcaggacctggacggcgagaagggccccagcagcgagggccccgaggaggaggacggcgagggcttcagcttcaagtacagccccggcaagctgagaggcaaccagtacaagaagatgatgaccaaggaggagctggaggaggagcagagagtgcagaaggagcagctggccgccatcttcaagctgatgaaggacaacaaggagaccttcggcgagatgagcgacggcgacgtgcaggagcagctgagactgtacgacatgtag

SEQ ID NO: 19701 - DNA, 534 bp, Artificial Sequence
  Description of Artificial Sequence: Synthetic coding sequence
atggaggcccccgccgagctgctggccgccctgcccgccctggccaccgccctggccctgctgctggcctggctgctggtgagaagaggcgccgccgccagccccgagcccgccagagccccccccgagcccgccccccccgccgaggccaccggcgcccccgcccccagcagaccctgcgcccccgagcccgccgccagccccgccggccccgaggagcccggcgagcccgccggcctgggcgagctgggcgagcccgccggccccggcgagcccgagggccccggcgaccccgccgccgcccccgccgaggccgaggagcaggccgtggaggccagacaggaggaggagcaggacctggacggcgagaagggccccagcagcgagggccccgaggaggaggacggcgagggcttcagcttcaagtacagccccggcaagctgagaggcaaccagtacaagaagatgatgaccaaggaggagctggaggaggagcagagaatcgagctgaccagcgacctgaccagcctgtag

SEQ ID NO: 19702 - DNA, 513 bp, Artificial Sequence
  Description of Artificial Sequence: Synthetic coding sequence
atggaggcccccgccgagctgctggccgccctgcccgccctggccaccgccctggccctgctgctggcctggctgctggtgagaagaggcgccgccgccagccccgagcccgccagagccccccccgagcccgccccccccgccgaggccaccggcgcccccgcccccagcagaccctgcgcccccgagcccgccgccagccccgccggccccgaggagcccggcgagcccgccggcctgggcgagctgggcgagcccgccggccccggcgagcccgagggccccggcgaccccgccgccgcccccgccgaggccgaggagcaggccgtggaggccagacaggaggaggagcaggacctggacggcgagaagggccccagcagcgagggccccgaggaggaggacggcgagggcttcagcttcaagtacagccccggcaagctgagaggcaaccagtacaagaagatgatgaccaaggaggagctggaggaggagcagagaacccagagatag

SEQ ID NO: 19703 - DNA, 513 bp, Artificial Sequence
  Description of Artificial Sequence: Synthetic coding sequence
atggaggcccccgccgagctgctggccgccctgcccgccctggccaccgccctggccctgctgctggcctggctgctggtgagaagaggcgccgccgccagccccgagcccgccagagccccccccgagcccgccccccccgccgaggccaccggcgcccccgcccccagcagaccctgcgcccccgagcccgccgccagccccgccggccccgaggagcccggcgagcccgccggcctgggcgagctgggcgagcccgccggccccggcgagcccgagggccccggcgaccccgccgccgcccccgccgaggccgaggagcaggccgtggaggccagacaggaggaggagcaggacctggacggcgagaagggccccagcagcgagggccccgaggaggaggacggcgagggcttcagcttcaagtacagccccggcaagctgagaggcaaccagtacaagaagatgatgaccaaggaggagctggaggaggagcagagaaccgaggagtag

SEQ ID NO: 19704 - DNA, 1329 bp, Artificial Sequence
  Description of Artificial Sequence: Synthetic coding sequence
atggccctgcccagcagaatcctgctgtggaagctggtgctgctgcagagcagcgccgtgctgctgcacagcggcagcagcgtgcccgccgccgccggcagcagcgtggtgagcgagagcgccgtgagctgggaggccggcgccagagccgtgctgagatgccagagccccagaatggtgtggacccaggacagactgcacgacagacagagagtgctgcactgggacctgagaggccccggcggcggccccgccagaagactgctggacctgtacagcgccggcgagcagagagtgtacgaggccagagacagaggcagactggagctgagcgccagcgccttcgacgacggcaacttcagcctgctgatcagagccgtggaggagaccgacgccggcctgtacacctgcaacctgcaccaccactactgccacctgtacgagagcctggccgtgagactggaggtgaccgacggcccccccgccacccccgcctactgggacggcgagaaggaggtgctggccgtggccagaggcgcccccgccctgctgacctgcgtgaacagaggccacgtgtggaccgacagacacgtggaggaggcccagcaggtggtgcactgggacagacagccccccggcgtgccccacgacagagccgacagactgctggacctgtacgccagcggcgagagaagagcctacggccccctgttcctgagagacagagtggccgtgggcgccgacgccttcgagagaggcgacttcagcctgagaatcgagcccctggaggtggccgacgagggcacctacagctgccacctgcaccaccactactgcggcctgcacgagagaagagtgttccacctgaccgtggccgagccccacgccgagcccccccccagaggcagccccggcaacggcagcagccacagcggcgcccccggccccgaccccaccctggccagaggccacaacgtgatcaacgtgatcgtgcccgagagcagagcccacttcttccagcagctgggctacgtgctggccaccctgctgctgttcatcctgctgctggtgaccgtgctgctggccgccagaagaagaagaggcggctacgagtacagcgaccagaagagcggcaagagcaagggcaaggacgtgaacctggccgagttcgccgtggccgccggcgaccagatgctgtacagaagcgaggacatccagctggactacaagaacaacatcctgaaggagagagccgagctggcccacagccccctgcccgccaagtacatcgacctggacaagggcttcagaaaggagaactgcaagtag

SEQ ID NO: 19705 - DNA, 1026 bp, Artificial Sequence
  Description of Artificial Sequence: Synthetic coding sequence
atggccctgcccagcagaatcctgctgtggaagctggtgctgctgcagagcagcgccgtgctgctgcacagcgccgtggaggagaccgacgccggcctgtacacctgcaacctgcaccaccactactgccacctgtacgagagcctggccgtgagactggaggtgaccgacggcccccccgccacccccgcctactgggacggcgagaaggaggtgctggccgtggccagaggcgcccccgccctgctgacctgcgtgaacagaggccacgtgtggaccgacagacacgtggaggaggcccagcaggtggtgcactgggacagacagccccccggcgtgccccacgacagagccgacagactgctggacctgtacgccagcggcgagagaagagcctacggccccctgttcctgagagacagagtggccgtgggcgccgacgccttcgagagaggcgacttcagcctgagaatcgagcccctggaggtggccgacgagggcacctacagctgccacctgcaccaccactactgcggcctgcacgagagaagagtgttccacctgaccgtggccgagccccacgccgagcccccccccagaggcagccccggcaacggcagcagccacagcggcgcccccggccccgaccccaccctggccagaggccacaacgtgatcaacgtgatcgtgcccgagagcagagcccacttcttccagcagctgggctacgtgctggccaccctgctgctgttcatcctgctgctggtgaccgtgctgctggccgccagaagaagaagaggcggctacgagtacagcgaccagaagagcggcaagagcaagggcaaggacgtgaacctggccgagttcgccgtggccgccggcgaccagatgctgtacagaagcgaggacatccagctggactacaagaacaacatcctgaaggagagagccgagctggcccacagccccctgcccgccaagtacatcgacctggacaagggcttcagaaaggagaactgcaagtag

SEQ ID NO: 19706 - DNA, 1302 bp, Artificial Sequence
  Description of Artificial Sequence: Synthetic coding sequence
atgatcagatgcgccgccaccggcagcgccgtgctgctgcacagcggcagcagcgtgcccgccgccgccggcagcagcgtggtgagcgagagcgccgtgagctgggaggccggcgccagagccgtgctgagatgccagagccccagaatggtgtggacccaggacagactgcacgacagacagagagtgctgcactgggacctgagaggccccggcggcggccccgccagaagactgctggacctgtacagcgccggcgagcagagagtgtacgaggccagagacagaggcagactggagctgagcgccagcgccttcgacgacggcaacttcagcctgctgatcagagccgtggaggagaccgacgccggcctgtacacctgcaacctgcaccaccactactgccacctgtacgagagcctggccgtgagactggaggtgaccgacggcccccccgccacccccgcctactgggacggcgagaaggaggtgctggccgtggccagaggcgcccccgccctgctgacctgcgtgaacagaggccacgtgtggaccgacagacacgtggaggaggcccagcaggtggtgcactgggacagacagccccccggcgtgccccacgacagagccgacagactgctggacctgtacgccagcggcgagagaagagcctacggccccctgttcctgagagacagagtggccgtgggcgccgacgccttcgagagaggcgacttcagcctgagaatcgagcccctggaggtggccgacgagggcacctacagctgccacctgcaccaccactactgcggcctgcacgagagaagagtgttccacctgaccgtggccgagccccacgccgagcccccccccagaggcagccccggcaacggcagcagccacagcggcgcccccggccccgaccccaccctggccagaggccacaacgtgatcaacgtgatcgtgcccgagagcagagcccacttcttccagcagctgggctacgtgctggccaccctgctgctgttcatcctgctgctggtgaccgtgctgctggccgccagaagaagaagaggcggctacgagtacagcgaccagaagagcggcaagagcaagggcaaggacgtgaacctggccgagttcgccgtggccgccggcgaccagatgctgtacagaagcgaggacatccagctggactacaagaacaacatcctgaaggagagagccgagctggcccacagccccctgcccgccaagtacatcgacctggacaagggcttcagaaaggagaactgcaagtag

SEQ ID NO: 19707 - DNA, 1353 bp, Artificial Sequence
  Description of Artificial Sequence: Synthetic coding sequence
atggccctgcccagcagaatcctgctgtggaagctggtgctgctgcagagcagcgccgtgctgctgcacagcggcagcagcgtgcccgccgccgccggcagcagcgtggtgagcgagagcgccgtgagctgggaggccggcgccagagccgtgctgagatgccagagccccagaatggtgtggacccaggacagactgcacgacagacagagagtgctgcactgggacctgagaggccccggcggcggccccgccagaagactgctggacctgtacagcgccggcgagcagagagtgtacgaggccagagacagaggcagactggagctgagcgccagcgccttcgacgacggcaacttcagcctgctgatcagagccgtggaggagaccgacgccggcctgtacacctgcaacctgcaccaccactactgccacctgtacgagagcctggccgtgagactggaggtgaccgacggcccccccgccacccccgcctactgggacggcgagaaggaggtgctggccgtggccagaggcgcccccgccctgctgacctgcgtgaacagaggccacgtgtggaccgacagacacgtggaggaggcccagcaggtggtgcactgggacagacagccccccggcgtgccccacgacagagccgacagactgctggacctgtacgccagcggcgagagaagagcctacggccccctgttcctgagagacagagtggccgtgggcgccgacgccttcgagagaggcgacttcagcctgagaatcgagcccctggaggtggccgacgagggcacctacagctgccacctgcaccaccactactgcggcctgcacgagagaagagtgttccacctgaccgtggccgagccccacgccgagcccccccccagaggcagccccggcaacggcagcagccacagcggcgcccccggccccgaccccaccctggccagaggccacaacgtgatcaacgtgatcgtgcccgagagcagagcccacttcttccagcagctgggctacgtgctggccaccctgctgctgttcatcctgctgctggtgaccgtgctgctggccgccagaagaagaagaggcggctacgagtacagcgaccagaagagcggcaagagcaagggcaaggacgtgaacctggccgagttcgccgtggccgccggcgaccagatgctgtacagaagcgaggacatccagctggccagcagcccccccaccgactacaagaacaacatcctgaaggagagagccgagctggcccacagccccctgcccgccaagtacatcgacctggacaaggaccccagcggcctgtgccccctgggcgcctag

SEQ ID NO: 19708 - DNA, 207 bp, Artificial Sequence
  Description of Artificial Sequence: Synthetic coding sequence
atgccccagaaggacccctgccagaagcaggcctgcgagatccagaagtgcctgcaggccaacagctacatggagagcaagtgccaggccgtgatccaggagctgagaaagtgctgcgcccagtaccccaagggcagaagcgtggtgtgcagcggcttcgagaaggaggaggaggagaacctgaccagaaagagcgccagcaagtag

SEQ ID NO: 19709 - DNA, 207 bp, Artificial Sequence; identical to SEQ ID NO: 19708
  Description of Artificial Sequence: Synthetic coding sequence

SEQ ID NO: 19710 - DNA, 618 bp, Artificial Sequence
  Description of Artificial Sequence: Synthetic coding sequence
atgagcgcccagagactgatcagcaacagaaccagccagcagagcgccagcaacagcgactacacctgggagtacgagtactacgagatcggccccgtgagcttcgagggcctgaaggcccacaagtacagcatcgtgatcggcttctgggtgggcctggccgtgttcgtgatcttcatgttcttcgtgctgaccctgctgaccaagaccggcgccccccaccaggacaacgccgagagcagcgagaagagattcagaatgaacagcttcgtgagcgacttcggcagacccctggagcccgacaaggtgttcagcagacagggcaacgaggagagcagaagcctgttccactgctacatcaacgaggtggagagactggacagagccaaggcctgccaccagaccaccgccctggacagcgacgtgcagctgcaggaggccatcagaagcagcggccagcccgaggaggagctgaacagactgatgaagttcgacatccccaacttcgtgaacaccgaccagaactacttcggcgaggacgacctgctgatcagcgagccccccatcgtgctggagaccaagcccctgagccagaccagccacaaggacctggactag

SEQ ID NO: 19711 - DNA, 930 bp, Artificial Sequence
  Description of Artificial Sequence: Synthetic coding sequence
atgagcctggagcagagaagcctgcactgcaagcccgaggaggccctggaggcccagcaggaggccctgggcctggtgtgcgtgcaggccgccaccagcagcagcagccccctggtgctgggcaccctggaggaggtgcccaccgccggcagcaccgaccccccccagagcccccagggcgccagcgccttccccaccaccatcaacttcaccagacagagacagcccagcgagggcagcagcagcagagaggaggagggccccagcaccagctgcatcctggagagcctgttcagagccgtgatcaccaagaaggtggccgacctggtgggcttcctgctgctgaagtacagagccagagagcccgtgaccaaggccgagatgctggagagcgtgatcaagaactacaagcactgcttccccgagatcttcggcaaggccagcgagagcctgcagctggtgttcggcatcgacgtgaaggaggccgaccccaccggccacagctacgtgctggtgacctgcctgggcctgagctacgacggcctgctgggcgacaaccagatcatgcccaagaccggcttcctgatcatcgtgctggtgatgatcgccatggagggcggccacgcccccgaggaggagatctgggaggagctgagcgtgatggaggtgtacgacggcagagagcacagcgcctacggcgagcccagaaagctgctgacccaggacctggtgcaggagaagtacctggagtacagacaggtgcccgacagcgaccccgccagatacgagttcctgtggggccccagagccctggccgagaccagctacgtgaaggtgctggagtacgtgatcaaggtgagcgccagagtgagattcttcttccccagcctgagagaggccgccctgagagaggaggaggagggcgtgtag

SEQ ID NO: 19712 - DNA, 4368 bp, Artificial Sequence
  Description of Artificial Sequence: Synthetic coding sequence
atgagcaagagcctgaagaagaagagccactggaccagcaaggtgcacgagagcgtgatcggcagaaaccccgagggccagctgggcttcgagctgaagggcggcgccgagaacggccagttcccctacctgggcgaggtgaagcccggcaaggtggcctacgagagcggcagcaagctggtgagcgaggagctgctgctggaggtgaacgagacccccgtggccggcctgaccatcagagacgtgctggccgtgatcaagcactgcaaggaccccctgagactgaagtgcgtgaagcagggcggcatcgtggacaaggacctgagacactacctgaacctgagattccagaagggcagcgtggaccacgagctgcagcagatcatcagagacaacctgtacctgagaaccgtgccctgcaccaccagaccccacaaggagggcgaggtgcccggcgtggactacatcttcatcaccgtggaggacttcatggagctggagaagagcggcgccctgctggagagcggcacctacgaggacaactactacggcacccccaagccccccgccgagcccgcccccctgctgctgaacgtgaccgaccagatcctgcccggcgccacccccagcgccgagggcaagagaaagagaaacaagagcgtgagcaacatggagaaggccagcatcgagccccccgaggaggaggaggaggagagacccgtggtgaacggcaacggcgtggtggtgacccccgagagcagcgagcacgaggacaagagcgccggcgccagcggcgagatgcccagccagccctaccccgcccccgtgtacagccagcccgaggagctgaaggagcagatggacgacaccaagcccaccaagcccgaggacaacgaggagcccgaccccctgcccgacaactgggagatggcctacaccgagaagggcgaggtgtacttcatcgaccacaacaccaagaccaccagctggctggaccccagactggccaagaaggccaagccccccgaggagtgcaaggagaacgagctgccctacggctgggagaagatcgacgaccccatctacggcacctactacgtggaccacatcaacagaagaacccagttcgagaaccccgtgctggaggccaagagaaagctgcagcagcacaacatgccccacaccgagctgggcaccaagcccctgcaggcccccggcttcagagagaagcccctgttcaccagagacgccagccagctgaagggcaccttcctgagcaccaccctgaagaagagcaacatgggcttcggcttcaccatcatcggcggcgacgagcccgacgagttcctgcaggtgaagagcgtgatccccgacggccccgccgcccaggacggcaagatggagaccggcgacgtgatcgtgtacatcaacgaggtgtgcgtgctgggccacacccacgccgacgtggtgaagctgttccagagcgtgcccatcggccagagcgtgaacctggtgctgtgcagaggctaccccctgcccttcgaccccgaggaccccgccaacagcatggtgccccccctggccatcatggagagacccccccccgtgatggtgaacggcagacacaactacgagacctacctggagtacatcagcagaaccagccagagcgtgcccgacatcaccgacagacccccccacagcctgcacagcatgcccaccgacggccagctggacggcacctaccccccccccgtgcacgacgacaacgtgagcatggccagcagcggcgccacccaggccgagctgatgaccctgaccatcgtgaagggcgcccagggcttcggcttcaccatcgccgacagccccaccggccagagagtgaagcagatcctggacatccagggctgccccggcctgtgcgagggcgacctgatcgtggagatcaaccagcagaacgtgcagaacctgagccacaccgaggtggtggacatcctgaaggactgccccatcggcagcgagaccagcctgatcatccacagaggcggcttcttcagcccctggaagacccccaagcccatcatggacagatgggagaaccagggcagcccccagaccagcctgagcgcccccgccatcccccagaacctgcccttcccccccgccctgcacagaagcagcttccccgacagcaccgaggccttcgaccccagaaagcccgacccctacgagctgtacgagaagagcagagccatctacgagagcagacagcaggtgccccccagaaccagcttcagaatggacagcagcggccccgactacaaggagctggacgtgcacctgagaagaatggagagcggcttcggcttcagaatcctgggcggcgacgagcccggccagcccatcctgatcggcgccgtgatcgccatgggcagcgccgacagagacggcagactgcaccccggcgacgagctggtgtacgtggacggcatccccgtggccggcaagacccacagatacgtgatcgacctgatgcaccacgccgccagaaacggccaggtgaacctgaccgtgagaagaaaggtgctgtgcggcggcgagccctgccccgagaacggcagaagccccggcagcgtgagcacccaccacagcagccccagaagcgactacgccacctacaccaacagcaaccacgccgcccccagcagcaacgccagcccccccgagggcttcgccagccacagcctgcagaccagcgacgtggtgatccacagaaaggagaacgagggcttcggcttcgtgatcatcagcagcctgaacagacccgagagcggcagcaccatcaccgtgccccacaagatcggcagaatcatcgacggcagccccgccgacagatgcgccaagctgaaggtgggcgacagaatcctggccgtgaacggccagagcatcatcaacatgccccacgccgacatcgtgaagctgatcaaggacgccggcctgagcgtgaccctgagaatcatcccccaggaggagctgaacagccccaccagcgcccccagcagcgagaagcagagccccatggcccagcagagccccctggcccagcagagccccctggcccagcccagccccgccacccccaacagccccatcgcccagcccgcccccccccagcccctgcagctgcagggccacgagaacagctacagaagcgaggtgaaggccagacaggacgtgaagcccgacatcagacagccccccttcaccgactacagacagccccccctggactacagacagccccccggcggcgactaccagcagcccccccccctggactacagacagccccccctgctggactacagacagcacagccccgacaccagacagtaccccctgagcgactacagacagccccaggacttcgactacttcaccgtggacatggagaagggcgccaagggcttcggcttcagcatcagaggcggcagagagtacaagatggacctgtacgtgctgagactggccgaggacggccccgccatcagaaacggcagaatgagagtgggcgaccagatcatcgagatcaacggcgagagcaccagagacatgacccacgccagagccatcgagctgatcaagagcggcggcagaagagtgagactgctgctgaagagaggcaccggccaggtgcccgagtacgacgagcccgccccctggagcagccccgccgccgccgcccccggcctgcccgaggtgggcgtgagcctggacgacggcctggcccccttcagccccagccaccccgccccccccagcgaccccagccaccagatcagccccggccccacctgggacatcaagagagagcacgacgtgagaaagcccaaggagctgagcgcctgcggccagaagaagcagagactgggcgagcagagagagagaagcgccagcccccagagagccgccagacccagactggaggaggcccccggcggccagggcagacccgaggccggcagacccgccagcgaggccagagcccccggcctggccgccgccgacgccgccgacgccgccagagccggcggcaaggaggcccccagagccgccgccggcagcgagctgtgcagaagagagggccccggcgccgcccccgccttcgccggccccggcggcggcggcagcggcgccctggaggccgagggcagagccggcgccagagccggccccagacccggccccagaccccccggcggcgcccccgccagaaaggccgccgtggcccccggcccctggaaggtgcccggcagcgacaagctgcccagcgtgctgaagcccggcgccagcgccgccagcagatag

SEQ ID NO: 19713 - DNA, 4326 bp, Artificial Sequence
  Description of Artificial Sequence: Synthetic coding sequence
atgagcaagagcctgaagaagaagagccactggaccagcaaggtgcacgagagcgtgatcggcagaaaccccgagggccagctgggcttcgagctgaagggcggcgccgagaacggccagttcccctacctgggcgaggtgaagcccggcaaggtggcctacgagagcggcagcaagctggtgagcgaggagctgctgctggaggtgaacgagacccccgtggccggcctgaccatcagagacgtgctggccgtgatcaagcactgcaaggaccccctgagactgaagtgcgtgaagcagggcggcatcgtggacaaggacctgagacactacctgaacctgagattccagaagggcagcgtggaccacgagctgcagcagatcatcagagacaacctgtacctgagaaccgtgccctgcaccaccagaccccacaaggagggcgaggtgcccggcgtggactacatcttcatcaccgtggaggacttcatggagctggagaagagcggcgccctgctggagagcggcacctacgaggacaactactacggcacccccaagccccccgccgagcccgcccccctgctgctgaacgtgaccgaccagatcctgcccggcgccacccccagcgccgagggcaagagaaagagaaacaagagcgtgagcaacatggagaaggccagcatcgagccccccgaggaggaggaggaggagagacccgtggtgaacggcaacggcgtggtggtgacccccgagagcagcgagcacgaggacaagagcgccggcgccagcggcgagatgcccagccagccctaccccgcccccgtgtacagccagcccgaggagctgaaggagcagatggacgacaccaagcccaccaagcccgaggacaacgaggagcccgaccccctgcccgacaactgggagatggcctacaccgagaagggcgaggtgtacttcatcgaccacaacaccaagaccaccagctggctggaccccagactggccaagaaggccaagccccccgaggagtgcaaggagaacgagctgccctacggctgggagaagatcgacgaccccatctacggcacctactacgtggaccacatcaacagaagaacccagttcgagaaccccgtgctggaggccaagagaaagctgcagcagcacaacatgccccacaccgagctgggcaccaagcccctgcaggcccccggcttcagagagaagcccctgttcaccagagacgccagccagctgaagggcaccttcctgagcaccaccctgaagaagagcaacatgggcttcggcttcaccatcatcggcggcgacgagcccgacgagttcctgcaggtgaagagcgtgatccccgacggccccgccgcccaggacggcaagatggagaccggcgacgtgatcgtgtacatcaacgaggtgtgcgtgctgggccacacccacgccgacgtggtgaagctgttccagagcgtgcccatcggccagagcgtgaacctggtgctgtgcagaggctaccccctgcccttcgaccccgaggaccccgccaacagcatggtgccccccctggccatcatggagagacccccccccgtgatggtgaacggcagacacaactacgagacctacctggagtacatcagcagaaccagccagagcgtgcccgacatcaccgacagacccccccacagcctgcacagcatgcccaccgacggccagctggacggcacctaccccccccccgtgcacgacgacaacgtgagcatggccagcagcggcgccacccaggccgagctgatgaccctgaccatcgtgaagggcgcccagggcttcggcttcaccatcgccgacagccccaccggccagagagtgaagcagatcctggacatccagggctgccccggcctgtgcgagggcgacctgatcgtggagatcaaccagcagaacgtgcagaacctgagccacaccgaggtggtggacatcctgaaggactgccccatcggcagcgagaccagcctgatcatccacagaggcggcttcttcagcccctggaagacccccaagcccatcatggacagatgggagaaccagggcagcccccagaccagcctgagcgcccccgccatcccccagaacctgcccttcccccccgccctgcacagaagcagcttccccgacagcaccgaggccttcgaccccagaaagcccgacccctacgagctgtacgagaagagcagagccatctacgagagcagaagacccgactacaaggagctggacgtgcacctgagaagaatggagagcggcttcggcttcagaatcctgggcggcgacgagcccggccagcccatcctgatcggcgccgtgatcgccatgggcagcgccgacagagacggcagactgcaccccggcgacgagctggtgtacgtggacggcatccccgtggccggcaagacccacagatacgtgatcgacctgatgcaccacgccgccagaaacggccaggtgaacctgaccgtgagaagaaaggtgctgtgcggcggcgagccctgccccgagaacggcagaagccccggcagcgtgagcacccaccacagcagccccagaagcgactacgccacctacaccaacagcaaccacgccgcccccagcagcaacgccagcccccccgagggcttcgccagccacagcctgcagaccagcgacgtggtgatccacagaaaggagaacgagggcttcggcttcgtgatcatcagcagcctgaacagacccgagagcggcagcaccatcaccgtgccccacaagatcggcagaatcatcgacggcagccccgccgacagatgcgccaagctgaaggtgggcgacagaatcctggccgtgaacggccagagcatcatcaacatgccccacgccgacatcgtgaagctgatcaaggacgccggcctgagcgtgaccctgagaatcatcccccaggaggagctgaacagccccaccagcgcccccagcagcgagaagcagagccccatggcccagcagagccccctggcccagcagagccccctggcccagcccagccccgccacccccaacagccccatcgcccagcccgcccccccccagcccctgcagctgcagggccacgagaacagctacagaagcgaggtgaaggccagacaggacgtgaagcccgacatcagacagccccccttcaccgactacagacagccccccctggactacagacagccccccggcggcgactaccagcagcccccccccctggactacagacagccccccctgctggactacagacagcacagccccgacaccagacagtaccccctgagcgactacagacagccccaggacttcgactacttcaccgtggacatggagaagggcgccaagggcttcggcttcagcatcagaggcggcagagagtacaagatggacctgtacgtgctgagactggccgaggacggccccgccatcagaaacggcagaatgagagtgggcgaccagatcatcgagatcaacggcgagagcaccagagacatgacccacgccagagccatcgagctgatcaagagcggcggcagaagagtgagactgctgctgaagagaggcaccggccaggtgcccgagtacgacgagcccgccccctggagcagccccgccgccgccgcccccggcctgcccgaggtgggcgtgagcctggacgacggcctggcccccttcagccccagccaccccgccccccccagcgaccccagccaccagatcagccccggccccacctgggacatcaagagagagcacgacgtgagaaagcccaaggagctgagcgcctgcggccagaagaagcagagactgggcgagcagagagagagaagcgccagcccccagagagccgccagacccagactggaggaggcccccggcggccagggcagacccgaggccggcagacccgccagcgaggccagagcccccggcctggccgccgccgacgccgccgacgccgccagagccggcggcaaggaggcccccagagccgccgccggcagcgagctgtgcagaagagagggccccggcgccgcccccgccttcgccggccccggcggcggcggcagcggcgccctggaggccgagggcagagccggcgccagagccggccccagacccggccccagaccccccggcggcgcccccgccagaaaggccgccgtggcccccggcccctggaaggtgcccggcagcgacaagctgcccagcgtgctgaagcccggcgccagcgccgccagcagatag

SEQ ID NO: 19714 - DNA, 1668 bp, Artificial Sequence
  Description of Artificial Sequence: Synthetic coding sequence
atggagctggagaagagcggcgccctgctggagagcggcacctacgaggacaactactacggcacccccaagccccccgccgagcccgcccccctgctgctgaacgtgaccgaccagatcctgcccggcgccacccccagcgccgagggcaagagaaagagaaacaagagcgtgagcaacatggagaaggccagcatcgagccccccgaggaggaggaggaggagagacccgtggtgaacggcaacggcgtggtggtgacccccgagagcagcgagcacgaggacaagagcgccggcgccagcggcgagatgcccagccagccctaccccgcccccgtgtacagccagcccgaggagctgaaggagcagatggacgacaccaagcccaccaagcccgaggacaacgaggagcccgaccccctgcccgacaactgggagatggcctacaccgagaagggcgaggtgtacttcatcgaccacaacaccaagaccaccagctggctggaccccagactggccaagaaggccaagccccccgaggagtgcaaggagaacgagctgccctacggctgggagaagatcgacgaccccatctacggcacctactacgtggaccacatcaacagaagaacccagttcgagaaccccgtgctggaggccaagagaaagctgcagcagcacaacatgccccacaccgagctgggcaccaagcccctgcaggcccccggcttcagagagaagcccctgttcaccagagacgccagccagctgaagggcaccttcctgagcaccaccctgaagaagagcaacatgggcttcggcttcaccatcatcggcggcgacgagcccgacgagttcctgcaggtgaagagcgtgatccccgacggccccgccgcccaggacggcaagatggagaccggcgacgtgatcgtgtacatcaacgaggtgtgcgtgctgggccacacccacgccgacgtggtgaagctgttccagagcgtgcccatcggccagagcgtgaacctggtgctgtgcagaggctaccccctgcccttcgaccccgaggaccccgccaacagcatggtgccccccctggccatcatggagagacccccccccgtgatggtgaacggcagacacaactacgagacctacctggagtacatcagcagaaccagccagagcgtgcccgacatcaccgacagacccccccacagcctgcacagcatgcccaccgacggccagctggacggcacctaccccccccccgtgcacgacgacaacgtgagcatggccagcagcggcgccacccaggccgagctgatgaccctgaccatcgtgaagggcgcccagggcttcggcttcaccatcgccgacagccccaccggccagagagtgaagcagatcctggacatccagggctgccccggcctgtgcgagggcgacctgatcgtggagatcaaccagcagaacgtgcagaacctgagccacaccgaggtggtggacatcctgaaggactgccccatcggcagcgagaccagcctgatcatccacagaggcggcaagaccaacaccggcagcgccatcaagtacgtgggcaagatcgtgggcagcttcaacaacatcgtgaagatgcagatcagcctggagctgaacgagatcatcctgtag

SEQ ID NO: 19715 - DNA, 3762 bp, Artificial Sequence
  Description of Artificial Sequence: Synthetic coding sequence
atgagcaagagcctgaagaagaagagccactggaccagcaaggtgcacgagagcgtgatcggcagaaaccccgagggccagctgggcttcgagctgaagggcggcgccgagaacggccagttcccctacctgggcgaggtgaagcccggcaaggtggcctacgagagcggcagcaagctggtgagcgaggagctgctgctggaggtgaacgagacccccgtggccggcctgaccatcagagacgtgctggccgtgatcaagcactgcaaggaccccctgagactgaagtgcgtgaagcagggcggcatcgtggacaaggacctgagacactacctgaacctgagattccagaagggcagcgtggaccacgagctgcagcagatcatcagagacaacctgtacctgagaaccgtgccctgcaccaccagaccccacaaggagggcgaggtgcccggcgtggactacatcttcatcaccgtggaggacttcatggagctggagaagagcggcgccctgctggagagcggcacctacgaggacaactactacggcacccccaagccccccgccgagcccgcccccctgctgctgaacgtgaccgaccagatcctgcccggcgccacccccagcgccgagggcaagagaaagagaaacaagagcgtgagcaacatggagaaggccagcatcgagccccccgaggaggaggaggaggagagacccgtggtgaacggcaacggcgtggtggtgacccccgagagcagcgagcacgaggacaagagcgccggcgccagcggcgagatgcccagccagccctaccccgcccccgtgtacagccagcccgaggagctgaaggagcagatggacgacaccaagcccaccaagcccgaggacaacgaggagcccgaccccctgcccgacaactgggagatggcctacaccgagaagggcgaggtgtacttcatcgaccacaacaccaagaccaccagctggctggaccccagactggccaagaaggccaagccccccgaggagtgcaaggagaacgagctgccctacggctgggagaagatcgacgaccccatctacggcacctactacgtggaccacatcaacagaagaacccagttcgagaaccccgtgctggaggccaagagaaagctgcagcagcacaacatgccccacaccgagctgggcaccaagcccctgcaggcccccggcttcagagagaagcccctgttcaccagagacgccagccagctgaagggcaccttcctgagcaccaccctgaagaagagcaacatgggcttcggcttcaccatcatcggcggcgacgagcccgacgagttcctgcaggtgaagagcgtgatccccgacggccccgccgcccaggacggcaagatggagaccggcgacgtgatcgtgtacatcaacgaggtgtgcgtgctgggccacacccacgccgacgtggtgaagctgttccagagcgtgcccatcggccagagcgtgaacctggtgctgtgcagaggctaccccctgcccttcgaccccgaggaccccgccaacagcatggtgccccccctggccatcatggagagacccccccccgtgatggtgaacggcagacacaactacgagacctacctggagtacatcagcagaaccagccagagcgtgcccgacatcaccgacagacccccccacagcctgcacagcatgcccaccgacggccagctggacggcacctaccccccccccgtgcacgacgacaacgtgagcatggccagcagcggcgccacccaggccgagctgatgaccctgaccatcgtgaagggcgcccagggcttcggcttcaccatcgccgacagccccaccggccagagagtgaagcagatcctggacatccagggctgccccggcctgtgcgagggcgacctgatcgtggagatcaaccagcagaacgtgcagaacctgagccacaccgaggtggtggacatcctgaaggactgccccatcggcagcgagaccagcctgatcatccacagaggcggcttcttcagcccctggaagacccccaagcccatcatggacagatgggagaaccagggcagcccccagaccagcctgagcgcccccgccatcccccagaacctgcccttcccccccgccctgcacagaagcagcttccccgacagcaccgaggccttcgaccccagaaagcccgacccctacgagctgtacgagaagagcagagccatctacgagagcagacagcaggtgccccccagaaccagcttcagaatggacagcagcggccccgactacaaggagctggacgtgcacctgagaagaatggagagcggcttcggcttcagaatcctgggcggcgacgagcccggccagcccatcctgatcggcgccgtgatcgccatgggcagcgccgacagagacggcagactgcaccccggcgacgagctggtgtacgtggacggcatccccgtggccggcaagacccacagatacgtgatcgacctgatgcaccacgccgccagaaacggccaggtgaacctgaccgtgagaagaaaggtgctgtgcggcggcgagccctgccccgagaacggcagaagccccggcagcgtgagcacccaccacagcagccccagaagcgactacgccacctacaccaacagcaaccacgccgcccccagcagcaacgccagcccccccgagggcttcgccagccacagcctgcagaccagcgacgtggtgatccacagaaaggagaacgagggcttcggcttcgtgatcatcagcagcctgaacagacccgagagcggcagcaccatcaccgtgccccacaagatcggcagaatcatcgacggcagccccgccgacagatgcgccaagctgaaggtgggcgacagaatcctggccgtgaacggccagagcatcatcaacatgccccacgccgacatcgtgaagctgatcaaggacgccggcctgagcgtgaccctgagaatcatcccccaggaggagctgaacagccccaccagcgcccccagcagcgagaagcagagccccatggcccagcagagccccctggcccagcagagccccctggcccagcccagccccgccacccccaacagccccatcgcccagcccgcccccccccagcccctgcagctgcagggccacgagaacagctacagaagcgaggtgaaggccagacaggacgtgaagcccgacatcagacagccccccttcaccgactacagacagccccccctggactacagacagccccccggcggcgactaccagcagcccccccccctggactacagacagccccccctgctggactacagacagcacagccccgacaccagacagtaccccctgagcgactacagacagccccaggacttcgactacttcaccgtggacatggagaagggcgccaagggcttcggcttcagcatcagaggcggcagagagtacaagatggacctgtacgtgctgagactggccgaggacggccccgccatcagaaacggcagaatgagagtgggcgaccagatcatcgagatcaacggcgagagcaccagagacatgacccacgccagagccatcgagctgatcaagagcggcggcagaagagtgagactgctgctgaagagaggcaccggccaggtgcccgagtacgacccccccgcccccgcccaggccgtgctgctgagattcagactgaccgccttctag

SEQ ID NO: 19716 - DNA, 1653 bp, Artificial Sequence
  Description of Artificial Sequence: Synthetic coding sequence
atgatcagcgcccacagaaacctgtgcctgcccgacaactactacggcacccccaagccccccgccgagcccgcccccctgctgctgaacgtgaccgaccagatcctgcccggcgccacccccagcgccgagggcaagagaaagagaaacaagagcgtgagcaacatggagaaggccagcatcgagccccccgaggaggaggaggaggagagacccgtggtgaacggcaacggcgtggtggtgacccccgagagcagcgagcacgaggacaagagcgccggcgccagcggcgagatgcccagccagccctaccccgcccccgtgtacagccagcccgaggagctgaaggagcagatggacgacaccaagcccaccaagcccgaggacaacgaggagcccgaccccctgcccgacaactgggagatggcctacaccgagaagggcgaggtgtacttcatcgaccacaacaccaagaccaccagctggctggaccccagactggccaagaaggccaagccccccgaggagtgcaaggagaacgagctgccctacggctgggagaagatcgacgaccccatctacggcacctactacgtggaccacatcaacagaagaacccagttcgagaaccccgtgctggaggccaagagaaagctgcagcagcacaacatgccccacaccgagctgggcaccaagcccctgcaggcccccggcttcagagagaagcccctgttcaccagagacgccagccagctgaagggcaccttcctgagcaccaccctgaagaagagcaacatgggcttcggcttcaccatcatcggcggcgacgagcccgacgagttcctgcaggtgaagagcgtgatccccgacggccccgccgcccaggacggcaagatggagaccggcgacgtgatcgtgtacatcaacgaggtgtgcgtgctgggccacacccacgccgacgtggtgaagctgttccagagcgtgcccatcggccagagcgtgaacctggtgctgtgcagaggctaccccctgcccttcgaccccgaggaccccgccaacagcatggtgccccccctggccatcatggagagacccccccccgtgatggtgaacggcagacacaactacgagacctacctggagtacatcagcagaaccagccagagcgtgcccgacatcaccgacagacccccccacagcctgcacagcatgcccaccgacggccagctggacggcacctaccccccccccgtgcacgacgacaacgtgagcatggccagcagcggcgccacccaggccgagctgatgaccctgaccatcgtgaagggcgcccagggcttcggcttcaccatcgccgacagccccaccggccagagagtgaagcagatcctggacatccagggctgccccggcctgtgcgagggcgacctgatcgtggagatcaaccagcagaacgtgcagaacctgagccacaccgaggtggtggacatcctgaaggactgccccatcggcagcgagaccagcctgatcatccacagaggcggcaagaccaacaccggcagcgccatcaagtacgtgggcaagatcgtgggcagcttcaacaacatcgtgaagatgcagatcagcctggagctgaacgagatcatcctgtag

SEQ ID NO: 19717 - DNA, 1419 bp, Artificial Sequence
  Description of Artificial Sequence: Synthetic coding sequence
atgagccccgaggagtggacctacctggtggtgctgctgatcagcatccccatcggcttcctgttcaagaaggccggccccggcctgaagagatggggcgccgccgccgtgggcctgggcctgaccctgttcacctgcggcccccacaccctgcacagcctggtgaccatcctgggcacctgggccctgatccaggcccagccctgcagctgccacgccctggccctggcctggaccttcagctacctgctgttcttcagagccctgagcctgctgggcctgcccacccccacccccttcaccaacgccgtgcagctgctgctgaccctgaagctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatacagaacctacctggactggctggagcagcccttccccggcgccgtgcccagcctgagacccctgctgagaagagcctggcccgcccccctgttcggcctgctgttcctgctgagcagccacctgttccccctggaggccgtgagagaggacgccttctacgccagacccctgcccgccagactgttctacatgatccccgtgttcttcgccttcagaatgagattctacgtggcctggatcgccgccgagtgcggctgcatcgccgccggcttcggcgcctaccccgtggccgccaaggccagagccggcggcggccccaccctgcagtgccccccccccagcagccccgagaaggccgccagcctggagtacgactacgagaccatcagaaacatcgactgctacagcaccgacttctgcgtgagagtgagagacggcatgagatactggaacatgaccgtgcagtggtggctggcccagtacatctacaagagcgcccccgccagaagctacgtgctgagaagcgcctggaccatgctgctgagcgcctactggcacggcctgcaccccggctactacctgagcttcctgaccatccccctgtgcctggccgccgagggcagactggagagcgccctgagaggcagactgagccccggcggccagaaggcctgggactgggtgcactggttcctgaagatgagagcctacgactacatgtgcatgggcttcgtgctgctgagcctggccgacaccctgagatactgggccagcatctacttctgcatccacttcctggccctggccgccctgggcctgggcctggccctgggcggcggcagccccagcagaagaaaggccgccagccagcccaccagcctggcccccgagaagctgagagaggagtag

SEQ ID NO: 19718 - DNA, 1200 bp, Artificial Sequence
  Description of Artificial Sequence: Synthetic coding sequence
atgggcagcagcagatgcggccccggcgcccaccccgtgcacctgtggcccccccacttcgccttcagcggccaccaccccagagacctgggcccccacagcggccccgccctgctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatacagaacctacctggactggctggagcagcccttccccggcgccgtgcccagcctgagacccctgctgagaagagcctggcccgcccccctgttcggcctgctgttcctgctgagcagccacctgttccccctggaggccgtgagagaggacgccttctacgccagacccctgcccgccagactgttctacatgatccccgtgttcttcgccttcagaatgagattctacgtggcctggatcgccgccgagtgcggctgcatcgccgccggcttcggcgcctaccccgtggccgccaaggccagagccggcggcggccccaccctgcagtgccccccccccagcagccccgagaaggccgccagcctggagtacgactacgagaccatcagaaacatcgactgctacagcaccgacttctgcgtgagagtgagagacggcatgagatactggaacatgaccgtgcagtggtggctggcccagtacatctacaagagcgcccccgccagaagctacgtgctgagaagcgcctggaccatgctgctgagcgcctactggcacggcctgcaccccggctactacctgagcttcctgaccatccccctgtgcctggccgccgagggcagactggagagcgccctgagaggcagactgagccccggcggccagaaggcctgggactgggtgcactggttcctgaagatgagagcctacgactacatgtgcatgggcttcgtgctgctgagcctggccgacaccctgagatactgggccagcatctacttctgcatccacttcctggccctggccgccctgggcctgggcctggccctgggcggcggcagccccagcagaagaaaggccgccagccagcccaccagcctggcccccgagaagctgagagaggagtag

SEQ ID NO: 19719 - DNA, 1035 bp, Artificial Sequence
  Description of Artificial Sequence: Synthetic coding sequence
atgagccccgaggagtggacctacctggtggtgctgctgatcagcatccccatcggcttcctgttcaagaaggccggccccggcctgaagagatggggcgccgccgccgtgggcctgggcctgaccctgttcacctgcggcccccacaccctgcacagcctggtgaccatcctgggcacctgggccctgatccaggcccagccctgcagctgccacgccctggccctggcctggaccttcagctacctgctgttcttcagagccctgagcctgctgggcctgcccacccccacccccttcaccaacgccgtgcagctgctgctgaccctgaagctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatacagaacctacctggactggctggagcagcccttccccggcgccgtgcccagcctgagacccctgctgagaagagcctggcccgcccccctgttcggcctgctgttcctgctgagcagccacctgttccccctggaggccgtgagagaggacgccttctacgccagacccctgcccgccagactgttctacatgatccccgtgttcttcgccttcagaatgagattctacgtggcctggatcgccgccgagtgcggctgcatcgccgccggcttcggcgcctaccccgtggccgccaaggccagagccggcggcggccccaccctgcagtgccccccccccagcagccccgagaaggccgccagcctggagtacgactacgagaccatcagaaacatcgactgctacagcaccgacttctgcgtgagagtgagagacggcatgagatactggaacatgaccgtgcagtggtggctggcccagtacatctacaagagcgcccccgccagaagctacgtgctgagatag

SEQ ID NO: 19720 - DNA, 771 bp, Artificial Sequence
  Description of Artificial Sequence: Synthetic coding sequence
atgagccccgaggagtggacctacctggtggtgctgctgatcagcatccccatcggcttcctgttcaagaaggccggccccggcctgaagagatggggcgccgccgccgtgggcctgggcctgaccctgttcacctgcggcccccacaccctgcacagcctggtgaccatcctgggcacctgggccctgatccaggcccagccctgcagctgccacgccctggccctggcctggaccttcagctacctgctgttcttcagagccctgagcctgctgggcctgcccacccccacccccttcaccaacgccgtgcagctgctgctgaccctgaagctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatacagaacctacctggactggctggagcagcccttccccggcgccgtgcccagcctgagacccctgctgagaagagcctggcccgcccccctgttcggcctgctgttcctgctgagcagccacctgttccccctggaggccgtgagagaggacgccttctacgccagacccctgcccgccagactgttctacatgatccccgtgttcttcgccttcagaatgagattctacgtggcctggatcgccgccgagtgcggctgctag

SEQ ID NO: 19721 - DNA, 1200 bp, Artificial Sequence; identical to SEQ ID NO: 19718
  Description of Artificial Sequence: Synthetic coding sequence

SEQ ID NO: 19722 - DNA, 513 bp, Artificial Sequence
  Description of Artificial Sequence: Synthetic coding sequence
atgagccccgaggagtggacctacctggtggtgctgctgatcagcatccccatcggcttcctgttcaagaaggccggccccggcctgaagagatggggcgccgccgccgtgggcctgggcctgaccctgttcacctgcggcccccacaccctgcacagcctggtgaccatcctgggcacctgggccctgatccaggcccagccctgcagctgccacgccctggccctggcctggaccttcagctacctgctgttcttcagagccctgagcctgctgggcctgcccacccccacccccttcaccaacgccgtgcagctgctgctgaccctgaagctggtgagcctggccagcgaggtgcaggacctgcacctggcccagagaaaggagatggccagcggcttcagcaagggccccaccctgggcctgctgcccgacgtgcccagcctgatggagaccctgagctacagctactgctacgtgggcatcatgaccggccccttcttcagatactag

SEQ ID NO: 19723 - DNA, 1740 bp, Artificial Sequence
  Description of Artificial Sequence: Synthetic coding sequence
atgaaggacttcagcgacgtgatcctgtgcatggaggccaccgagagcagcaagaccgagttctgcaaccccgccttcgagcccgagagcggccccccctgccccccccccgtgttccccgaggacgccagctacagcgtgcccgccccctggcacggcagaagacccagaggcctgagacccgactgcagattcagctggctgtgcgtgctgctgctgagcagcctgctgctgctgctgctgggcctgctggtggccatcatcctggcccagctgcaggccgccccccccagcggcgccagccacagccccctgcccgccggcggcctgaccaccaccaccaccacccccaccatcaccaccagccaggccgccggcacccccaagggccagcaggagagcggcgtgagccccagcccccagagcacctgcggcggcctgctgagcggccccagaggcttcttcagcagccccaactaccccgacccctacccccccaacacccactgcgtgtggcacatccaggtggccaccgaccacgccatccagctgaagatcgaggccctgagcatcgagagcgtggccagctgcctgttcgacagactggagctgagccccgagcccgagggccccctgctgagagtgtgcggcagagtgcccccccccaccctgaacaccaacgccagccacctgctggtggtgttcgtgagcgacagcagcgtggagggcttcggcttccacgcctggtaccaggccatggcccccggcagaggcagctgcgcccacgacgagttcagatgcgaccagctgatctgcctgctgcccgacagcgtgtgcgacggcttcgccaactgcgccgacggcagcgacgagaccaactgcagcgccaagttcagcggctgcggcggcaacctgaccggcctgcagggcaccttcagcacccccagctacctgcagcagtacccccaccagctgctgtgcacctggcacatcagcgtgcccgccggccacagcatcgagctgcagttccacaacttcagcctggaggcccaggacgagtgcaagttcgactacgtggaggtgtacgagaccagcagcagcggcgccttcagcctgctgggcagattctgcggcgccgagccccccccccacctggtgagcagccaccacgagctggccgtgctgttcagaaccgaccacggcatcagcagcggcggcttcagcgccacctacctggccttcaacgccaccgagaacccctgcggccccagcgagctgagctgccaggccggcggctgcaagggcgtgcagtggatgtgcgacatgtggagagactgcaccgacggcagcgacgacaactgcagcggccccctgttccccccccccgagctggcctgcgagcccgtgcaggtggagatgtgcctgggcctgagctacaacaccaccgccttccccaacatctgggtgggcatgatcacccaggaggaggtggtggaggtgctgagcggctacaagagcctgaccagcctgccctgctaccagcacttcagaagactgctgtgcggcctgctggtgcccagatgcacccccctgggcagcgtgctgcccccctgcagaagcgtgtgccaggaggccgagcaccagtgccagagcggcctggccctgctgggcaccccctggcccttcaactgcaacagactgcccgaggccgccgacctggaggcctgcgcccagccctag

SEQ ID NO: 19724 - DNA, 1740 bp, Artificial Sequence; identical to SEQ ID NO: 19723
  Description of Artificial Sequence: Synthetic coding sequence

SEQ ID NO: 19725 - DNA, 396 bp, Artificial Sequence
  Description of Artificial Sequence: Synthetic coding sequence
atggcccccagcctgtggaagggcctggtgggcatcggcctgttcgccctggcccacgccgccttcagcgccgcccagcacagaagctacatgagactgaccgagaaggaggacgagagcctgcccatcgacatcgtgctgcagaccctgctggccttcgccgtgacctgctacggcatcgtgcacatcgccggcgagttcaaggacatggacgccaccagcgagctgaagaacaagaccttcgacaccctgagaaaccaccccagcttctacgtgttcaaccacagaggcagagtgctgttcagacccagcgacaccgccaacagcagcaaccaggacgccctgagcagcaacaccagcctgaagctgagaaagctggagagcctgagaagatag

SEQ ID NO: 19726 - DNA, 591 bp, Artificial Sequence
  Description of Artificial Sequence: Synthetic coding sequence
atgacccccctgggcagcggcccccccagagaggccagcatcgcccagcccagcggcttcagcaccaccgagaccctgtgcgcccaggacttcagcgacgtgatcttcctgagaagagccgacaccagaagatggaagaagaagcagctgagaagacccagcctgctgctgctgggctgctgcagcttcggcatcatggcccccagcctgtggaagggcctggtgggcatcggcctgttcgccctggcccacgccgccttcagcgccgcccagcacagaagctacatgagactgaccgagaaggaggacgagagcctgcccatcgacatcgtgctgcagaccctgctggccttcgccgtgacctgctacggcatcgtgcacatcgccggcgagttcaaggacatggacgccaccagcgagctgaagaacaagaccttcgacaccctgagaaaccaccccagcttctacgtgttcaaccacagaggcagagtgctgttcagacccagcgacaccgccaacagcagcaaccaggacgccctgagcagcaacaccagcctgaagctgagaaagctggagagcctgagaagatag

SEQ ID NO: 19727 - DNA, 2139 bp, Artificial Sequence
  Description of Artificial Sequence: Synthetic coding sequence
atggagagcaccagccaggacagaagagccacccacgtgatcaccatcaagcccaacgagaccgtgctgaccgccttcccctacagaccccacagcagcctgctggacttcctgaagggcgagcccagagtgctgggcgccacccagatcctgctggccctgatcatcgtgggcttcggcaccatcttcgccctgaactacatcggcttcagccagagactgcccctggtggtgctgaccggctaccccttctggggcgccctgatcttcatcctgaccggctacctgaccgtgaccgacaagaagagcaagctgctgggccagggcgtgaccggcatgaacgtgatcagcagcctggtggccatcaccggcatcaccttcaccatcctgagctacagacaccaggacaagtactgccagatgcccagcttcgaggagatctgcgtgttcagcagaaccctgttcatcggcatcctgctgatcctgctgatcatcagcatcgccgagctgagcatcagcgtgaccatcgccagcttcagaagcaagtgctggacccagagcgacgaggtgctgttcttcctgcccagcgacgtgacccagaacagcgagcagcccgcccccgaggagaacgaccagctgcagttcgtgctgcaggaggagttcagcagcgacgacagcaccaccaacgcccagagcgtgatcttcggcggctacgccttcttcaagctgaccctgagcagaagccccctggtgagccagcccggcaacaagggcagagagttcgtgcccgacgagcagaagcagagcatcctgcccagccccaagttcagcgaggaggagatcgagcccctgccccccaccctggagaagaagcccagcgagaacatgagcatccagctggacagcaccttcaagcagatgaaggacgaggacctgcagagcgccatcgtgcagcccagccagatgcagaccaagctgctgcaggaccaggccgccagcctgcaggtgttccccagccacagcgccctgaagctggaggacatcagccccgaggacctgcccagccaggccctgcccgtggagggcctgagcgagcagaccatgcccagcaagagcaccagcagccacgtgaagcagagcagcaacctgaccgccaacgacctgcccccccagggcatcctgagccaggacaccagcagccaggacatgctgttccacgacatgaccagccaggacatgcagagcctggacatgctgagccaggacacccccagccacgccatgcccccccaggacatccccagccaggacatgctgagccaggccctgagcgcccacgccatcctgcccgaggccagcaccagccacatcgtgcagttccccgagatccagcacctgctgcagcagccccccgacctgcagcccgagaacaccgagccccagaaccagcagatcctgcagatgagctaccaggacatcagaagcgaggtgatggaggagaccaaggagtggaagagcgaggaggagctgcacagaagaaagagcagcagaagacacagcctgaaccagcagaccaaggccctgcagtacctgagaagacacagcctggacgtgcaggccaagggccagaagagcagcaagagacacagcctggaccagcagagcaagggctggcagagccccaagcagaagagcctggaccagcagatcaaggactggctgagccccaagagacacagcgtggacaagcaggcccagctgaaccagaccaaggagcagctgcccgaccagcaggccgaggaccagcaggccaagggcgagcagtaccccgagggccagagcaaggacggccaggtgaaggaccagcagaccgacaaggagcagaacagcaagaagcagacccaggaccagcagaccgaggaccagcccgcccaggagaagaagagccccaagggccagttccagaacgtgcaggccgagggccagcaggcccaggtggagaaggtgcccaagctgctgtgccaggacagcgagagccagatccagcagtaccagttctggcagttccacaagggcaacctgcaggccggccagcccagaaccgtgaacctgctggccaagaaccccctgaccggctag

SEQ ID NO: 19728 - DNA, 339 bp, Artificial Sequence
  Description of Artificial Sequence: Synthetic coding sequence
atgatcggcatcttccacatcttcatgtggtacttcctgctggtgctgtacatgggccagatcaagggcgccttcggcacctacgagcccgtgacctacaagaccggctgcaccctgtggggcatcttcttcatcatcgccggcgtgttcctgatcagagtgaccaagtaccccaccagaagcggcaagctgggcagagaggtgagcagaatcctgctgttcttctacggcctggagttcagcatcgccctgacccacagcatctacagctgcagcaacctgttcagaagacagaacgacctgaccagcgtgaccgaggaggccgagagcaccccctag

SEQ ID NO: 19729 - DNA, 459 bp, Artificial Sequence
  Description of Artificial Sequence: Synthetic coding sequence
atgatcggcatcttccacatcttcatgtggtacttcctgctggtgctgtacatgggccagatcaagggcgccttcggcacctacgagcccgtgacctacaagaccggctgcaccctgtggggcatcttcttcatcatcgccggcgtgttcctgatcagagtgaccaagtaccccaccagaagcggcatcatcagcaccctgatcatcaacatcatctgcatcatcaccaccatcaccgccgtgaccctgaccatcatcgagctgagccacttcaacagcgtgagctacagaaactacggccaggccaagctgggcagagaggtgagcagaatcctgctgttcttctacggcctggagttcagcatcgccctgacccacagcatctacagctgcagcaacctgttcagaagacagaacgacctgaccagcgtgaccgaggaggccgagagcaccccctag

SEQ ID NO: 19730 - DNA, 282 bp, Artificial Sequence
  Description of Artificial Sequence: Synthetic coding sequence
atgatcggcatcttccacatcttcatgtggtacttcctgctggtgctgtacatgggccagatcaagggcgccttcggcacctacgagcccgtgacctacaagaccggctgcaccctgtggggcatcttcaagctgggcagagaggtgagcagaatcctgctgttcttctacggcctggagttcagcatcgccctgacccacagcatctacagctgcagcaacctgttcagaagacagaacgacctgaccagcgtgaccgaggaggccgagagcaccccctag

SEQ ID NO: 19731 - DNA, 2040 bp, Artificial Sequence
  Description of Artificial Sequence: Synthetic coding sequence
atggagagcaccagccaggacagaagagccacccacgtgatcaccatcaagcccaacgagaccgtgctgaccgccttcccctacagaccccacagcagcctgctggacttcctgaagggcgagcccagagtgctgggcgccacccagatcctgctggccctgatcatcgtgggcttcggcaccatcttcgccctgaactacatcggcttcagccagagactgcccctggtggtgctgaccggctaccccttctggggcgccctgatcttcatcctgaccggctacctgaccgtgaccgacaagaagagcaagctgctgggccagggcgtgaccggcatgaacgtgatcagcagcctggtggccatcaccggcatcaccttcaccatcctgagctacagacaccaggacaagtactgccagatgcccagcttcgaggagatctgcgtgttcagcagaaccctgttcatcgtgctgttcttcctgcccagcgacgtgacccagaacagcgagcagcccgcccccgaggagaacgaccagctgcagttcgtgctgcaggaggagttcagcagcgacgacagcaccaccaacgcccagagcgtgatcttcggcggctacgccttcttcaagctgaccctgagcagaagccccctggtgagccagcccggcaacaagggcagagagttcgtgcccgacgagcagaagcagagcatcctgcccagccccaagttcagcgaggaggagatcgagcccctgccccccaccctggagaagaagcccagcgagaacatgagcatccagctggacagcaccttcaagcagatgaaggacgaggacctgcagagcgccatcgtgcagcccagccagatgcagaccaagctgctgcaggaccaggccgccagcctgcaggtgttccccagccacagcgccctgaagctggaggacatcagccccgaggacctgcccagccaggccctgcccgtggagggcctgagcgagcagaccatgcccagcaagagcaccagcagccacgtgaagcagagcagcaacctgaccgccaacgacctgcccccccagggcatcctgagccaggacaccagcagccaggacatgctgttccacgacatgaccagccaggacatgcagagcctggacatgctgagccaggacacccccagccacgccatgcccccccaggacatccccagccaggacatgctgagccaggccctgagcgcccacgccatcctgcccgaggccagcaccagccacatcgtgcagttccccgagatccagcacctgctgcagcagccccccgacctgcagcccgagaacaccgagccccagaaccagcagatcctgcagatgagctaccaggacatcagaagcgaggtgatggaggagaccaaggagtggaagagcgaggaggagctgcacagaagaaagagcagcagaagacacagcctgaaccagcagaccaaggccctgcagtacctgagaagacacagcctggacgtgcaggccaagggccagaagagcagcaagagacacagcctggaccagcagagcaagggctggcagagccccaagcagaagagcctggaccagcagatcaaggactggctgagccccaagagacacagcgtggacaagcaggcccagctgaaccagaccaaggagcagctgcccgaccagcaggccgaggaccagcaggccaagggcgagcagtaccccgagggccagagcaaggacggccaggtgaaggaccagcagaccgacaaggagcagaacagcaagaagcagacccaggaccagcagaccgaggaccagcccgcccaggagaagaagagccccaagggccagttccagaacgtgcaggccgagggccagcaggcccaggtggagaaggtgcccaagctgctgtgccaggacagcgagagccagatccagcagtaccagttctggcagttccacaagggcaacctgcaggccggccagcccagaaccgtgaacctgctggccaagaaccccctgaccggctag

SEQ ID NO: 19732 - DNA, 177 bp, Artificial Sequence
  Description of Artificial Sequence: Synthetic coding sequence
atgaacgtgatcagcagcctggtggccatcaccggcatcaccttcaccatcctgagctacagacaccaggacaagtactgccagatgcccagcttcgaggagatctgcgtgttcagcagaaccctgttcatcgacttcatcctgctgacccccccccacagcagccacttcctgtag

SEQ ID NO: 19733 - DNA, 1989 bp, Artificial Sequence
  Description of Artificial Sequence: Synthetic coding sequence
atggagagcaccagccaggacagaagagccacccacgtgatcaccatcaagcccaacgagaccgtgctgaccgccttcccctacagaccccacagcagcctgctggacttcctgaagggcgagcccagagtgctgggcgccacccagatcctgctggccctgatcatcgtgggcttcggcaccatcttcgccctgaactacatcggcttcagccagagactgcccctggtggtgctgaccggctaccccttctggggcgccctgatcggccagggcgtgaccggcatgaacgtgatcagcagcctggtggccatcaccggcatcaccttcaccatcctgagctacagacaccaggacaagtactgccagatgcccagcttcgaggagatctgcgtgttcagcagaaccctgttcatcgtgctgttcttcctgcccagcgacgtgacccagaacagcgagcagcccgcccccgaggagaacgaccagctgcagttcgtgctgcaggaggagttcagcagcgacgacagcaccaccaacgcccagagcgtgatcttcggcggctacgccttcttcaagctgaccctgagcagaagccccctggtgagccagcccggcaacaagggcagagagttcgtgcccgacgagcagaagcagagcatcctgcccagccccaagttcagcgaggaggagatcgagcccctgccccccaccctggagaagaagcccagcgagaacatgagcatccagctggacagcaccttcaagcagatgaaggacgaggacctgcagagcgccatcgtgcagcccagccagatgcagaccaagctgctgcaggaccaggccgccagcctgcaggtgttccccagccacagcgccctgaagctggaggacatcagccccgaggacctgcccagccaggccctgcccgtggagggcctgagcgagcagaccatgcccagcaagagcaccagcagccacgtgaagcagagcagcaacctgaccgccaacgacctgcccccccagggcatcctgagccaggacaccagcagccaggacatgctgttccacgacatgaccagccaggacatgcagagcctggacatgctgagccaggacacccccagccacgccatgcccccccaggacatccccagccaggacatgctgagccaggccctgagcgcccacgccatcctgcccgaggccagcaccagccacatcgtgcagttccccgagatccagcacctgctgcagcagccccccgacctgcagcccgagaacaccgagccccagaaccagcagatcctgcagatgagctaccaggacatcagaagcgaggtgatggaggagaccaaggagtggaagagcgaggaggagctgcacagaagaaagagcagcagaagacacagcctgaaccagcagaccaaggccctgcagtacctgagaagacacagcctggacgtgcaggccaagggccagaagagcagcaagagacacagcctggaccagcagagcaagggctggcagagccccaagcagaagagcctggaccagcagatcaaggactggctgagccccaagagacacagcgtggacaagcaggcccagctgaaccagaccaaggagcagctgcccgaccagcaggccgaggaccagcaggccaagggcgagcagtaccccgagggccagagcaaggacggccaggtgaaggaccagcagaccgacaaggagcagaacagcaagaagcagacccaggaccagcagaccgaggaccagcccgcccaggagaagaagagccccaagggccagttccagaacgtgcaggccgagggccagcaggcccaggtggagaaggtgcccaagctgctgtgccaggacagcgagagccagatccagcagtaccagttctggcagttccacaagggcaacctgcaggccggccagcccagaaccgtgaacctgctggccaagaaccccctgaccggctag

SEQ ID NO: 19734 - DNA, 1704 bp, Artificial Sequence
  Description of Artificial Sequence: Synthetic coding sequence
atgaacgtgatcagcagcctggtggccatcaccggcatcaccttcaccatcctgagctacagacaccaggacaagtactgccagatgcccagcttcgaggagatctgcgtgttcagcagaaccctgttcatcgtgctgttcttcctgcccagcgacgtgacccagaacagcgagcagcccgcccccgaggagaacgaccagctgcagttcgtgctgcaggaggagttcagcagcgacgacagcaccaccaacgcccagagcgtgatcttcggcggctacgccttcttcaagctgaccctgagcagaagccccctggtgagccagcccggcaacaagggcagagagttcgtgcccgacgagcagaagcagagcatcctgcccagccccaagttcagcgaggaggagatcgagcccctgccccccaccctggagaagaagcccagcgagaacatgagcatccagctggacagcaccttcaagcagatgaaggacgaggacctgcagagcgccatcgtgcagcccagccagatgcagaccaagctgctgcaggaccaggccgccagcctgcaggtgttccccagccacagcgccctgaagctggaggacatcagccccgaggacctgcccagccaggccctgcccgtggagggcctgagcgagcagaccatgcccagcaagagcaccagcagccacgtgaagcagagcagcaacctgaccgccaacgacctgcccccccagggcatcctgagccaggacaccagcagccaggacatgctgttccacgacatgaccagccaggacatgcagagcctggacatgctgagccaggacacccccagccacgccatgcccccccaggacatccccagccaggacatgctgagccaggccctgagcgcccacgccatcctgcccgaggccagcaccagccacatcgtgcagttccccgagatccagcacctgctgcagcagccccccgacctgcagcccgagaacaccgagccccagaaccagcagatcctgcagatgagctaccaggacatcagaagcgaggtgatggaggagaccaaggagtggaagagcgaggaggagctgcacagaagaaagagcagcagaagacacagcctgaaccagcagaccaaggccctgcagtacctgagaagacacagcctggacgtgcaggccaagggccagaagagcagcaagagacacagcctggaccagcagagcaagggctggcagagccccaagcagaagagcctggaccagcagatcaaggactggctgagccccaagagacacagcgtggacaagcaggcccagctgaaccagaccaaggagcagctgcccgaccagcaggccgaggaccagcaggccaagggcgagcagtaccccgagggccagagcaaggacggccaggtgaaggaccagcagaccgacaaggagcagaacagcaagaagcagacccaggaccagcagaccgaggaccagcccgcccaggagaagaagagccccaagggccagttccagaacgtgcaggccgagggccagcaggcccaggtggagaaggtgcccaagctgctgtgccaggacagcgagagccagatccagcagtaccagttctggcagttccacaagggcaacctgcaggccggccagcccagaaccgtgaacctgctggccaagaaccccctgaccggctag

SEQ ID NO: 19735 - DNA, 444 bp, Artificial Sequence
  Description of Artificial Sequence: Synthetic coding sequence
atggtgagaagaggccacgtgggcatcttcttcatcgagggcggcgtgcccttctggggcggcgcctgcttcatcatcagcggcagcctgagcgtggccgccgagaagaaccacaccagctgcctggtgagaagcagcctgggcaccaacatcctgagcgtgatggccgccttcgccggcaccgccatcctgctgatggacttcggcgtgaccaacagagacgtggacagaggctacctggccgtgctgaccatcttcaccgtgctggagttcttcaccgccgtgatcgccatgcacttcggctgccaggccatccacgcccaggccagcgcccccgtgatcttcctgcccaacgccttcagcgccgacttcaacatccccagccccgccgccagcgccccccccgcctacgacaacgtggcctacgcccagggcgtggtgtag

SEQ ID NO: 19736 - DNA, 723 bp, Artificial Sequence
  Description of Artificial Sequence: Synthetic coding sequence
atgagcgccgcccccgccagcaacggcgtgttcgtggtgatcccccccaacaacgccagcggcctgtgccccccccccgccatcctgcccaccagcatgtgccagccccccggcatcatgcagttcgaggagccccccctgggcgcccagacccccagagccacccagccccccgacctgagacccgtggagaccttcctgaccggcgagcccaaggtgctgggcaccgtgcagatcctgatcggcctgatccacctgggcttcggcagcgtgctgctgatggtgagaagaggccacgtgggcatcttcttcatcgagggcggcgtgcccttctggggcggcgcctgcttcatcatcagcggcagcctgagcgtggccgccgagaagaaccacaccagctgcctggtgagaagcagcctgggcaccaacatcctgagcgtgatggccgccttcgccggcaccgccatcctgctgatggacttcggcgtgaccaacagagacgtggacagaggctacctggccgtgctgaccatcttcaccgtgctggagttcttcaccgccgtgatcgccatgcacttcggctgccaggccatccacgcccaggccagcgcccccgtgatcttcctgcccaacgccttcagcgccgacttcaacatccccagccccgccgccagcgccccccccgcctacgacaacgtggcctacgcccagggcgtggtgtag

SEQ ID NO: 19737 - DNA, 3162 bp, Artificial Sequence
  Description of Artificial Sequence: Synthetic coding sequence
atggaggtgagcggcgaccccggcatccccgccctgcacagactgtgcaccagagccctgagcgccagccccggccccaccgccctgggccccagcaccttcctgccctgggacgtgagcgccagaatgaccagcgccagaagaagaaccgacgtgggccccagagtggccttcacctacccctgcacccagctgagccccaccagagcccacagacacctgcccgtgcacaccgtgacctacccctgcacccagctgagccccaccagagcccacagctgccacctgcccatgcacaccgtgacctacccctgcacccccagccccaccagagcccacagctgccacctgcccgtgcacaccgtgacctacacctgcaccctgagccccacccacgcctgcctgcacgccagcaccgtgagctgcctgtgctgcatccccgtgcacaccgtgacctacccctgcaccctgagccccacctgcgcccactgccacctgcacatgagagccagaacccacccccagccccacgcctgcgccgtgtacctgtgcatcctgagccccaccagagcccactgccacctgcacgtgcacaccgtgacctacatgtgcgtgcccgcctgcacccacagcatcacccccgtgcacgccccccccgacaccagctgcgcctgggcccaggccgtgcacagatggcccgtgctgtggggcagcagaagcagcagcatgagcagcggcctgaagcagacccccatggtgggcgtgaccggccccccctgggaccccgacgcccccgcccccgcccccgccggcaccctgaccgcccacctgatccccggcgccctgcagagcagcggcctgaccctgctgctgagcctggccgcccactgcagcggcccccaggccaaggtgctgagccccggcggcctggacgccagcggcgccaacctgtgggccagcgccaactgcagcctgctgcagggcttctggtgccagcccgccagccagctgcccagagaccagctgagcgccctgatccagagactggccctgctgcaggtgcccctgcaggcctggcaggtgagcggcaaggagtgcagaggcgccggcaccggcggcagaggcgacgaccccacctgcggcaagagaggcagagaggtgggcggcgactggggcctgagacccccccagagaggcagagcccccaccggctgccacggcgagagcagagtgaccagagagagaagaagcgcccagctgagctgcctggccaacctggccagcagatgcggcctgcaggacgacttcaccctgcacccccccaacctgctgctgttctacaacctgagccaggtgagagaggccgactgcagagccttcatcagaagagccgcccagggcgacgtggagctgctgagccacctgcccgaccagagagtggccctgtggagagccgccgtggcctgcctggtgggcgccggctggggctgggccagatgcatcggcggcagcctgcccctgggcgccgacctgctggccctgcagggcgtggccagactgagactgagcgccagcgaccagcagctgctgggcgccctggtgtgcgacatggacgccagcagcatcggcgccgccgacccccacatgctggagaacctgagaagatgccccagactgaccgccgcccagagaatcgccctgaacagcctgctggccggcggcaagaccagcctgggcccccccggcagctggaccctggagggcctgcaggccctgggccccctggccacctacatcagcccccacctgtgggcccaggtgcaggaggccgtgggcctgggcttcttcagaagcgtggtggccagctgccaggtgggcagactgggccagagagaggccagatgcttcgtgaccagcttcctggagagcaagaccaagcccgtgagcagcagacccagactgagcaccggcaacatcaccgccgccaccctgagagacgacctgttcctggtgcactacgactgcgccgagctggagagctgcctggacggctgcatcctgagaaccaacctggacaccctgctgcagcacctgctgcccaccgagtgccagcacgtggtgaaggccaagctggcccagatctacccccagggcctgcccgaggaccagctgagactgatcaccagcctggtgtacctgtacagcagaaccgagatcggccagtggagcatcaccagccaggacaccgtgatggccctgctggccagcgacgtggccctggagaaccagaccgaggccgtgctgcagaagttcctggagcacaacggcaccgtgagcggcgccctgctgctggccatcggcggcaccagactgtgctggatgagcccccaccagatccagaccatccacccccaggagctgagactggccggcgccctggacctgagcagctgcccccagagcagaaaggacgtgctgtacaccaaggcccacgagaccttcggcagcagcggcaccctggccgcctactacagactgatgagaccctacctgggcggcagccccggcggcgcccagccccccagccccgtgccccccggcggcgcccccgtggaggagctgagacacctggcccacgccaacatcagcatggacatcgacaccttcaccagcctgaaccccctggagctgcagagcctggacgtgggcaacgtgaccgccctgctgggccacaacgtgggcgacctgcagaaggccagaagccaccccaccgtgagagcctggctgagaagcctgaacagcagcaccctgggccagctgggcctggacgccagccccaccagccccaccggccccgcccacggcaccagaggcccccccagcaccacccaccaggtgctgcacctggtgcacaccagcggcctgcccaccaacgacgcccaggccagcaccagcggcagcctgtgggcccccctgggctacctgcccctggccatggccctgccctgcagcctgctgtgcctgctgcactggggcacctgcatcctggtgagcgtggacagcgtggccagcggctggctgggcagccagggcagcggcgccggcaagaccgaggtgctggacagcgccggcagacccctgggcctgaccggccagctgtag

SEQ ID NO: 19738 - DNA, 2109 bp, Artificial Sequence
  Description of Artificial Sequence: Synthetic coding sequence
atggccgccgccgtgaccatccccggccccagaatcggcgccctgcagagcagcggcctgaccctgctgctgagcctggccgcccactgcagcggcccccaggccaaggtgctgagccccggcggcctggacgccagcggcgccaacctgtgggccagcgccaactgcagcctgctgcagggcttctggtgccagcccgccagccagctgcccagagaccagctgagcgccctgatccagagactggccctgctgcaggtgcccctgcaggcctggcagctgagctgcctggccaacctggccagcagatgcggcctgcaggacgacttcaccctgcacccccccaacctgctgctgttctacaacctgagccaggtgagagaggccgactgcagagccttcatcagaagagccgcccagggcgacgtggagctgctgagccacctgcccgaccagagagtggccctgtggagagccgccgtggcctgcctggtgggcgccggcctgagactgagcgccagcgaccagcagctgctgggcgccctggtgtgcgacatggacgccagcagcatcggcgccgccgacccccacatgctggagaacctgagaagatgccccagactgaccgccgcccagagaatcgccctgaacagcctgctggccggcggcaagaccagcctgggcccccccggcagctggaccctggagggcctgcaggccctgggccccctggccacctacatcagcccccacctgtgggcccaggtgcaggaggccgtgggcctgggcttcttcagaagcgtggtggccagctgccaggtgggcagactgggccagagagaggccagatgcttcgtgaccagcttcctggagagcaagaccaagcccgtgagcagcagacccagactgagcaccggcaacatcaccgccgccaccctgagagacgacctgttcctggtgcactacgactgcgccgagctggagagctgcctggacggctgcatcctgagaaccaacctggacaccctgctgcagcacctgctgcccaccgagtgccagcacgtggtgaaggccaagctggcccagatctacccccagggcctgcccgaggaccagctgagactgatcaccagcctggtgtacctgtacagcagaaccgagatcggccagtggagcatcaccagccaggacaccgtgatggccctgctggccagcgacgtggccctggagaaccagaccgaggccgtgctgcagaagttcctggagcacaacggcaccgtgagcggcgccctgctgctggccatcggcggcaccagactgtgctggatgagcccccaccagatccagaccatccacccccaggagctgagactggccggcgccctggacctgagcagctgcccccagagcagaaaggacgtgctgtacaccaaggcccacgagaccttcggcagcagcggcaccctggccgcctactacagactgatgagaccctacctgggcggcagccccggcggcgcccagccccccagccccgtgccccccggcggcgcccccgtggaggagctgagacacctggcccacgccaacatcagcatggacatcgacaccttcaccagcctgaaccccctggagctgcagagcctggacgtgggcaacgtgaccgccctgctgggccacaacgtgggcgacctgcagaaggccagaagccaccccaccgtgagagcctggctgagaagcctgaacagcagcaccctgggccagctgggcctggacgccagccccaccagccccaccggccccgcccacggcaccagaggcccccccagcaccacccaccaggtgctgcacctggtgcacaccagcggcctgcccaccaacgacgcccaggccagcaccagcggcagcctgtgggcccccctgggctacctgcccctggccatggccctgccctgcagcctgctgtgcctgctgcactggggcacctgcatcctggtgagcgtggacagcgtggccagcggctggctgggcagccagggcagcggcgccggcaagaccgaggtgctggacagcgccggcagacccctgggcctgaccggccagctgtag

SEQ ID NO: 19739 - DNA, 792 bp, Artificial Sequence
  Description of Artificial Sequence: Synthetic coding sequence
atgagcctggtggccgaggccttcgtgagccagatcgccgccgccgagccctggcccgagaacgccaccctgtaccagcagctgaagggcgagcagatcctgctgagcgacaacgccgccagcctggccgtgcaggccttcctgcagatgtgcaacctgcccatcaaggtggtgtgcagagccaacgccgagtacatgagccccagcggcaaggtgcccttcatccacgtgggcaaccaggtggtgagcgagctgggccccatcgtgcagttcgtgaaggccaagggccacagcctgagcgacggcctggaggaggtgcagaaggccgagatgaaggcctacatggagctggtgaacaacatgctgctgaccgccgagctgtacctgcagtggtgcgacgaggccaccgtgggcgagatcacccacgccagatacggcagcccctacccctggcccctgaaccacatcctggcctaccagaagcagtgggaggtgaagagaaagatgaaggccatcggctggggcaagaagaccctggaccaggtgctggaggacgtggaccagtgctgccaggccctgagccagagactgggcacccagccctacttcttcaacaagcagcccaccgagctggacgccctggtgttcggccacctgtacaccatcctgaccacccagctgaccaacgacgagctgagcgagaaggtgaagaactacagcaacctgctggccttctgcagaagaatcgagcagcactacttcgaggacagaggcaagggcagactgagctag

SEQ ID NO: 19740 - DNA, 762 bp, Artificial Sequence
  Description of Artificial Sequence: Synthetic coding sequence
atgtacatcgccgccgagccctggcccgagaacgccaccctgtaccagcagctgaagggcgagcagatcctgctgagcgacaacgccgccagcctggccgtgcaggccttcctgcagatgtgcaacctgcccatcaaggtggtgtgcagagccaacgccgagtacatgagccccagcggcaaggtgcccttcatccacgtgggcaaccaggtggtgagcgagctgggccccatcgtgcagttcgtgaaggccaagggccacagcctgagcgacggcctggaggaggtgcagaaggccgagatgaaggcctacatggagctggtgaacaacatgctgctgaccgccgagctgtacctgcagtggtgcgacgaggccaccgtgggcgagatcacccacgccagatacggcagcccctacccctggcccctgaaccacatcctggcctaccagaagcagtgggaggtgaagagaaagatgaaggccatcggctggggcaagaagaccctggaccaggtgctggaggacgtggaccagtgctgccaggccctgagccagagactgggcacccagccctacttcttcaacaagcagcccaccgagctggacgccctggtgttcggccacctgtacaccatcctgaccacccagctgaccaacgacgagctgagcgagaaggtgaagaactacagcaacctgctggccttctgcagaagaatcgagcagcactacttcgaggacagaggcaagggcagactgagctag

SEQ ID NO: 19741 - DNA, 477 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctacgccaagttcagcggcgcccccctgaaggtgaacgtgatcgacaacacctggagaggcagcagaggcgacgtgcccatcctgaccaccgaggacgacatggtgagccagcccgccaagatcctgaacttcctgagaaagcagaagtacaacgccgactacgagctgagcgccaagcagggcgccgacaccctggcctacatcgccctgctggaggagaagctgctgcccgccgtgctgcacaccttctgggtggagagcgacaactacttcaccgtgaccaagccctggttcgccagccagatccccttccccctgagcctgatcctgcccggcagaatgagcaagcagatcctgagcagcagagccggcacccacatgctgagaaagtag

SEQ ID NO: 19742 - DNA, 747 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctacgccaagttcagcggcgcccccctgaaggtgaacgtgatcgacaacacctggagaggcagcagaggcgacgtgcccatcctgaccaccgaggacgacatggtgagccagcccgccaagatcctgaacttcctgagaaagcagaagtacaacgccgactacgagctgagcgccaagcagggcgccgacaccctggcctacatcgccctgctggaggagaagctgctgcccgccgtgctgcacaccttctgggtggagagcgacaactacttcaccgtgaccaagccctggttcgccagccagatccccttccccctgagcctgatcctgcccggcagaatgagcaagggcgccctgaacagaatcctgctgaccagaggccagccccccctgtaccacctgagagaggtggaggcccagatctacagagacgccaaggagtgcctgaacctgctgagcaacagactgggcaccagccagttcttcttcggcgacacccccagcaccctggacgcctacgtgttcggcttcctggcccccctgtacaaggtgagattccccaaggtgcagctgcaggagcacctgaagcagctgagcaacctgtgcagattctgcgacgacatcctgagcagctacttcagactgagcctgggcgagggctag

SEQ ID NO: 19743 - DNA, 747 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctacgccaagttcagcggcgcccccctgaaggtgaacgtgatcgacaacacctggagaggcagcagaggcgacgtgcccatcctgaccaccgaggacgacatggtgagccagcccgccaagatcctgaacttcctgagaaagcagaagtacaacgccgactacgagctgagcgccaagcagggcgccgacaccctggcctacatcgccctgctggaggagaagctgctgcccgccgtgctgcacaccttctgggtggagagcgacaactacttcaccgtgaccaagccctggttcgccagccagatccccttccccctgagcctgatcctgcccggcagaatgagcaagggcgccctgaacagaatcctgctgaccagaggccagccccccctgtaccacctgagagaggtggaggcccagatctacagagacgccaaggagtgcctgaacctgctgagcaacagactgggcaccagccagttcttcttcggcgacacccccagcaccctggacgcctacgtgttcggcttcctggcccccctgtacaaggtgagattccccaaggtgcagctgcaggagcacctgaagcagctgagcaacctgtgcagattctgcgacgacatcctgagcagctacttcagactgagcctgggcgacggctag

SEQ ID NO: 19744 - DNA, 939 bp, Artificial Sequence
  Description of Artificial Sequence: Synthetic coding sequence
atggccgcccccctggagctgagctgctggggcggcggctggggcctgcccagcgtgcacagcgagagcctggtggtgatggcctacgccaagttcagcggcgcccccctgaaggtgaacgtgatcgacaacacctggagaggcagcagaggcgacgtgcccatcctgaccaccgaggacgacatggtgagccagcccgccaagatcctgaacttcctgagaaagcagaagtacaacgccgactacgagctgagcgccaagcagggcgccgacaccctggcctacatcgccctgctggaggagaagctgctgcccgccgtgctgcacaccttctgggtggagagcgacaactacttcaccgtgaccaagccctggttcgccagccagatccccttccccctgagcctgatcctgcccggcagaatgagcaagggcgccctgaacagaatcctgctgaccagaggccagccccccctgtaccacctgagagaggtggaggcccagatctacagagacgccaaggagtgcctgaacctgctgagcaacagactgggcaccagccagttcttcttcggcgacacccccagcaccctggacgcctacgtgttcggcttcctggcccccctgtacaaggtgagattccccaaggtgcagctgcaggagcacctgaagcagctgagcaacctgtgcagattctgcgacgacatcctgagcagctacttcagactgagcctgggcggcatcagccccgccggccaggagaccgtggacgccaacctgcagaagctgacccagctggtgaacaaggagagcaacctgatcgagaagatggacgacaacctgagacagagcccccagctgccccccagaaagctgcccaccctgaagctgacccccgccgaggaggagaacaacagcttccagagactgagcccctag

SEQ ID NO: 19745 - DNA, 756 bp, Artificial Sequence
  Description of Artificial Sequence: Synthetic coding sequence
atggtgagccagcccgccaagatcctgaacttcctgagaaagcagaagtacaacgccgactacgagctgagcgccaagcagggcgccgacaccctggcctacatcgccctgctggaggagaagctgctgcccgccgtgctgcacaccttctgggtggagagcgacaactacttcaccgtgaccaagccctggttcgccagccagatccccttccccctgagcctgatcctgcccggcagaatgagcaagggcgccctgaacagaatcctgctgaccagaggccagccccccctgtaccacctgagagaggtggaggcccagatctacagagacgccaaggagtgcctgaacctgctgagcaacagactgggcaccagccagttcttcttcggcgacacccccagcaccctggacgcctacgtgttcggcttcctggcccccctgtacaaggtgagattccccaaggtgcagctgcaggagcacctgaagcagctgagcaacctgtgcagattctgcgacgacatcctgagcagctacttcagactgagcctgggcggcatcagccccgccggccaggagaccgtggacgccaacctgcagaagctgacccagctggtgaacaaggagagcaacctgatcgagaagatggacgacaacctgagacagagcccccagctgccccccagaaagctgcccaccctgaagctgacccccgccgaggaggagaacaacagcttccagagactgagcccctag

SEQ ID NO: 19746 - DNA, 1008 bp, Artificial Sequence
  Description of Artificial Sequence: Synthetic coding sequence
atggccgcccccagcggcgtgcacctgctggtgagaagaggcagccacagaatcttcagcagccccctgaaccacatctacctgcacaagcagagcagcagccagcagagaagaaacttcttcttcagaagacagagagacatcagccacagcatcgtgctgcccgccgccgtgagcagcgcccaccccgtgcccaagcacatcaagaagcccgactacgtgaccaccggcatcgtgcccgactggggcgacagcatcgaggtgaagaacgaggaccagatccagggcctgcaccaggcctgccagctggccagacacgtgctgctgctggccggcaagagcctgaaggtggacatgaccaccgaggagatcgacgccctggtgcacagagagatcatcagccacaacgcctaccccagccccctgggctacggcggcttccccaagagcgtgtgcaccagcgtgaacaacgtgctgtgccacggcatccccgacagcagacccctgcaggacggcgacatcatcaacatcgacgtgaccgtgtactacaacggctaccacggcgacaccagcgagaccttcctggtgggcaacgtggacgagtgcggcaagaagctggtggaggtggccagaagatgcagagacgaggccatcgccgcctgcagagccggcgcccccttcagcgtgatcggcaacaccatcagccacatcacccaccagaacggcttccaggtgtgcccccacttcgtgggccacggcatcggcagctacttccacggccaccccgagatctggcaccacgccaacgacagcgacctgcccatggaggagggcatggccttcaccatcgagcccatcatcaccgagggcagccccgagttcaaggtgctggaggacgcctggaccgtggtgagcctggacaaccagagaagcgcccagttcgagcacaccgtgctgatcaccagcagaggcgcccagatcctgaccaagctgccccacgaggcctag

SEQ ID NO: 19747 - DNA, 747 bp, Artificial Sequence
  Description of Artificial Sequence: Synthetic coding sequence
atgaagcccgccagcatcagcgaggaggagctgctgaacctgatcaacaagctgaacaacgacgacaacgtggacggcctgctggtgcagctgcccctgcccgagcacatcgacgagagaagaatctgcaacgccgtgagccccgacaaggacgtggacggcttccacgtgatcaacgtgggcagaatgtgcctggaccagtacagcatgctgcccgccaccccctggggcgtgtgggagatcatcaagagaaccggcatccccaccctgggcaagaacgtggtggtggccggcagaagcaagaacgtgggcatgcccatcgccatgctgctgcacaccgacggcgcccacgagagacccggcggcgacgccaccgtgaccatcagccacagatacacccccaaggagcagctgaagaagcacaccatcctggccgacatcgtgatcagcgccgccggcatccccaacctgatcaccgccgacatgatcaaggagggcgccgccgtgatcgacgtgggcatcaacagagtgcacgaccccgtgaccgccaagcccaagctggtgggcgacgtggacttcgagggcgtgagacagaaggccggctacatcacccccgtgcccggcggcgtgggccccatgaccgtggccatgctgatgaagaacaccatcatcgccgccaagaaggtgctgagactggaggagagagaggtgctgaagagcaaggagctgggcgtggccaccaactag

SEQ ID NO: 19748 - DNA, 561 bp, Artificial Sequence
  Description of Artificial Sequence: Synthetic coding sequence
atgtgcctggaccagtacagcatgctgcccgccaccccctggggcgtgtgggagatcatcaagagaaccggcatccccaccctgggcaagaacgtggtggtggccggcagaagcaagaacgtgggcatgcccatcgccatgctgctgcacaccgacggcgcccacgagagacccggcggcgacgccaccgtgaccatcagccacagatacacccccaaggagcagctgaagaagcacaccatcctggccgacatcgtgatcagcgccgccggcatccccaacctgatcaccgccgacatgatcaaggagggcgccgccgtgatcgacgtgggcatcaacagagtgcacgaccccgtgaccgccaagcccaagctggtgggcgacgtggacttcgagggcgtgagacagaaggccggctacatcacccccgtgcccggcggcgtgggccccatgaccgtggccatgctgatgaagaacaccatcatcgccgccaagaaggtgctgagactggaggagagagaggtgctgaagagcaaggagctgggcgtggccaccaactag

SEQ ID NO: 19749 - DNA, 1053 bp, Artificial Sequence
  Description of Artificial Sequence: Synthetic coding sequence
atggccgccaccagcctgatgagcgccctggccgccagactgctgcagcccgcccacagctgcagcctgagactgagacccttccacctggccgccgtgagaaacgaggccgtggtgatcagcggcagaaagctggcccagcagatcaagcaggaggtgagacaggaggtggaggagtgggtggccagcggcaacaagagaccccacctgagcgtgatcctggtgggcgagaaccccgccagccacagctacgtgctgaacaagaccagagccgccgccgtggtgggcatcaacagcgagaccatcatgaagcccgccagcatcagcgaggaggagctgctgaacctgatcaacaagctgaacaacgacgacaacgtggacggcctgctggtgcagctgcccctgcccgagcacatcgacgagagaagaatctgcaacgccgtgagccccgacaaggacgtggacggcttccacgtgatcaacgtgggcagaatgtgcctggaccagtacagcatgctgcccgccaccccctggggcgtgtgggagatcatcaagagaaccggcatccccaccctgggcaagaacgtggtggtggccggcagaagcaagaacgtgggcatgcccatcgccatgctgctgcacaccgacggcgcccacgagagacccggcggcgacgccaccgtgaccatcagccacagatacacccccaaggagcagctgaagaagcacaccatcctggccgacatcgtgatcagcgccgccggcatccccaacctgatcaccgccgacatgatcaaggagggcgccgccgtgatcgacgtgggcatcaacagagtgcacgaccccgtgaccgccaagcccaagctggtgggcgacgtggacttcgagggcgtgagacagaaggccggctacatcacccccgtgcccggcggcgtgggccccatgaccgtggccatgctgatgaagaacaccatcatcgccgccaagaaggtgctgagactggaggagagagaggtgctgaagagcaaggagctgggcgtggccaccaactag

SEQ ID NO: 19750 - DNA, 882 bp, Artificial Sequence
  Description of Artificial Sequence: Synthetic coding sequence
atggccaccaacgagagcgtgagcatcttcagcagcgccagcctggccgtggagtacgtggacagcctgctgcccgagaaccccctgcaggagcccttcaagaacgcctggaactacatgctgaacaactacaccaagttccagatcgccacctggggcagcctgatcgtgcacgaggccctgtacttcctgttctgcctgcccggcttcctgttccagttcatcccctacatgaagaagtacaagatccagaaggacaagcccgagacctgggagaaccagtggaagtgcttcaaggtgctgctgttcaaccacttctgcatccagctgcccctgatctgcggcacctactacttcaccgagtacttcaacatcccctacgactgggagagaatgcccagatggtacttcctgctggccagatgcttcggctgcgccgtgatcgaggacacctggcactacttcctgcacagactgctgcaccacaagagaatctacaagtacatccacaaggtgcaccacgagttccaggcccccttcggcatggaggccgagtacgcccaccccctggagaccctgatcctgggcaccggcttcttcatcggcatcgtgctgctgtgcgaccacgtgatcctgctgtgggcctgggtgaccatcagactgctggagaccatcgacgtgcacagcggctacgacatccccctgaaccccctgaacctgatccccttctacgccggcagcagacaccacgacttccaccacatgaacttcatcggcaactacgccagcaccttcacctggtgggacagaatcttcggcaccgacagccagtacaacgcctacaacgagaagagaaagaagttcgagaagaagaccgagtag

SEQ ID NO: 19751 - DNA, 489 bp, Artificial Sequence
  Description of Artificial Sequence: Synthetic coding sequence
atgcccagatggtacttcctgctggccagatgcttcggctgcgccgtgatcgaggacacctggcactacttcctgcacagactgctgcaccacaagagaatctacaagtacatccacaaggtgcaccacgagttccaggcccccttcggcatggaggccgagtacgcccaccccctggagaccctgatcctgggcaccggcttcttcatcggcatcgtgctgctgtgcgaccacgtgatcctgctgtgggcctgggtgaccatcagactgctggagaccatcgacgtgcacagcggctacgacatccccctgaaccccctgaacctgatccccttctacgccggcagcagacaccacgacttccaccacatgaacttcatcggcaactacgccagcaccttcacctggtgggacagaatcttcggcaccgacagccagtacaacgcctacaacgagaagagaaagaagttcgagaagaagaccgagtag

SEQ ID NO: 19752 - DNA, 258 bp, Artificial Sequence
  Description of Artificial Sequence: Synthetic coding sequence
atggccaccaacgagagcgtgagcatcttcagcagcgccagcctggccgtggagtacgtggacagcctgctgcccgagaaccccctgcaggagcccttcaagaacgcctggaactacatgctgaacaactacaccaagttccagatcgccacctggggcagcctgatcgtgcacgaggccctgtacttcctgttctgcctgcccggcttcctgttccagttcatcccctacatgaagaagtacaagatccagaagtag

SEQ ID NO: 19753 - DNA, 663 bp, Artificial Sequence
  Description of Artificial Sequence: Synthetic coding sequence
atggccaccaacgagagcgtgagcatcttcagcagcgccagcctggccgtggagtacgtggacagcctgctgcccgagaaccccctgcaggagcccttcaagaacgcctggaactacatgctgaacaactacaccaagttccagatcgccacctggggcagcctgatcgtgcacgaggccctgtacttcctgttctgcctgcccggcttcctgttccagttcatcccctacatgaagaagtacaagatccagaaggacaagcccgagacctgggagaaccagtggaagtgcttcaaggtgctgctgttcaaccacttctgcatccagctgcccctgatctgcggcacctactacttcaccgagtacttcaacatcccctacgactgggagagaatgcccagatggtacttcctgctggccagatgcttcggctgcgccgtgatcgaggacacctggcactacttcctgcacagactgctgcaccacaagagaatctacaagtacatccacaaggtgcaccacgagttccaggcccccttcggcatggaggccgagtacgcccaccccctggagaccctgatcctgggcaccggcttcttcatcggcatcgtgctgctgtgcgaccacgtgatcctgctgtgggcctgggtgaccatcagatag

SEQ ID NO: 19754 - DNA, 723 bp, Artificial Sequence
  Description of Artificial Sequence: Synthetic coding sequence
atggccgccctgagaagaatgctgcacctgcccagcctgatgatgggcacctgcagacccttcgccggcagcctggccgacagctgcctggccgacagatgcctgtgggacagactgcacgcccagcccagactgggcaccgtgcccaccttcgactggttcttcggctacgacgaggtgcagggcctgctgctgcccctgctgcaggaggcccaggccgccagccccctgagagtgctggacgtgggctgcggcaccagcagcctgtgcaccggcctgtacaccaagagcccccaccccgtggacgtgctgggcgtggacttcagccccgtggccgtggcccacatgaacagcctgctggagggcggccccggccagacccccctgtgccccggccaccccgccagcagcctgcacttcatgcacgccgacgcccagaacctgggcgccgtggccagcagcggcagcttccagctgctgctggacaagggcacctgggacgccgtggccagaggcggcctgcccagagcctaccagctgctgagcgagtgcctgagagtgctgaacccccagggcaccctgatccagttcagcgacgaggaccccgacgtgagactgccctgcctggagcagggcagctacggctggaccgtgaccgtgcaggagctgggccccttcagaggcatcacctacttcgcctacctgatccagggcagccactag

SEQ ID NO: 19755 - DNA, 657 bp, Artificial Sequence
  Description of Artificial Sequence: Synthetic coding sequence
atggccctggtgccctacgaggagaccaccgagttcggcctgcagaagttccacaagcccctggccaccttcagcttcgccaaccacaccatccagatcagacaggactggagacacctgggcgtggccgccgtggtgtgggacgccgccatcgtgctgagcacctacctggagatgggcgccgtggagctgagaggcagaagcgccgtggagctgggcgccggcaccggcctggtgggcatcgtggccgccctgctgggcgcccacgtgaccatcaccgacagaaaggtggccctggagttcctgaagagcaacgtgcaggccaacctgcccccccacatccagaccaagaccgtggtgaaggagctgacctggggccagaacctgggcagcttcagccccggcgagttcgacctgatcctgggcgccgacatcatctacctggaggagaccttcaccgacctgctgcagaccctggagcacctgtgcagcaaccacagcgtgatcctgctggcctgcagaatcagatacgagagagacaacaacttcctggccatgctggagagacagttcaccgtgagaaaggtgcactacgaccccgagaaggacgtgcacatctacgaggcccagaagagaaaccagaaggaggacctgtag

SEQ ID NO: 19756 - DNA, 657 bp, Artificial Sequence; identical to SEQ ID NO: 19755
  Description of Artificial Sequence: Synthetic coding sequence

SEQ ID NO: 19757 - DNA, 273 bp, Artificial Sequence
  Description of Artificial Sequence: Synthetic coding sequence
atggccctggtgccctacgaggagaccaccgagttcggcctgcagaagttccacaagcccctggccaccttcagcttcgccaaccacaccatccagatcagacaggactggagacacctgggcgtggccgccgtggtgtgggacgccgccatcgtgctgagcacctacctggagatgggcgccgtggagctgagaggcagaagcgccgtggagctgggcgccggcaccggcctggtgggcatcgtggccgccctgctgggcggcggcatctag

SEQ ID NO: 19758 - DNA, 657 bp, Artificial Sequence; identical to SEQ ID NO: 19755
  Description of Artificial Sequence: Synthetic coding sequence

SEQ ID NO: 19759 - DNA, 657 bp, Artificial Sequence; identical to SEQ ID NO: 19755
  Description of Artificial Sequence: Synthetic coding sequence

SEQ ID NO: 19760 - DNA, 657 bp, Artificial Sequence; identical to SEQ ID NO: 19755
  Description of Artificial Sequence: Synthetic coding sequence

SEQ ID NO: 19761 - DNA, 273 bp, Artificial Sequence; identical to SEQ ID NO: 19757
  Description of Artificial Sequence: Synthetic coding sequence

SEQ ID NO: 19762 - DNA, 681 bp, Artificial Sequence
  Description of Artificial Sequence: Synthetic coding sequence
atggccgaccccggccccgaccccgagagcgagagcgagagcgtgttccccagagaggtgggcctgttcgccgacagctacagcgagaagagccagttctgcttctgcggccacgtgctgaccatcacccagaacttcggcagcagactgggcgtggccgccagagtgtgggacgccgccctgagcctgtgcaactacttcgagagccagaacgtggacttcagaggcaagaaggtgatcgagctgggcgccggcaccggcatcgtgggcatcctggccgccctgcagggcggcgacgtgaccatcaccgacctgcccctggccctggagcagatccagggcaacgtgcaggccaacgtgcccgccggcggccaggcccaggtgagagccctgagctggggcatcgaccaccacgtgttccccgccaactacgacctggtgctgggcgccgacatcgtgtacctggagcccaccttccccctgctgctgggcaccctgcagcacctgtgcagaccccacggcaccatctacctggccagcaagatgagaaaggagcacggcaccgagagcttcttccagcacctgctgccccagcacttccagctggagctggcccagagagacgaggacgagaacgtgaacatctacagagccagacacagagagcccagacccgcctag

SEQ ID NO: 19763 - DNA, 450 bp, Artificial Sequence
  Description of Artificial Sequence: Synthetic coding sequence
atggccgaccccggccccgaccccgagagcgagagcgagagcgtgttccccagagaggtgggcctgttcgccgacagctacagcgagaagagccagttctgcttctgcggccacgtgctgaccatcacccagaacttcggcagcagactgggcgtggccgccagagtgtgggacgccgccctgagcctgtgcaactacttcgagagccagaacgtggacttcagaggcaagaaggtgatcgagctgggcgccggcaccggcatcgtgggcatcctggccgccctgcagggcgcctacggcctggtgagagagaccgaggacgacgtgatcgagcaggagctgtggagaggcatgagaggcgcctgcggccacgccctgagcatgagcaccatgaccccctgggagagcatcaagggcagcagcgtgagaggcggctgctaccaccactag

SEQ ID NO: 19764 - DNA, 810 bp, Artificial Sequence
  Description of Artificial Sequence: Synthetic coding sequence
gccagatgccagttctgcgcctgcgagagcctgagcccctgcagcggcctgagcagcctggccgccagacagggctaccaccagatctgggccttccccttcctgcccagcggcgccaccgccacctggcccgccgccagcagaagcagaagcctggccgccagaagcctgcccagaagccccgccagacccggccccaacgacgccctgctgggcgagcacgacttcagaggccagggcgtgagagcccagagattcagattcagcgaggagcccggccccggcgccgacggcgccgtgctggaggtgcacgtgccccagatcggcgccggcgtgagcctgcccggcatcctggccgccaagtgcggcgccgaggtgatcctgagcgacagcagcgagctgccccactgcctggaggtgtgcagacagagctgccagatgaacaacctgccccacctgcaggtggtgggcctgacctggggccacatcagctgggacctgctggccctgcccccccaggacatcatcctggccagcgacgtgttcttcgagcccgaggacttcgaggacatcctggccaccatctacttcctgatgcacaagaaccccaaggtgcagctgtggagcacctaccaggtgagaagcgccgactggagcctggaggccctgctgtacaagtgggacatgaagtgcgtgcacatccccctggagagcttcgacgccgacaaggaggacatcgccgagagcaccctgcccggcagacacaccgtggagatgctggtgatcagcttcgccaaggacagcctgtag

SEQ ID NO: 19765 - DNA, 573 bp, Artificial Sequence
  Description of Artificial Sequence: Synthetic coding sequence
atgtacgtgtggccctgcgccgtggtgctggcccagtacctgtggttccacagaagaagcctgcccggcaaggccatcctggagatcggcgccggcgtgagcctgcccggcatcctggccgccaagtgcggcgccgaggtgatcctgagcgacagcagcgagctgccccactgcctggaggtgtgcagacagagctgccagatgaacaacctgccccacctgcaggtggtgggcctgacctggggccacatcagctgggacctgctggccctgcccccccaggacatcatcctggccagcgacgtgttcttcgagcccgaggacttcgaggacatcctggccaccatctacttcctgatgcacaagaaccccaaggtgcagctgtggagcacctaccaggtgagaagcgccgactggagcctggaggccctgctgtacaagtgggacatgaagtgcgtgcacatccccctggagagcttcgacgccgacaaggaggacatcgccgagagcaccctgcccggcagacacaccgtggagatgctggtgatcagcttcgccaaggacagcctgtag

SEQ ID NO: 19766 - DNA, 372 bp, Artificial Sequence
  Description of Artificial Sequence: Synthetic coding sequence
atgaacaacctgccccacctgcaggtggtgggcctgacctggggccacatcagctgggacctgctggccctgcccccccaggacatcatcctggccagcgacgtgttcttcgagcccgaggacttcgaggacatcctggccaccatctacttcctgatgcacaagaaccccaaggtgcagctgtggagcacctaccaggtgagaagcgccgactggagcctggaggccctgctgtacaagtgggacatgaagtgcgtgcacatccccctggagagcttcgacgccgacaaggaggacatcgccgagagcaccctgcccggcagacacaccgtggagatgctggtgatcagcttcgccaaggacagcctgtag

SEQ ID NO: 19767 - DNA, 372 bp, Artificial Sequence; identical to SEQ ID NO: 19766
  Description of Artificial Sequence: Synthetic coding sequence

SEQ ID NO: 19768 - DNA, 372 bp, Artificial Sequence; identical to SEQ ID NO: 19766
  Description of Artificial Sequence: Synthetic coding sequence

SEQ ID NO: 19769 - DNA, 2715 bp, Artificial Sequence
  Description of Artificial Sequence: Synthetic coding sequence
atggccgccatcagagccctgcagcagtggtgcagacagcagtgcgagggctacagagacgtgaacatctgcaacatgaccaccagcttcagagacggcctggccttctgcgccatcctgcacagacacagacccgacctgatcaacttcagcgccctgaagaaggagaacatctacgagaacaacaagctggccttcagagtggccgaggagcacctgggcatccccgccctgctggacgccgaggacatggtggccctgaaggtgcccgacagactgagcatcctgacctacgtgagccagtactacaactacttccacggcagaagccccatcggcggcatggccggcgtgaagagagccagcgaggacagcgaggaggagcccagcggcaagaaggcccccgtgcaggccgccaagctgcccagccccgcccccgccagaaagccccccctgagccccgcccagaccaaccccgtggtgcagagaagaaacgagggcgccggcggccccccccccaagaccgaccaggccctggccggcagcctggtgagcagcacctgcggcgtgtgcggcaagcacgtgcacctggtgcagagacacctggccgacggcagactgtaccacagaagctgcttcagatgcaagcagtgcagctgcaccctgcacagcggcgcctacaaggccaccggcgagcccggcaccttcgtgtgcaccagccacctgcccgccgccgccagcgccagccccaagctgaccggcctggtgcccagacagcccggcgccatgggcgtggacagcagaaccagctgcagcccccagaaggcccaggaggccaacaaggccagacccagcgcctgggagcccgccgccggcaacagccccgccagagccagcgtgcccgccgcccccaaccccgccgccaccagcgccaccagcgtgcacgtgagaagccccgccagacccagcgagagcagactggcccccacccccaccgagggcaaggtgagacccagagtgaccaacagcagccccatgggctggagcagcgccgccccctgcaccgccgccgccgccagccaccccgccgtgccccccagcgcccccgaccccagacccgccaccccccagggcggcggcgcccccagagtggccgccccccagaccaccctgagcagcagcagcaccagcgccgccaccgtggacccccccgcctggacccccagcgccagcagaacccagcaggccagaaacaagttcttccagaccagcgccgtgccccccggcaccagcctgagcggcagaggccccacccccagcctggtgctgagcaaggacagcagcaaggagcaggccagaaacttcctgaagcaggccctgagcgccctggaggaggccggcgcccccgcccccggcagacccagccccgccaccgccgccgtgcccagcagccagcccaagaccgaggccccccaggccagccccctggccaagcccctgcagagcagcagccccagagtgctgggcctgcccagcagaatggagccccccgcccccctgagcaccagcagcaccagccaggccagcgccctgccccccgccggcagaagaaacctggccgagagcagcggcgtgggcagagtgggcgccggcagcagacccaagcccgaggcccccatggccaagggcaagagcaccaccctgacccaggacatgagcaccagcctgcaggagggccaggaggacggccccgccggctggagagccaacctgaagcccgtggacagaagaagccccgccgagagaaccctgaagcccaaggagcccagagccctggccgagcccagagccggcgaggcccccagaaaggtgagcggcagcttcgccggcagcgtgcacatcaccctgacccccgtgagacccgacagaacccccagacccgccagccccggccccagcctgcccgccagaagccccagcccccccagaagaagaagactggccgtgcccgccagcctggacgtgtgcgacaactggctgagacccgagccccccggccaggaggccagagtgcagagctggaaggaggaggagaagaagccccacctgcagggcaagcccggcagacccctgagccccgccaacgtgcccgccctgcccggcgagaccgtgaccagccccgtgagactgcaccccgactacctgagccccgaggagatccagagacagctgcaggacatcgagagaagactggacgccctggagctgagaggcgtggagctggagaagagactgagagccgccgagggcgacgacgccgaggacagcctgatggtggactggttctggctgatccacgagaagcagctgctgctgagacaggagagcgagctgatgtacaagagcaaggcccagagactggaggagcagcagctggacatcgagggcgagctgagaagactgatggccaagcccgaggccctgaagagcctgcaggagagaagaagagagcaggagctgctggagcagtacgtgagcaccgtgaacgacagaagcgacatcgtggacagcctggacgaggacagactgagagagcaggaggaggaccagatgctgagagacatgatcgagaagctgggcctgcagagaaagaagagcaagttcagactgagcaagatctggagccccaagagcaagagcagccccagccagtag

SEQ ID NO: 19770 - DNA, 2079 bp, Artificial Sequence
  Description of Artificial Sequence: Synthetic coding sequence
atggccgccatcagagccctgcagcagtggtgcagacagcagtgcgagggctacagagacgtgaacatctgcaacatgaccacccacctgcccgccgccgccagcgccagccccaagctgaccggcctggtgcccagacagcccggcgccatgggcgtggacagcagaaccagctgcagcccccagaaggcccaggaggccaacaaggccagacccagcgcctgggagcccgccgccggcaacagccccgccagagccagcgtgcccgccgcccccaaccccgccgccaccagcgccaccagcgtgcacgtgagaagccccgccagacccagcgagagcagactggcccccacccccaccgagggcaaggtgagacccagagtgaccaacagcagccccatgggctggagcagcgccgccccctgcaccgccgccgccgccagccaccccgccgtgccccccagcgcccccgaccccagacccgccaccccccagggcggcggcgcccccagagtggccgccccccagaccaccctgagcagcagcagcaccagcgccgccaccgtggacccccccgcctggacccccagcgccagcagaacccagcaggccagaaacaagttcttccagaccagcgccgtgccccccggcaccagcctgagcggcagaggccccacccccagcctggtgctgagcaaggacagcagcaaggagcaggccagaaacttcctgaagcaggccctgagcgccctggaggaggccggcgcccccgcccccggcagacccagccccgccaccgccgccgtgcccagcagccagcccaagaccgaggccccccaggccagccccctggccaagcccctgcagagcagcagccccagagtgctgggcctgcccagcagaatggagccccccgcccccctgagcaccagcagcaccagccaggccagcgccctgccccccgccggcagaagaaacctggccgagagcagcggcgtgggcagagtgggcgccggcagcagacccaagcccgaggcccccatggccaagggcaagagcaccaccctgacccaggacatgagcaccagcctgcaggagggccaggaggacggccccgccggctggagagccaacctgaagcccgtggacagaagaagccccgccgagagaaccctgaagcccaaggagcccagagccctggccgagcccagagccggcgaggcccccagaaaggtgagcggcagcttcgccggcagcgtgcacatcaccctgacccccgtgagacccgacagaacccccagacccgccagccccggccccagcctgcccgccagaagccccagcccccccagaagaagaagactggccgtgcccgccagcctggacgtgtgcgacaactggctgagacccgagccccccggccaggaggccagagtgcagagctggaaggaggaggagaagaagccccacctgcagggcaagcccggcagacccctgagccccgccaacgtgcccgccctgcccggcgagaccgtgaccagccccgtgagactgcaccccgactacctgagccccgaggagatccagagacagctgcaggacatcgagagaagactggacgccctggagctgagaggcgtggagctggagaagagactgagagccgccgagggcgacgacgccgaggacagcctgatggtggactggttctggctgatccacgagaagcagctgctgctgagacaggagagcgagctgatgtacaagagcaaggcccagagactggaggagcagcagctggacatcgagggcgagctgagaagactgatggccaagcccgaggccctgaagagcctgcaggagagaagaagagagcaggagctgctggagcagtacgtgagcaccgtgaacgacagaagcgacatcgtggacagcctggacgaggacagactgagagagcaggaggaggaccagatgctgagagacatgatcgagaagctgggcctgcagagaaagaagagcaagttcagactgagcaagatctggagccccaagagcaagagcagccccagccagtag

SEQ ID NO: 19771 - DNA, 1230 bp, Artificial Sequence
  Description of Artificial Sequence: Synthetic coding sequence
atggacagactgaagagccacctgaccgtgtgcttcctgcccagcgtgcccttcctgatcctggtgagcaccctggccaccgccaagagcgtgaccaacagcaccctgaacggcaccaacgtggtgctgggcagcgtgcccgtgatcatcgccagaaccgaccacatcatcgtgaaggagggcaacagcgccctgatcaactgcagcgtgtacggcatccccgacccccagttcaagtggtacaacagcatcggcaagctgctgaaggaggaggaggacgagaaggagagaggcggcggcaagtggcagatgcacgacagcggcctgctgaacatcaccaaggtgagcttcagcgacagaggcaagtacacctgcgtggccagcaacatctacggcaccgtgaacaacaccgtgaccctgagagtgatcttcaccagcggcgacatgggcgtgtactacatggtggtgtgcctggtggccttcaccatcgtgatggtgctgaacatcaccagactgtgcatgatgagcagccacctgaagaagaccgagaaggccatcaacgagttcttcagaaccgagggcgccgagaagctgcagaaggccttcgagatcgccaagagaatccccatcatcaccagcgccaagaccctggagctggccaaggtgacccagttcaagaccatggagttcgccagatacatcgaggagctggccagaagcgtgcccctgccccccctgatcatgaactgcagaaccatcatggaggagatcatggaggtggtgggcctggaggagcagggccagaacttcgtgagacacacccccgagggccaggaggccgccgacagagacgaggtgtacaccatccccaacagcctgaagagaagcgacagccccgccgccgacagcgacgccagcagcctgcacgagcagccccagcagatcgccatcaaggtgagcgtgcacccccagagcaagaaggagcacgccgacgaccaggagggcggccagttcgaggtgaaggacgtggaggagaccgagctgagcgccgagcacagccccgagaccgccgagcccagcaccgacgtgaccagcaccgagctgaccagcgaggagcccacccccgtggaggtgcccgacaaggtgctgccccccgcctacctggaggccaccgagcccgccgtgacccacgacaagaacacctgcatcatctacgagagccacgtgtag

SEQ ID NO: 19772 - DNA, 921 bp, Artificial Sequence
  Description of Artificial Sequence: Synthetic coding sequence
atgcacgacagcggcctgctgaacatcaccaaggtgagcttcagcgacagaggcaagtacacctgcgtggccagcaacatctacggcaccgtgaacaacaccgtgaccctgagagtgatcttcaccagcggcgacatgggcgtgtactacatggtggtgtgcctggtggccttcaccatcgtgatggtgctgaacatcaccagactgtgcatgatgagcagccacctgaagaagaccgagaaggccatcaacgagttcttcagaaccgagggcgccgagaagctgcagaaggccttcgagatcgccaagagaatccccatcatcaccagcgccaagaccctggagctggccaaggtgacccagttcaagaccatggagttcgccagatacatcgaggagctggccagaagcgtgcccctgccccccctgatcatgaactgcagaaccatcatggaggagatcatggaggtggtgggcctggaggagcagggccagaacttcgtgagacacacccccgagggccaggaggccgccgacagagacgaggtgtacaccatccccaacagcctgaagagaagcgacagccccgccgccgacagcgacgccagcagcctgcacgagcagccccagcagatcgccatcaaggtgagcgtgcacccccagagcaagaaggagcacgccgacgaccaggagggcggccagttcgaggtgaaggacgtggaggagaccgagctgagcgccgagcacagccccgagaccgccgagcccagcaccgacgtgaccagcaccgagctgaccagcgaggagcccacccccgtggaggtgcccgacaaggtgctgccccccgcctacctggaggccaccgagcccgccgtgacccacgacaagaacacctgcatcatctacgagagccacgtgtag

SEQ ID NO: 19773 - DNA, 195 bp, Artificial Sequence
  Description of Artificial Sequence: Synthetic coding sequence
atgcacgacagcggcctgctgaacatcaccaaggtgagcttcagcgacagaggcaagtacacctgcgtggccagcaacatctacggcaccgtgaacaacaccgtgaccctgagagtgatcttcaccagcggcgacatgggcgtgtactacatggtggtgtgcctggtggccttcaccatcgtgatggtgctgtag

SEQ ID NO: 19774 - DNA, 297 bp, Artificial Sequence
  Description of Artificial Sequence: Synthetic coding sequence
atggacagactgaagagccacctgaccgtgtgcttcctgcccagcgtgcccttcctgatcctggtgagcaccctggccaccgccaagagcgtgaccaacagcaccctgaacggcaccaacgtggtgctgggcagcgtgcccgtgatcatcgccagaaccgaccacatcatcgtgaaggagggcaacagcgccctgatcaactgcagcgtgtacggcatccccgacccccagttcaagtggtacaacagcatcggcaagctgctgaaggaggaggaggacgagaaggagagaggctag

SEQ ID NO: 19775 - DNA, 273 bp, Artificial Sequence
  Description of Artificial Sequence: Synthetic coding sequence
atggacagactgaagagccacctgaccgtgtgcttcctgcccagcgtgcccttcctgatcctggtgagcaccctggccaccgccaagagcgtgaccaacagcaccctgaacggcaccaacgtggtgctgggcagcgtgcccgtgatcatcgccagaaccgaccacatcatcgtgaaggagggcaacagcgccctgatcaactgcagcgtgtacggcatccccgacccccagttcaagtggtacaacagcatcggcaagctgctgaaggagtag

SEQ ID NO: 19776 - DNA, 222 bp, Artificial Sequence
  Description of Artificial Sequence: Synthetic coding sequence
atggacagactgaagagccacctgaccgtgtgcttcctgcccagcgtgcccttcctgatcctggtgagcaccctggccaccgccaagagcgtgaccaacagcaccctgaacggcaccaacgtggtgctgggcagcgtgcccgtgatcatcgccagaaccgaccacatcatcgtgaaggagggcaacagcgccctgatcaactgcagcgtgtacggcatctag

SEQ ID NO: 19777 - DNA, 474 bp, Artificial Sequence
  Description of Artificial Sequence: Synthetic coding sequence
atgcacgacagcggcctgctgaacatcaccaaggtgagcttcagcgacagaggcaagtacacctgcgtggccagcaacatctacggcaccgtgaacaacaccgtgaccctgagagtgatcttcaccagcggcgacatgggcgtgtactacatggtggtgtgcctggtggccttcaccatcgtgatggtgctgaacatcaccagactgtgcatgatgagcagccacctgaagaagaccgagaaggccatcaacgagttcttcagaaccgagggcgccgagaagctgcagaaggccttcgagatcgccaagagaatccccatcatcaccagcgccaagaccctggagctggccaaggtgacccagttcaagaccatggagttcgccagatacatcgaggagctggccagaagcgtgcccctgccccccctgatcatgaactgcagaaccatcatggaggagatcatggaggtgtag

SEQ ID NO: 19778 - DNA, 366 bp, Artificial Sequence
  Description of Artificial Sequence: Synthetic coding sequence
atgcccagcgacagacccttcaagcagagaagaagcttcgccgacagatgcaaggaggtgcagcagatcagagaccagcaccccagcaagatccccgtgatcatcgagagatacaagggcgagaagcagctgcccgtgctggacaagaccaagttcctggtgcccgaccacgtgaacatgagcgagctggtgaagatcatcagaagaagactgcagctgaaccccacccaggccttcttcctgctggtgaaccagcacagcatggtgagcgtgagcacccccatcgccgacatctacgagcaggagaaggacgaggacggcttcctgtacatggtgtacgccagccaggagaccttcggcttctag

SEQ ID NO: 19779 - DNA, 366 bp, Artificial Sequence; identical to SEQ ID NO: 19778
  Description of Artificial Sequence: Synthetic coding sequence

SEQ ID NO: 19780 - DNA, 378 bp, Artificial Sequence
  Description of Artificial Sequence: Synthetic coding sequence
atgaagatgagattcttcagcagcccctgcggcaaggccgccgtggaccccgccgacagatgcaaggaggtgcagcagatcagagaccagcaccccagcaagatccccgtgatcatcgagagatacaagggcgagaagcagctgcccgtgctggacaagaccaagttcctggtgcccgaccacgtgaacatgagcgagctggtgaagatcatcagaagaagactgcagctgaaccccacccaggccttcttcctgctggtgaaccagcacagcatggtgagcgtgagcacccccatcgccgacatctacgagcaggagaaggacgaggacggcttcctgtacatggtgtacgccagccaggagaccttcggcttctag

SEQ ID NO: 19781 - DNA, 378 bp, Artificial Sequence
  Description of Artificial Sequence: Synthetic coding sequence
atgcccagcgagaagaccttcaagcagagaagaaccttcgagcagagagtggaggacgtgagactgatcagagagcagcaccccaccaagatccccgtgatcatcgagagatacaagggcgagaagcagctgcccgtgctggacaagaccaagttcctggtgcccgaccacgtgaacatgagcgagctgatcaagatcatcagaagaagactgcagctgaacgccaaccaggccttcttcctgctggtgaacggccacagcatggtgagcgtgagcacccccatcagcgaggtgtacgagagcgagaaggacgaggacggcttcctgtacatggtgtacgccagccaggagaccttcggcatgaagctgagcgtgtag

SEQ ID NO: 19782 - DNA, 201 bp, Artificial Sequence
  Description of Artificial Sequence: Synthetic coding sequence
atgagcgagctgatcaagatcatcagaagaagactgcagctgaacgccaaccaggccttcttcctgctggtgaacggccacagcatggtgagcgtgagcacccccatcagcgaggtgtacgagagcgagaaggacgaggacggcttcctgtacatggtgtacgccagccaggagaccttcggcatgaagctgagcgtgtag

SEQ ID NO: 19783 - DNA, 444 bp, Artificial Sequence
  Description of Artificial Sequence: Synthetic coding sequence
atgccccccccccagaagatccccagcgtgagacccttcaagcagagaaagagcctggccatcagacaggaggaggtggccggcatcagagccaagttccccaacaagatccccgtggtggtggagagataccccagagagaccttcctgccccccctggacaagaccaagttcctggtgccccaggagctgaccatgacccagttcctgagcatcatcagaagcagaatggtgctgagagccaccgaggccttctacctgctggtgaacaacaagagcctggtgagcatgagcgccaccatggccgagatctacagagactacaaggacgaggacggcttcgtgtacatgacctacgccagccaggagaccttcggctgcctggagagcgccgcccccagagacggcagcagcctggaggacagaccctgcaaccccctgtag

SEQ ID NO: 19784 - DNA, 1968 bp, Artificial Sequence
  Description of Artificial Sequence: Synthetic coding sequence
atggccgagctgggcgccggcggcgacggccacagaggcggcgacggcgccgtgagaagcgagaccgcccccgacagctacaaggtgcaggacaagaagaacgccagcagcagacccgccagcgccatcagcggccagaacaacaaccacagcggcaacaagcccgaccccccccccgtgctgagagtggacgacagacagagactggccagagagagaagagaggagagagagaagcagctggaccccgacagaagaagcgtgagcaccatgaacctgagcaagtacgtggaccccgtgatcagcaagagactgagcagcagcagcgccaccctgctgaacagccccgacagagccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgtggtgatctag

SEQ ID NO: 19785 - DNA, 2250 bp, Artificial Sequence
  Description of Artificial Sequence: Synthetic coding sequence
atggccgagctgggcgccggcggcgacggccacagaggcggcgacggcgccgtgagaagcgagaccgcccccgacagctacaaggtgcaggacaagaagaacgccagcagcagacccgccagcgccatcagcggccagaacaacaaccacagcggcaacaagcccgaccccccccccgtgctgagagtggacgacagacagagactggccagagagagaagagaggagagagagaagcagctggccgccagagagatcgtgtggctggagagagaggagagagccagacagcactacgagaagcacctggaggagagaaagaagagactggaggagcagagacagaaggaggagagaagaagagccgccgtggaggagaagagaagacagagactggaggaggacaaggagagacacgaggccgtggtgagaagaaccatggagagaagccagaagcccaagcagaagcacaacagatggagctggggcggcagcctgcacggcagccccagcatccacagcgccgaccccgacagaagaagcgtgagcaccatgaacctgagcaagtacgtggaccccgtgatcagcaagagactgagcagcagcagcgccaccctgctgaacagccccgacagagccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgaggtgatctag

SEQ ID NO: 19786 - DNA, 1812 bp, Artificial Sequence
  Description of Artificial Sequence: Synthetic coding sequence
atggagagaagccagaagcccaagcagaagcacaacagatggagctggggcggcagcctgcacggcagccccagcatccacagcgccgaccccgacagaagaagcgtgagcaccatgaacctgagcaagtacgtggaccccgtgatcagcaagagactgagcagcagcagcgccaccctgctgaacagccccgacagagccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgaggtgatctag

SEQ ID NO: 19787 - DNA, 2205 bp, Artificial Sequence
  Description of Artificial Sequence: Synthetic coding sequence
atgcccggcagcgccaccgccctgagacacgagagactgaagaagaccaacgccagacccatccccctgggcctgttcaccatcaacgaggaggacgagcagcagaagaacggcaacagcagaagacccaaggcccccgacagctacaaggtgcaggacaagaagaacgccagcagcagacccgccagcgccatcagcggccagaacaacaaccacagcggcaacaagcccgaccccccccccgtgctgagagtggacgacagacagagactggccagagagagaagagaggagagagagaagcagctggccgccagagagatcgtgtggctggagagagaggagagagccagacagcactacgagaagcacctggaggagagaaagaagagactggaggagcagagacagaaggaggagagaagaagagccgccgtggaggagaagagaagacagagactggaggaggacaaggagagacacgaggccgtggtgagaagaaccatggagagaagccagaagcccaagcagaagcacaacagatggagctggggcggcagcctgcacggcagccccagcatccacagcgccgccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgaggtgatctag

SEQ ID NO: 19788 - DNA, 2316 bp, Artificial Sequence
  Description of Artificial Sequence: Synthetic coding sequence
atgcccggcagcgccaccgccctgagacacgagagactgaagaagaccaacgccagacccatccccctgggcctgttcaccatcaacgaggaggacgagcagcagaagaacggcaacagcagaagacccaaggcccccgacagctacaaggtgcaggacaagaagaacgccagcagcagacccgccagcgccatcagcggccagaacaacaaccacagcggcaacaagcccgaccccccccccgtgctgagagtggacgacagacagagactggccagagagagaagagaggagagagagaagcagctggccgccagagagatcgtgtggctggagagagaggagagagccagacagcactacgagaagcacctggaggagagaaagaagagactggaggagcagagacagaaggaggagagaagaagagccgccgtggaggagaagagaagacagagactggaggaggacaaggagagacacgaggccgtggtgagaagaaccatggagagaagccagaagcccaagcagaagcacaacagatggagctggggcggcagcctgcacggcagccccagcatccacagcgccgaccccgacagaagaagcgtgagcaccatgaacctgagcaagtacgtggaccccgtgatcagcaagagactgagcagcagcagcgccaccctgctgaacagccccgacagagccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgaggtgatctag

SEQ ID NO: 19789 - DNA, 2205 bp, Artificial Sequence
  Description of Artificial Sequence: Synthetic coding sequence
atggaggacaccaagctgtacagccccgacagctacaaggtgcaggacaagaagaacgccagcagcagacccgccagcgccatcagcggccagaacaacaaccacagcggcaacaagcccgaccccccccccgtgctgagagtggacgacagacagagactggccagagagagaagagaggagagagagaagcagctggccgccagagagatcgtgtggctggagagagaggagagagccagacagcactacgagaagcacctggaggagagaaagaagagactggaggagcagagacagaaggaggagagaagaagagccgccgtggaggagaagagaagacagagactggaggaggacaaggagagacacgaggccgtggtgagaagaaccatggagagaagccagaagcccaagcagaagcacaacagatggagctggggcggcagcctgcacggcagccccagcatccacagcgccgaccccgacagaagaagcgtgagcaccatgaacctgagcaagtacgtggaccccgtgatcagcaagagactgagcagcagcagcgccaccctgctgaacagccccgacagagccagaagactgcagctgagcccctgggagagcagcgtggtgaacagactgctgacccccacccacagcttcctggccagaagcaagagcaccgccgccctgagcggcgaggccgccagctgcagccccatcatcatgccctacaaggccgcccacagcagaaacagcatggacagacccaagctgttcgtgaccccccccgagggcagcagcagaagaagaatcatccacggcaccgccagctacaagaaggagagagagagagagaacgtgctgttcctgaccagcggcaccagaagagccgtgagccccagcaaccccaaggccagacagcccgccagaagcagactgtggctgcccagcaagagcctgccccacctgcccggcacccccagacccaccagcagcctgccccccggcagcgtgaaggccgcccccgcccaggtgagaccccccagccccggcaacatcagacccgtgaagagagaggtgaaggtggagcccgagaagaaggaccccgagaaggagccccagaaggtggccaacgagcccagcctgaagggcagagcccccctggtgaaggtggaggaggccaccgtggaggagagaacccccgccgagcccgaggtgggccccgccgcccccgccatggcccccgcccccgccagcgcccccgcccccgccagcgcccccgcccccgcccccgtgcccacccccgccatggtgagcgcccccagcagcaccgtgaacgccagcgccagcgtgaagaccagcgccggcaccaccgaccccgaggaggccaccagactgctggccgagaagagaagactggccagagagcagagagagaaggaggagagagagagaagagagcaggaggagctggagagacagaagagagaggagctggcccagagagtggccgaggagagaaccaccagaagagaggaggagagcagaagactggaggccgagcaggccagagagaaggaggagcagctgcagagacaggccgaggagagagccctgagagagagagaggaggccgagagagcccagagacagaaggaggaggaggccagagtgagagaggaggccgagagagtgagacaggagagagagaagcacttccagagagaggagcaggagagactggagagaaagaagagactggaggagatcatgaagagaaccagaagaaccgaggccaccgacaagaagaccagcgaccagagaaacggcgacatcgccaagggcgccctgaccggcggcaccgaggtgagcgccctgccctgcaccaccaacgcccccggcaacggcaagcccgtgggcagcccccacgtggtgaccagccaccagagcaaggtgaccgtggagagcacccccgacctggagaagcagcccaacgagaacggcgtgagcgtgcagaacgagaacttcgaggagatcatcaacctgcccatcggcagcaagcccagcagactggacgtgaccaacagcgagagccccgagatccccctgaaccccatcctggccttcgacgacgagggcaccctgggccccctgccccaggtggacggcgtgcagacccagcagaccgccgaggtgatctag

SEQ ID NO: 19790 - DNA, 3021 bp, Artificial Sequence
  Description of Artificial Sequence: Synthetic coding sequence
atgagcaacagcagaaacaacagagtgatggtggagggcgtgggcgccagagtggtgagaggccccgactggaagtggggcaagcaggacggcggcgagggccacgtgggcaccgtgagaagcttcgagagccccgaggaggtggtggtggtgtgggacaacggcaccgccgccaactacagatgcagcggcgcctacgacctgagaatcctggacagcgcccccaccggcatcaagcacgacggcaccatgtgcgacacctgcagacagcagcccatcatcggcatcagatggaagtgcgccgagtgcaccaactacgacctgtgcaccgtgtgctaccacggcgacaagcaccacctgagacacagattctacagaatcaccacccccggcagcgagagagtgctgctggagagcagaagaaagagcaagaagatcaccgccagaggcatcttcgccggcgccagagtggtgagaggcgtggactggcagtgggaggaccaggacggcggcaacggcagaagaggcaaggtgaccgagatccaggactggagcgccagcagcccccacagcgccgcctacgtgctgtgggacaacggcgccaagaacctgtacagagtgggcttcgagggcatgagcgacctgaagtgcgtgcaggacgccaagggcggcagcttctacagagaccactgccccgtgctgggcgagcagaacggcaacagaaaccccggcggcctgcagatcggcgacctggtgaacatcgacctggacctggagatcgtgcagagcctgcagcacggccacggcggctggaccgacggcatgttcgagaccctgaccaccaccggcaccgtgtgcggcatcgacgaggaccacgacatcgtggtgcagtaccccagcggcaacagatggaccttcaaccccgccgtgctgaccaaggccaacatcgtgagaagcggcgacgccgcccagggcgccgagggcggcaccagccagttccaggtgggcgacctggtgcaggtgtgctacgacctggagagaatcaagctgctgcagagaggccacggcgagtgggccgaggccatgctgcccaccctgggcaaggtgggcagagtgcagcagatctacagcgacagcgacctgaaggtggaggtgtgcggcaccagctggacctacaaccccgccgccgtgagcaaggtggccagcgccggcagcgccatcagcaacgccagcggcgagagactgagccagctgctgaagaagctgttcgagacccaggagagcggcgacctgaacgaggagctggtgaaggccgccgccaacggcgacgtggccaaggtggaggacctgctgaagagacccgacgtggacgtgaacggccagtgcgccggccacaccgccatgcaggccgccagccagaacggccacgtggacatcctgaagctgctgctgaagcagaacgtggacgtggaggccgaggacaaggacggcgacagagccgtgcaccacgccgccttcggcgacgagggcgccgtgatcgaggtgctgcacagaggcagcgccgacctgaacgccagaaacaagagaagacagacccccctgcacatcgccgtgaacaagggccacctgcaggtggtgaagaccctgctggacttcggctgccaccccagcctgcaggacagcgagggcgacacccccctgcacgacgccatcagcaagaagagagacgacatcctggccgtgctgctggaggccggcgccgacgtgaccatcaccaacaacaacggcttcaacgccctgcaccacgccgccctgagaggcaaccccagcgccatgagagtgctgctgagcaagctgcccagaccctggatcgtggacgagaagaaggacgacggctacaccgccctgcacctggccgccctgaacaaccacgtggaggtggccgagctgctggtgcaccagggcaacgccaacctggacatccagaacgtgaaccagcagaccgccctgcacctggccgtggagagacagcacacccagatcgtgagactgctggtgagagccggcgccaagctggacatccaggacaaggacggcgacacccccctgcacgaggccctgagacaccacaccctgagccagctgagacagctgcaggacatgcaggacgtgggcaaggtggacgccgcctgggagcccagcaagaacaccctgatcatgggcctgggcacccagggcgccgagaagaagagcgccgccagcatcgcctgcttcctggccgccaacggcgccgacctgagcatcagaaacaagaagggccagagccccctggacctgtgccccgaccccaacctgtgcaaggccctggccaagtgccacaaggagaaggtgagcggccaggtgggcagcagaagccccagcatgatcagcaacgacagcgagaccctggaggagtgcatggtgtgcagcgacatgaagagagacaccctgttcggcccctgcggccacatcgccacctgcagcctgtgcagccccagagtgaagaagtgcctgatctgcaaggagcaggtgcagagcagaaccaagatcgaggagtgcgtggtgtgcagcgacaagaaggccgccgtgctgttccagccctgcggccacatgtgcgcctgcgagaactgcgccaacctgatgaagaagtgcgtgcagtgcagagccgtggtggagagaagagtgcccttcatcatgtgctgcggcggcaagagcagcgaggacgccaccgacgacatcagcagcggcaacatccccgtgctgcagaaggacaaggacaacaccaacgtgaacgccgacgtgcagaagctgcagcagcagctgcaggacatcaaggagcagaccatgtgccccgtgtgcctggacagactgaagaacatgatcttcctgtgcggccacggcacctgccagctgtgcggcgacagaatgagcgagtgccccatctgcagaaaggccatcgagagaagaatcctgctgtactag

SEQ ID NO: 19791 - DNA, 750 bp, Artificial Sequence
  Description of Artificial Sequence: Synthetic coding sequence
atggccaagagcggcctgagacaggacccccagagcaccgccgccgccaccgtgctgaagagagccgtggagctggacagcgagagcagatacccccaggccctggtgtgctaccaggagggcatcgacctgctgctgcaggtgctgaagggcaccaaggacaacaccaagagatgcaacctgagagagaagatcagcaagtacatggacagagccgagaacatcaagaagtacctggaccaggagaaggaggacggcaagtaccacaagcagatcaagatcgaggagaacgccaccggcttcagctacgagagcctgttcagagagtacctgaacgagaccgtgaccgaggtgtggatcgaggacccctacatcagacacacccaccagctgtacaacttcctgagattctgcgagatgctgatcaagagaccctgcaaggtgaagaccatccacctgctgaccagcctggacgagggcatcgagcaggtgcagcagagcagaggcctgcaggagatcgaggagagcctgagaagccacggcgtgctgctggaggtgcagtacagcagcagcatccacgacagagagatcagattcaacaacggctggatgatcaagatcggcagaggcctggactacttcaagaagccccagagcagattcagcctgggctactgcgacttcgacctgagaccctgccacgagaccaccgtggacatcttccacaagaagcacaccaagaacatctag

SEQ ID NO: 19792 - DNA, 696 bp, Artificial Sequence
  Description of Artificial Sequence: Synthetic coding sequence
ctgaagagagccgtggagctggacagcgagagcagatacccccaggccctggtgtgctaccaggagggcatcgacctgctgctgcaggtgctgaagggcaccaaggacaacaccaagagatgcaacctgagagagaagatcagcaagtacatggacagagccgagaacatcaagaagtacctggaccaggagaaggaggacggcaagtaccacaagcagatcaagatcgaggagaacgccaccggcttcagctacgagagcctgttcagagagtacctgaacgagaccgtgaccgaggtgtggatcgaggacccctacatcagacacacccaccagctgtacaacttcctgagattctgcgagatgctgatcaagagaccctgcaaggtgaagaccatccacctgctgaccagcctggacgagggcatcgagcaggtgcagcagagcagaggcctgcaggagatcgaggagagcctgagaagccacggcgtgctgctggaggtgcagtacagcagcagcatccacgacagagagatcagattcaacaacggctggatgatcaagatcggcagaggcctggactacttcaagaagccccagagcagattcagcctgggctactgcgacttcgacctgagaccctgccacgagaccaccgtggacatcttccacaagaagcacaccaagaacatctag

SEQ ID NO: 19793 - DNA, 1431 bp, Artificial Sequence
  Description of Artificial Sequence: Synthetic coding sequence
atgttcagactgaacagcctgagcgccctggccgagctggccgtgggcagcagatggtaccacggcggcagccagcccatccagatcagaagaagactgatgatggtggccttcctgggcgccagcgccgtgaccgccagcaccggcctgctgtggaagagagcccacgccgagagccccccctgcgtggacaacctgaagagcgacatcggcgacaagggcaagaacaaggacgagggcgacgtgtgcaaccacgagaagaagaccgccgacctggccccccaccccgaggagaagaagaagaagagaagcggcttcagagacagaaaggtgatggagtacgagaacagaatcagagcctacagcacccccgacaagatcttcagatacttcgccaccctgaaggtgatcagcgagcccggcgaggccgaggtgttcatgacccccgaggacttcgtgagaagcatcacccccaacgagaagcagcccgagcacctgggcctggaccagtacatcatcaagagattcgacggcaagaagatcagccaggagagagagaagttcgccgacgagggcagcatcttctacaccctgggcgagtgcggcctgatcagcttcagcgactacatcttcctgaccaccgtgctgagcaccccccagagaaacttcgagatcgccttcaagatgttcgacctgaacggcgacggcgaggtggacatggaggagttcgagcaggtgcagagcatcatcagaagccagaccagcatgggcatgagacacagagacagacccaccaccggcaacaccctgaagagcggcctgtgcagcgccctgaccacctacttcttcggcgccgacctgaagggcaagctgaccatcaagaacttcctggagttccagagaaagctgcagcacgacgtgctgaagctggagttcgagagacacgaccccgtggacggcagaatcaccgagagacagttcggcggcatgctgctggcctacagcggcgtgcagagcaagaagctgaccgccatgcagagacagctgaagaagcacttcaaggagggcaagggcctgaccttccaggaggtggagaacttcttcaccttcctgaagaacatcaacgacgtggacaccgccctgagcttctaccacatggccggcgccagcctggacaaggtgaccatgcagcaggtggccagaaccgtggccaaggtggagctgagcgaccacgtgtgcgacgtggtgttcgccctgttcgactgcgacggcaacggcgagctgagcaacaaggagttcgtgagcatcatgaagcagagactgatgagaggcctggagaagcccaaggacatgggcttcaccagactgatgcaggccatgtggaagtgcgcccaggagaccgcctgggacttcgccctgcccaagcagtag

SEQ ID NO: 19794 - DNA, 1437 bp, Artificial Sequence
  Description of Artificial Sequence: Synthetic coding sequence
atgttcagactgaacagcctgagcgccctggccgagctggccgtgggcagcagatggtaccacggcggcagccagcccatccagatcagaagaagactgatgatggtggccttcctgggcgccagcgccgtgaccgccagcaccggcctgctgtggaagagagcccacgccgagagccccccctgcgtggacaacctgaagagcgacatcggcgacaagggcaagaacaaggacgagggcgacgtgtgcaaccacgagaagaagaccgccgacctggccccccaccccgaggagaagaagaagaagagaagcggcttcagagacagaaaggtgatggagtacgagaacagaatcagagcctacagcacccccgacaagatcttcagatacttcgccaccctgaaggtgatcagcgagcccggcgaggccgaggtgttcatgacccccgaggacttcgtgagaagcatcacccccaacgagaagcagcccgagcacctgggcctggaccagtacatcatcaagagattcgacggcaagaacaagaagatcagccaggagagagagaagttcgccgacgagggcagcatcttctacaccctgggcgagtgcggcctgatcagcttcagcgactacatcttcctgaccaccgtgctgagcaccccccagagaaacttcgagatcgccttcaagatgttcgacctgaacggcgacggcgaggtggacatggaggagttcgagcaggccatcagcatcatcagaagccagaccagcatgggcatgagacacagagacagacccaccaccggcaacaccctgaagagcggcctgtgcagcgccctgaccacctacttcttcggcgccgacctgaagggcaagctgaccatcaagaacttcctggagttccagagaaagctgcagcacgacgtgctgaagctggagttcgagagacacgaccccgtggacggcagaatcaccgagagacagttcggcggcatgctgctggcctacagcggcgtgcagagcaagaagctgaccgccatgcagagacagctgaagaagcacttcaaggagggcaagggcctgaccttccaggaggtggagaacttcttcaccttcctgaagaacatcaacgacgtggacaccgccctgagcttctaccacatggccggcgccagcctggacaaggtgaccatgcagcaggtggccagaaccgtggccaaggtggagctgagcgaccacgtgtgcgacgtggtgttcgccctgttcgactgcgacggcaacggcgagctgagcaacaaggagttcgtgagcatcatgaagcagagactgatgagaggcctggagaagcccaaggacatgggcttcaccagactgatgcaggccatgtggaagtgcgcccaggagaccgcctgggacttcgccctgcccaagcagtag

SEQ ID NO: 19795 - DNA, 837 bp, Artificial Sequence
  Description of Artificial Sequence: Synthetic coding sequence
atggtgagcctgaaggccaagctgaaccacctgagacagagcatgctgaagcagaaggccccccagagaaacttcgagatcgccttcaagatgttcgacctgaacggcgacggcgaggtggacatggaggagttcgagcaggtgcagagcatcatcagaagccagaccagcatgggcatgagacacagagacagacccaccaccggcaacaccctgaagagcggcctgtgcagcgccctgaccacctacttcttcggcgccgacctgaagggcaagctgaccatcaagaacttcctggagttccagagaaagctgcagcacgacgtgctgaagctggagttcgagagacacgaccccgtggacggcagaatcaccgagagacagttcggcggcatgctgctggcctacagcggcgtgcagagcaagaagctgaccgccatgcagagacagctgaagaagcacttcaaggagggcaagggcctgaccttccaggaggtggagaacttcttcaccttcctgaagaacatcaacgacgtggacaccgccctgagcttctaccacatggccggcgccagcctggacaaggtgaccatgcagcaggtggccagaaccgtggccaaggtggagctgagcgaccacgtgtgcgacgtggtgttcgccctgttcgactgcgacggcaacggcgagctgagcaacaaggagttcgtgagcatcatgaagcagagactgatgagaggcctggagaagcccaaggacatgggcttcaccagactgatgcaggccatgtggaagtgcgcccaggagaccgcctgggacttcgccctgcccaagcagtag

SEQ ID NO: 19796 - DNA, 1431 bp, Artificial Sequence
  Description of Artificial Sequence: Synthetic coding sequence
atgttcagactgaacagcctgagcgccctggccgagctggccgtgggcagcagatggtaccacggcggcagccagcccatccagatcagaagaagactgatgatggtggccttcctgggcgccagcgccgtgaccgccagcaccggcctgctgtggaagagagcccacgccgagagccccccctgcgtggacaacctgaagagcgacatcggcgacaagggcaagaacaaggacgagggcgacgtgtgcaaccacgagaagaagaccgccgacctggccccccaccccgaggagaagaagaagaagagaagcggcttcagagacagaaaggtgatggagtacgagaacagaatcagagcctacagcacccccgacaagatcttcagatacttcgccaccctgaaggtgatcagcgagcccggcgaggccgaggtgttcatgacccccgaggacttcgtgagaagcatcacccccaacgagaagcagcccgagcacctgggcctggaccagtacatcatcaagagattcgacggcaagaagatcagccaggagagagagaagttcgccgacgagggcagcatcttctacaccctgggcgagtgcggcctgatcagcttcagcgactacatcttcctgaccaccgtgctgagcaccccccagagaaacttcgagatcgccttcaagatgttcgacctgaacggcgacggcgaggtggacatggaggagttcgagcaggccatcagcatcatcagaagccagaccagcatgggcatgagacacagagacagacccaccaccggcaacaccctgaagagcggcctgtgcagcgccctgaccacctacttcttcggcgccgacctgaagggcaagctgaccatcaagaacttcctggagttccagagaaagctgcagcacgacgtgctgaagctggagttcgagagacacgaccccgtggacggcagaatcaccgagagacagttcggcggcatgctgctggcctacagcggcgtgcagagcaagaagctgaccgccatgcagagacagctgaagaagcacttcaaggagggcaagggcctgaccttccaggaggtggagaacttcttcaccttcctgaagaacatcaacgacgtggacaccgccctgagcttctaccacatggccggcgccagcctggacaaggtgaccatgcagcaggtggccagaaccgtggccaaggtggagctgagcgaccacgtgtgcgacgtggtgttcgccctgttcgactgcgacggcaacggcgagctgagcaacaaggagttcgtgagcatcatgaagcagagactgatgagaggcctggagaagcccaaggacatgggcttcaccagactgatgcaggccatgtggaagtgcgcccaggagaccgcctgggacttcgccctgcccaagcagtag

SEQ ID NO: 19797 - DNA, 837 bp, Artificial Sequence
  Description of Artificial Sequence: Synthetic coding sequence
atgaagagaatctacacctacagaagagccaaggagatcttcaaggacacccccaaggccccccagagaaacttcgagatcgccttcaagatgttcgacctgaacggcgacggcgaggtggacatggaggagttcgagcaggtgcagagcatcatcagaagccagaccagcatgggcatgagacacagagacagacccaccaccggcaacaccctgaagagcggcctgtgcagcgccctgaccacctacttcttcggcgccgacctgaagggcaagctgaccatcaagaacttcctggagttccagagaaagctgcagcacgacgtgctgaagctggagttcgagagacacgaccccgtggacggcagaatcaccgagagacagttcggcggcatgctgctggcctacagcggcgtgcagagcaagaagctgaccgccatgcagagacagctgaagaagcacttcaaggagggcaagggcctgaccttccaggaggtggagaacttcttcaccttcctgaagaacatcaacgacgtggacaccgccctgagcttctaccacatggccggcgccagcctggacaaggtgaccatgcagcaggtggccagaaccgtggccaaggtggagctgagcgaccacgtgtgcgacgtggtgttcgccctgttcgactgcgacggcaacggcgagctgagcaacaaggagttcgtgagcatcatgaagcagagactgatgagaggcctggagaagcccaaggacatgggcttcaccagactgatgcaggccatgtggaagtgcgcccaggagaccgcctgggacttcgccctgcccaagcagtag

SEQ ID NO: 19798 - DNA, 1092 bp, Artificial Sequence
  Description of Artificial Sequence: Synthetic coding sequence
atggacggcggcagcggcggcctgggcagcggcgacaacgcccccaccaccgaggccctgttcgtggccctgggcgccggcgtgaccgccctgagccaccccctgctgtacgtgaagctgctgatccaggtgggccacgagcccatgccccccaccctgggcaccaacgtgctgggcagaaaggtgctgtacctgcccagcttcttcacctacgccaagtacatcgtgcaggtggacggcaagatcggcctgttcagaggcctgagccccagactgatgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcagggccagctgttcagaggcagcagctgcttcagcgccggctgccaccaggaccacgccctgccctggagcaacctgaaccacctgaagaacaccgtgagcacctggcccccctgggtgagacccgaccacctgggcacccccgccagaagactgcagcccaacaacaaccagatgtgcagcagccccgccggcctgcagttccacatctgccacgtgagcgtgcagatgtggggctag

SEQ ID NO: 19799 - DNA, 1074 bp, Artificial Sequence
  Description of Artificial Sequence: Synthetic coding sequence
atggacggcggcagcggcggcctgggcagcggcgacaacgcccccaccaccgaggccctgttcgtggccctgggcgccggcgtgaccgccctgagccaccccctgctgtacgtgaagctgctgatccaggtgggccacgagcccatgccccccaccctgggcaccaacgtgctgggcagaaaggtgctgtacctgcccagcttcttcacctacgccaagtacatcgtgcaggtggacggcaagatcggcctgttcagaggcctgagccccagactgatgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcgtgatccagcccggccccggccaccccgagctgtaccaggtgagagacggcgactgcagcgagcacgccgacctgcccctgcccgccagctggagaccccacggctgcgagcagctgagagccgccagctgggccccccccctgctgcccagcgtgcagatcctggacagcctgctggaggtgcccgagtgcgccgcctgcttcagcgccggctgccaccaggaccacgccctgccctggagcaacctgaaccacctgaagaacaccgtgagcacctggcccccctgggtgagacccgaccacctgggcacccccgccagaagactgcagcccaacaacaaccagatgtgcagcagccccgccggcctgcagttccacatctgccacgtgagcgtgcagatgtggggctag

SEQ ID NO: 19800 - DNA, 561 bp, Artificial Sequence
  Description of Artificial Sequence: Synthetic coding sequence
gccgtgtgcgtgccccacgtgggccccccccccgcctgccacctgaacgccctgcacggccccgtgtgcggcaccggcggccaggtgcagctgagctgcggcgccaccatccccggcagcagcgccgccatggtgccccacttcggcgtgatcaacggcaagctggcccacagccccagactgatcatgagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtggccagcagcagcgaggcccccgcctgcttcagcgccggctgccaccaggaccacgccctgccctag

SEQ ID NO: 19801 - DNA, 1119 bp, Artificial Sequence
  Description of Artificial Sequence: Synthetic coding sequence
atgggcgccagcgaccccgaggtggccccctgggccagaggcggcgccgccggcatggccggcgccggcgccggcgccggcgccagaggcggcgccgccgccggcgtggaggccagagccagagaccccccccccgcccacagagcccaccccagacaccccagacccgccgcccagcccagcgccagaagaatggacggcggcagcggcggcctgggcagcggcgacaacgcccccaccaccgaggccctgttcgtggccctgggcgccggcgtgaccgccctgagccaccccctgctgtacgtgaagctgctgatccaggtgggccacgagcccatgccccccaccctgggcaccaacgtgctgggcagaaaggtgctgtacctgcccagcttcttcacctacgccaagtacatcgtgcaggtggacggcaagatcggcctgttcagaggcctgagccccagactgatgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcagggccagctgttcagaggcagcagcctgctgttcagaagagtgagcagcggcagctgcttcgccctggagtag

SEQ ID NO: 19802 - DNA, 1170 bp, Artificial Sequence
  Description of Artificial Sequence: Synthetic coding sequence
atgggcgccagcgaccccgaggtggccccctgggccagaggcggcgccgccggcatggccggcgccggcgccggcgccggcgccagaggcggcgccgccgccggcgtggaggccagagccagagaccccccccccgcccacagagcccaccccagacaccccagacccgccgcccagcccagcgccagaagaatggacggcggcagcggcggcctgggcagcggcgacaacgcccccaccaccgaggccctgttcgtggccctgggcgccggcgtgaccgccctgagccaccccctgctgtacgtgaagctgctgatccaggtgggccacgagcccatgccccccaccctgggcaccaacgtgctgggcagaaaggtgctgtacctgcccagcttcttcacctacgccaagtacatcgtgcaggtggacggcaagatcggcctgttcagaggcctgagccccagactgatgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcgtgagcgacacccccggcggcctgggcaacgaccagaaccccggcagccagttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcagggccagctgttcagaggcagcagcctgctgttcagaagagtgagcagcggcagctgcttcgccctggagtag

SEQ ID NO: 19803 - DNA, 606 bp, Artificial Sequence
  Description of Artificial Sequence: Synthetic coding sequence
tgagccgtgtgcgtgccccacgtgggccccccccccgcctgccacctgaacgccctgcacggccccgtgtgcggcaccggcggccaggtgcagctgagctgcggcgccaccatccccggcagcagcgccgccatggtgccccacttcggcgtgatcaacggcaagctggcccacagccccagactgatcatgagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcagggccagctgttcagaggcagcagcctgctgttcagaagagtgagcagcggcagctgcttcgcctag

SEQ ID NO: 19804 - DNA, 1185 bp, Artificial Sequence
  Description of Artificial Sequence: Synthetic coding sequence
gccggcatggccggcgccggcgccggcgccggcgccagaggcggcgccgccgccggcgtggaggccagagccagagaccccccccccgcccacagagcccaccccagacaccccagacccgccgcccagcccagcgccagaagaatggacggcggcagcggcggcctgggcagcggcgacaacgcccccaccaccgaggccctgttcgtggccctgggcgccggcgtgaccgccctgagccaccccctgctgtacgtgaagctgctgatccaggtgggccacgagcccatgccccccaccctgggcaccaacgtgctgggcagaaaggtgctgtacctgcccagcttcttcacctacgccaagtacatcgtgcaggtggacggcaagatcggcctgttcagaggcctgagccccagactgatgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcaggtgagcaagcactggaccgccgaggccttccccgtgctgtgctacatcctgcagctgaagtggttctgcggctgcttcatcgcctgcaaggacaagtggttccacggcatccagtactgcgaggagatcctgggcatctacaaggccttcaagttcagcagctacatcatcagcgagagaatctag

SEQ ID NO: 19805 - DNA, 765 bp, Artificial Sequence
  Description of Artificial Sequence: Synthetic coding sequence
atgagcaacgccctgagcaccgtgaccagaggcagcatgaagaaggtgttcccccccgacgagatcgagcaggtgagcaacaaggacgacatgaagaccagcctgaagaaggtggtgaaggagaccagctacgagatgatgatgcagtgcgtgagcagaatgctggcccaccccctgcacgtgatcagcatgagatgcatggtgcagttcgtgggcagagaggccaagtacagcggcgtgctgagcagcatcggcaagatcttcaaggaggagggcctgctgggcttcttcgtgggcctgatcccccacctgctgggcgacgtggtgttcctgtggggctgcaacctgctggcccacttcatcaacgcctacctggtggacgacagcttcagccaggccctggccatcagaagctacaccaagttcgtgatgggcatcgccgtgagcatgctgacctaccccttcctgctggtgggcgacctgatggccgtgaacaactgcggcctgcaggccggcctgcccccctacagccccgtgttcaagagctggatccactgctggaagtacctgagcgtgcaggtgagcaagcactggaccgccgaggccttccccgtgctgtgctacatcctgcagctgaagtggttctgcggctgcttcatcgcctgcaaggacaagtggttccacggcatccagtactgcgaggagatcctgggcatctacaaggccttcaagttcagcagctacatcatcagcgagagaatctag

SEQ ID NO: 19806 - DNA, 894 bp, Artificial Sequence
  Description of Artificial Sequence: Synthetic coding sequence
atgatggacagcgaggcccacgagaagagaccccccatcctgaccagcagcaagcaggacatcagcccccacatcaccaacgtgggcgagatgaagcactacctgtgcggctgctgcgccgccttcaacaacgtggccatcaccttccccatccagaaggtgctgttcagacagcagctgtacggcatcaagaccagagacgccatcctgcagctgagaagagacggcttcagaaacctgtacagaggcatcctgccccccctgatgcagaagaccaccaccctggccctgatgttcggcctgtacgaggacctgagctgcctgctgcacaagcacgtgagcgcccccgagttcgccaccagcggcgtggccgccgtgctggccggcaccaccgaggccatcttcacccccctggagagagtgcagaccctgctgcaggaccacaagcaccacgacaagttcaccaacacctaccaggccttcaaggccctgaagtgccacggcatcggcgagtactacagaggcctggtgcccatcctgttcagaaacggcctgagcaacgtgctgttcttcggcctgagaggccccatcaaggagcacctgcccaccgccaccacccacagcgcccacctggtgaacgacttcatctgcggcggcctgctgggcgccatgctgggcttcctgttcttccccatcaacgtggtgaagaccagaatccagagccagatcggcggcgagttccagagcttccccaaggtgttccagaagatctggctggagagagacagaaagctgatcaacctgttcagaggcgcccacctgaactaccacagaagcctgatcagctggggcatcatcaacgccacctacgagttcctgctgaaggtgatctag

SEQ ID NO: 19807 - DNA, 894 bp, Artificial Sequence; identical to SEQ ID NO: 19806
  Description of Artificial Sequence: Synthetic coding sequence

SEQ ID NO: 19808 - DNA, 894 bp, Artificial Sequence; identical to SEQ ID NO: 19806
  Description of Artificial Sequence: Synthetic coding sequence

SEQ ID NO: 19809 - DNA, 924 bp, Artificial Sequence
  Description of Artificial Sequence: Synthetic coding sequence
atgcccttcatgagaaagatcctgagcaacatgatcgacagcgaggcccacgagaagagaccccccatcctgaccagcagcaagcaggacatcagcccccacatcaccaacgtgggcgagatgaagcactacctgtgcggctgctgcgccgccttcaacaacgtggccatcacctaccccatccagaaggtgctgttcagacagcagctgtacggcatcaagaccagagacgccgtgctgcagctgagaagagacggcttcagaaacctgtacagaggcatcctgccccccctgatgcagaagaccaccaccctggccctgatgttcggcctgtacgaggacctgagctgcctgctgagaaagcacgtgagagcccccgagttcgccacccacggcgtggccgccgtgctggccggcaccgccgaggccatcttcacccccctggagagagtgcagaccctgctgcagaaccacaagcaccacgacaagttcaccaacacctaccaggccttcaaggccctgaagtgccacggcatcggcgagtactacagaggcctggtgcccatcctgttcagaaacggcctgagcaacgtgctgttcttcggcctgagaggccccatcaaggagcacctgcccaccgccaccacccacagcgcccacctggtgaacgacttcatcggcggcggcctgctgggcgccatgctgggcttcctgtgcttccccatcaacgtggtgaagaccagactgcagagccagatcggcggcgagttccagagcttccccaaggtgttccagaagatctggctggagagagacagaaagctgatcaacctgttcagaggcgcccacctgaactaccacagaagcctgatcagctggggcatcatcaacgccacctacgagttcctgctgaagttcatctag

SEQ ID NO: 19810 - DNA, 894 bp, Artificial Sequence
  Description of Artificial Sequence: Synthetic coding sequence
atgatcgacagcgaggcccacgagaagagaccccccatcctgaccagcagcaagcaggacatcagcccccacatcaccaacgtgggcgagatgaagcactacctgtgcggctgctgcgccgccttcaacaacgtggccatcacctaccccatccagaaggtgctgttcagacagcagctgtacggcatcaagaccagagacgccgtgctgcagctgagaagagacggcttcagaaacctgtacagaggcatcctgccccccctgatgcagaagaccaccaccctggccctgatgttcggcctgtacgaggacctgagctgcctgctgagaaagcacgtgagagcccccgagttcgccacccacggcgtggccgccgtgctggccggcaccgccgaggccatcttcacccccctggagagagtgcagaccctgctgcagaaccacaagcaccacgacaagttcaccaacacctaccaggccttcaaggccctgaagtgccacggcatcggcgagtactacagaggcctggtgcccatcctgttcagaaacggcctgagcaacgtgctgttcttcggcctgagaggccccatcaaggagcacctgcccaccgccaccacccacagcgcccacctggtgaacgacttcatcggcggcggcctgctgggcgccatgctgggcttcctgtgcttccccatcaacgtggtgaagaccagactgcagagccagatcggcggcgagttccagagcttccccaaggtgttccagaagatctggctggagagagacagaaagctgatcaacctgttcagaggcgcccacctgaactaccacagaagcctgatcagctggggcatcatcaacgccacctacgagttcctgctgaagttcatctag

SEQ ID NO: 19811 - DNA, 924 bp, Artificial Sequence
  Description of Artificial Sequence: Synthetic coding sequence
atgggcgagcagaaccacagccccggcaaggagctgcagcacagaaccagagccgaggcccccggcaagaagagctggcacagccaggcctacgccctgggcgccgtgagcaacttcatgagcaccttcctgaccttccccatctacaaggtggtgttcagacagcagatccacgccatggccgtgagcgaggccgtgagacagctgtggcacgagggcccccagtacttctacagaggcatctacccccccctgctgagcaagaccctgcagggcaccctgctgttcggcacctacgacagcctgctgtgcttcctgagccccgtgggcccccacaccctgggccacagatgggccgccggcctgatgagcggcgtggtggaggccgtggccctgagccccttcgagagagtgcagaacgtgctgcaggacggcagaaagcaggccagattccccagcaccttcagcatcctgaaggagttcaacagctacggcctgtggggcagactgagcctgggctactacagaggcttctggcccgtgctggccagaaacagcctgggcagcgccctgtacttcagcttcaaggaccccatccaggacggcctggccgagcagggcctgccccactgggtgcccgccctggtgagcggcagcgtgaacggcaccatcacctgcctggtgctgtaccccctgatcgtgctggtggccaacatgcagagccacatcggctggcagaacatgcccagcctgtgggccagcgcccaggacgtgtggaacaccagaggcagaaagctgctgctgatctacagaggcggcagcctggtgatcctgagaagcagcgtgacctggggcctgaccaccgccatccacgacttcctgcagagaaagagccacagcagaaaggagctgaagaccgactag

SEQ ID NO: 19812 - DNA, 876 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaacggccagctggtgagaaacgacagcctggtgacccccagcccccagcaggccagagtgtgccccccccacatgctgcccgaggacggcgccaacctgagcagcgccagaggcatcctgagcctgatccagagcagcaccagaagagcctaccagcagatcctggacgtgctggacgagaacagaagacccgtgctgagaggcggcagcgccgccgccaccagcaacccccaccacgacaacgtgagatacggcatcagcaacatcgacaccaccatcgagggcaccagcgacgacctgaccgtggtggacgccgccagcctgagaagacagatcatcaagctgaacagaagactgcagctgctggaggaggagaacaaggagagagccaagagagagatggtgatgtacagcatcaccgtggccttctggctgctgaacagctggctgtggttcagaagatag

SEQ ID NO: 19813 - DNA, 732 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaacggccagctggtgagaaacgacagcctgtggcacagaagcgacagcgcccccagaaacaagatcagcagattccaggcccccatcagcgcccccgagtacacctacggcatcagcaacatcgacaccaccatcgagggcaccagcgacgacctgaccgtggtggacgccgccagcctgagaagacagatcatcaagctgaacagaagactgcagctgctggaggaggagaacaaggagagagccaagagagagatggtgatgtacagcatcaccgtggccttctggctgctgaacagctggctgtggttcagaagatag

SEQ ID NO: 19814 - DNA, 717 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaacggccagctggtgagaaacgacagcctgcccgtgctgagaggcggcagcgccgccgccaccagcaacccccaccacgacaacgtgagatacggcatcagcaacatcgacaccaccatcgagggcaccagcgacgacctgaccgtggtggacgccgccagcctgagaagacagatcatcaagctgaacagaagactgcagctgctggaggaggagaacaaggagagagccaagagagagatggtgatgtacagcatcaccgtggccttctggctgctgaacagctggctgtggttcagaagatag

SEQ ID NO: 19815 - DNA, 1029 bp, Artificial Sequence
  Description of Artificial Sequence: Synthetic coding sequence
atgagcaagggcaccagcagcgacaccagcctgggcagagtgagcagagccgccttccccagccccaccgccgccgagatggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaacggccagctggtgagaaacgacagcctgtggcacagaagcgacagcgcccccagaaacaagatcagcagattccaggcccccatcagcgcccccgagtacaccgtgacccccagcccccagcaggccagagtgtgccccccccacatgctgcccgaggacggcgccaacctgagcagcgccagaggcatcctgagcctgatccagagcagcaccagaagagcctaccagcagatcctggacgtgctggacgagaacagaagacccgtgctgagaggcggcagcgccgccgccaccagcaacccccaccacgacaacgtgagatacggcatcagcaacatcgacaccaccatcgagggcaccagcgacgacctgaccgtggtggacgccgccagcctgagaagacagatcatcaagctgaacagaagactgcagctgctggaggaggagaacaaggagagagccaagagagagatggtgatgtacagcatcaccgtggccttctggctgctgaacagctggctgtggttcagaagatag

SEQ ID NO: 19816 - DNA, 657 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaacggccagctggtgagaaacgacagcctgtacggcatcagcaacatcgacaccaccatcgagggcaccagcgacgacctgaccgtggtggacgccgccagcctgagaagacagatcatcaagctgaacagaagactgcagctgctggaggaggagaacaaggagagagccaagagagagatggtgatgtacagcatcaccgtggccttctggctgctgaacagctggctgtggttcagaagatag

SEQ ID NO: 19817 - DNA, 1029 bp, Artificial Sequence; identical to SEQ ID NO: 19815
  Description of Artificial Sequence: Synthetic coding sequence

SEQ ID NO: 19818 - DNA, 657 bp, Artificial Sequence; identical to SEQ ID NO: 19816
  Description of Artificial Sequence: Synthetic coding sequence

SEQ ID NO: 19819 - DNA, 717 bp, Artificial Sequence; identical to SEQ ID NO: 19814
  Description of Artificial Sequence: Synthetic coding sequence

SEQ ID NO: 19820 - DNA, 183 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggcctag

SEQ ID NO: 19821 - DNA, 99 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggcccccccctag

SEQ ID NO: 19822 - DNA, 105 bp, Artificial Sequence
  Description of Artificial Sequence: Synthetic coding sequence
atgagcaagggcaccagcagcgacaccagcctgggcagagtgagcagagccgccttccccagccccaccgccgccgagatggccgagatcagcagaatccagtag

SEQ ID NO: 19823 - DNA, 216 bp, Artificial Sequence
  Description of Artificial Sequence: Synthetic coding sequence
atgagcaagggcaccagcagcgacaccagcctgggcagagtgagcagagccgccttccccagccccaccgccgccgagatggccgagatcagcagaatccagtacgagatggagtacaccgagggcatcagccagagaatgagagtgcccgagaagctgaaggtggccccccccaacgccgacctggagcagggcttccaggagggcgtgccctag

SEQ ID NO: 19824 - DNA, 417 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcaggtgcccgagagaatcgtggtggccggcaacaacgaggacgtgagcttcagcagacccgccgacctggacctgatccagagcacccccttcaagcccctggccctgaagaccccccccagagtgctgaccctgagcgagagacccctggacttcctggacctggagagaccccccaccaccccccagaacgaggagatcagagccgtgggcagactgaagagagagagaagcatgagcgagaacgccgtgagacagaactag

SEQ ID NO: 19825 - DNA, 159 bp, Artificial Sequence
  Description of Artificial Sequence: Synthetic coding sequence
atggccgagatcagcagaatccagtacgagatggagtacaccgagggcatcagccagagaatgagagtgcccgagaagctgaaggtggccccccccaacgccgacctggagcagggcttccaggagggcgtgcccaacgccagcgtgatcatgcagtag

SEQ ID NO: 19826 - DNA, 501 bp, Artificial Sequence
  Description of Artificial Sequence: Synthetic coding sequence
atgagcgagccccagcccagaggcgccgagagagacctgtacagagacacctgggtgagatacctgggctacgccaacgaggtgggcgaggccttcagaagcctggtgcccgccgccgtggtgtggctgagctacggcgtggccagcagctacgtgctggccgacgccatcgacaagggcaagaaggccggcgaggtgcccagccccgaggccggcagaagcgccagagtgaccgtggccgtggtggacaccttcgtgtggcaggccctggccagcgtggccatccccggcttcaccatcaacagagtgtgcgccgccagcctgtacgtgctgggcaccgccaccagatggcccctggccgtgagaaagtggaccaccaccgccctgggcctgctgaccatccccatcatcatccaccccatcgacagaagcgtggacttcctgctggacagcagcctgagaaagctgtaccccaccgtgggcaagcccagcagcagctag

SEQ ID NO: 19827 - DNA, 408 bp, Artificial Sequence
  Description of Artificial Sequence: Synthetic coding sequence
atgagcgagccccagcccagaggcgccgagagagacctgtacagagacacctgggtgagatacctgggctacgccaacgaggtgggcgaggccttcagaagcctggtgcccgccgccgtggtgtggctgagctacggcgtggccagcagctacgtgctggccgacgccatcgacaagggcaagaaggccggcgaggtgggcggcttcccccccggcctgcagcccgcccaggccctgcccaacagcggcgaggcccagctgctgctgatcatcctgtggtacctggcctgcgccagcgccagctgcttcatgagcaccagctacagctgccagggcatgtggacccccggcagcctggtgagcaaggaccccggcacctgggtgggcctgagctggaccgaggcctag

SEQ ID NO: 19828 - DNA, 1002 bp, Artificial Sequence
  Description of Artificial Sequence: Synthetic coding sequence
atgctgggctggatcaagagactgatcagaatggtgttccagcaggtgggcgtgagcatgcagagcgtgctgtggagcagaaagccctacggcagcagcagaagcatcgtgagaaagatcggcaccaacctgagcctgatccagtgccccagagtgcagttccagatcaacagccacgccaccgagtggagccccagccaccccggcgaggacgccgtggccagcttcgccgacgtgggctgggtggccaaggaggagggcgagtgcagcgccagactgagaaccgaggtgagaagcagaccccccctgcaggacgacctgctgttcttcgagaaggcccccagcagacagatcagcctgcccgacctgagccaggaggagccccagctgaagacccccgccctggccaacgaggaggccctgcagaagatctgcgccctggagaacgagctggccgccctgagagcccagatcgccaagatcgtgacccagcaggagcagcagaacctgaccgccggcgacctggacagcaccaccttcggcaccatccccccccaccccccccccccccccccccccctgcccccccccgccctgggcctgcaccagagcaccagcgccgtggacctgatcaaggagagaagagagaagagagccaacgccggcaagaccctggtgaagaacaaccccaagaagcccgagatgcccaacatgctggagatcctgaaggagatgaacagcgtgaagctgagaagcgtgaagagaagcgagcaggacgtgaagcccaagcccgtggacgccaccgaccccgccgccctgatcgccgaggccctgaagaagaagttcgcctacagatacagaagcgacagccaggacgaggtggagaagggcatccccaagagcgagagcgaggccaccagcgagagagtgctgttcggcccccacatgctgaagcccaccggcaagatgaaggccctgatcgagaacgtgagcgacagctag

SEQ ID NO: 19829 - DNA, 903 bp, Artificial Sequence
  Description of Artificial Sequence: Synthetic coding sequence
atgctgggctggatcaagagactgatcagaatggtgttccagcaggtgggcgtgagcatgcagagcatcaacagccacgccaccgagtggagccccagccaccccggcgaggacgccgtggccagcttcgccgacgtgggctgggtggccaaggaggagggcgagtgcagcgccagactgagaaccgaggtgagaagcagaccccccctgcaggacgacctgctgttcttcgagaaggcccccagcagacagatcagcctgcccgacctgagccaggaggagccccagctgaagacccccgccctggccaacgaggaggccctgcagaagatctgcgccctggagaacgagctggccgccctgagagcccagatcgccaagatcgtgacccagcaggagcagcagaacctgaccgccggcgacctggacagcaccaccttcggcaccatccccccccaccccccccccccccccccccccctgcccccccccgccctgggcctgcaccagagcaccagcgccgtggacctgatcaaggagagaagagagaagagagccaacgccggcaagaccctggtgaagaacaaccccaagaagcccgagatgcccaacatgctggagatcctgaaggagatgaacagcgtgaagctgagaagcgtgaagagaagcgagcaggacgtgaagcccaagcccgtggacgccaccgaccccgccgccctgatcgccgaggccctgaagaagaagttcgcctacagatacagaagcgacagccaggacgaggtggagaagggcatccccaagagcgagagcgaggccaccagcgagagagtgctgttcggcccccacatgctgaagcccaccggcaagatgaaggccctgatcgagaacgtgagcgacagctag

SEQ ID NO: 19830 - DNA, 1005 bp, Artificial Sequence
  Description of Artificial Sequence: Synthetic coding sequence
atgagactgacccccagagccctgtgcagcgccgcccaggccgcctggagagagaacttccccctgtgcggcagagacgtggccagatggttccccggccacatggccaagggcctgaagaagatgcagagcagcctgaagctggtggactgcatcatcgaggtgcacgacgccagaatccccctgagcggcagaaaccccctgttccaggagaccctgggcctgaagccccacctgctggtgctgaacaagatggacctggccgacctgaccgagcagcagaagatcatgcagcacctggagggcgagggcctgaagaacgtgatcttcaccaactgcgtgaaggacgagaacgtgaagcagatcatccccatggtgaccgagctgatcggcagaagccacagataccacagaaaggagaacctggagtactgcatcatggtgatcggcgtgcccaacgtgggcaagagcagcctgatcaacagcctgagaagacagcacctgagaaagggcaaggccaccagagtgggcggcgagcccggcatcaccagagccgtgatgagcaagatccaggtgagcgagagacccctgatgttcctgctggacacccccggcgtgctggcccccagaatcgagagcgtggagaccggcctgaagctggccctgtgcggcaccgtgctggaccacctggtgggcgaggagaccatggccgactacctgctgtacaccctgaacaagcaccagagattcggctacgtgcagcactacggcctgggcagcgcctgcgacaacgtggagagagtgctgaagagcgtggccgtgaagctgggcaagacccagaaggtgaaggtgctgaccggcaccggcaacgtgaacatcatccagcccaactaccccgccgccgccagagacttcctgcagaccttcagaagaggcctgctgggcagcgtgatgctggacctggacgtgctgagaggccacccccccgccgagaccctgccctag

SEQ ID NO: 19831 - DNA, 852 bp, Artificial Sequence
  Description of Artificial Sequence: Synthetic coding sequence
atgagactgacccccagagccctgtgcagcgccgcccaggccgcctggagagagaacttccccctgtgcggcagagacgtggccagatggttccccggccacatggccaagggcctgaagaagatgcagagcagcctgaagctggtggactgcatcatcgaggtgcacgacgccagaatccccctgagcggcagaaaccccctgttccaggagaccctgggcctgaagccccacctgctggtgctgaacaagatggacctggccgacctgaccgagcagcagaagatcatgcagcacctggagggcgagggcctgaagaacgtgatcttcaccaactgcgtgaaggacgagaacgtgaagcagatcatccccatggtgaccgagctgatcggcagaagccacagataccacagaaaggaggtgagcgagagacccctgatgttcctgctggacacccccggcgtgctggcccccagaatcgagagcgtggagaccggcctgaagctggccctgtgcggcaccgtgctggaccacctggtgggcgaggagaccatggccgactacctgctgtacaccctgaacaagcaccagagattcggctacgtgcagcactacggcctgggcagcgcctgcgacaacgtggagagagtgctgaagagcgtggccgtgaagctgggcaagacccagaaggtgaaggtgctgaccggcaccggcaacgtgaacatcatccagcccaactaccccgccgccgccagagacttcctgcagaccttcagaagaggcctgctgggcagcgtgatgctggacctggacgtgctgagaggccacccccccgccgagaccctgccctag

SEQ ID NO: 19832 - DNA, 681 bp, Artificial Sequence
  Description of Artificial Sequence: Synthetic coding sequence
atgcagagcagcctgaagctggtggactgcatcatcgaggtgcacgacgccagaatccccctgagcggcagaaaccccctgttccaggagaccctgggcctgaagccccacctgctggtgctgaacaagatggacctggccgacctgaccgagcagcagaagatcatgcagcacctggagggcgagggcctgaagaacgtgatcttcaccaactgcgtgaaggacgagaacgtgaagcagatcatccccatggtgaccgagctgatcggcagaagccacagataccacagaaaggagaacctggagtactgcatcatggtgatcggcgtgcccaacgtgggcaagagcagcctgatcaacagcctgagaagacagcacctgagaaagggcaaggccaccagagtgggcggcgagcccggcatcaccagagccgtgatgagcaagatccaggtggagagcagcggcgccagacccagcaccctgagcagagccctgcaggccagcggcacctgcagacccctgtgcggcttcagactgctgaccaccctgcccagcccccccctgagcgtgcccgccgagcaccccagaggcagacactgcccctgcccctacagcaccgtggtgatcgtgttcgcccccaacctgtggggcagacacgccgtgttccccatcagcagatag

SEQ ID NO: 19833 - DNA, 237 bp, Artificial Sequence
  Description of Artificial Sequence: Synthetic coding sequence
atgagcgagagcgagctgggcagaaagtgggacagatgcctggccgacgccgtggtgaagatcggcaccggcttcggcctgggcatcgtgttcagcctgaccttcttcaagagaagaatgtggcccctggccttcggcagcggcatgggcctgggcatggcctacagcaactgccagcacgacttccaggccccctacctgctgcacggcaagtacgtgaaggagcaggagcagtag

SEQ ID NO: 19834 - DNA, 1467 bp, Artificial Sequence
  Description of Artificial Sequence: Synthetic coding sequence
atgaacagccagaccgaggaccacgccctggcccccgtgagaaacaccatccagctgcccacccagcccctgaacagcgaggagtgggacaagctgaaggaggacctgaaggagaacaccggcaagaccagcttcgagagctggatcatcagccagatggccggctgccacagcagcatcgacgtggccaagagcctgctggcctgggtggccgccaagaacaacggcatcgtgagctacgacctgctggtgaagtacctgtacctgtgcgtgttccacatgcagaccagcgaggtgatcgacgtgttcgagatcatgaaggccagatacaagaccctggagcccagaggctacagcctgctgatcagaggcctgatccacagcgacagatggagagaggccctgctgctgctggaggacatcaagaaggtgatcacccccagcaagaagaactacaacgactgcatccagggcgccctgctgcaccaggacgtgaacaccgcctggaacctgtaccaggagctgctgggccacgacatcgtgcccatgctggagaccctgaaggccttcttcgacttcggcaaggacatcaaggacgacaactacagcaacaagctgctggacatcctgagctacctgagaaacaaccagctgtaccccggcgagagcttcgcccacagcatcaagacctggttcgagagcgtgcccggcaagcagtggaagggccagttcaccaccgtgagaaagagcggccagtgcagcggctgcggcaagaccatcgagagcatccagctgagccccgaggagtacgagtgcctgaagggcaagatcatgagagacgtgatcgacggcggcgaccagtacagaaagaccaccccccaggagctgaagagattcgagaacttcatcaagagcagaccccccttcgacgtggtgatcgacggcctgaacgtggccaagatgttccccaaggtgagagagagccagctgctgctgaacgtggtgagccagctggccaagagaaacctgagactgctggtgctgggcagaaagcacatgctgagaagaagcagccagtggagcagagacgagatggaggaggtgcagaagcaggccagctgcttcttcgccgacgacatcagcgaggacgaccccttcctgctgtacgccaccctgcacagcggcaaccactgcagattcatcaccagagacctgatgagagaccacaaggcctgcctgcccgacgccaagacccagagactgttcttcaagtggcagcagggccaccagctggccatcgtgaacagattccccggcagcaagctgaccttccagagaatcctgagctacgacaccgtggtgcagaccaccggcgacagctggcacatcccctacgacgaggacctggtggagagatgcagctgcgaggtgcccaccaagtggctgtgcctgcaccagaagacctag

SEQ ID NO: 19835 - DNA, 1704 bp, Artificial Sequence
  Description of Artificial Sequence: Synthetic coding sequence
atgaccttctacctgttcggcatcagaagcttccccaagctgtggaagagcccctacctgggcctgggccccggccacagctacgtgagcctgttcctggccgacagatgcggcatcagaaaccagcagagactgttcagcctgaagaccatgagcccccagaacaccaaggccaccaacctgatcgccaaggccagatacctgagaaaggacgagggcagcaacaagcaggtgtacagcgtgccccacttcttcctggccggcgccgccaaggagagaagccagatgaacagccagaccgaggaccacgccctggcccccgtgagaaacaccatccagctgcccacccagcccctgaacagcgaggagtgggacaagctgaaggaggacctgaaggagaacaccggcaagaccagcttcgagagctggatcatcagccagatggccggctgccacagcagcatcgacgtggccaagagcctgctggcctgggtggccgccaagaacaacggcatcgtgagctacgacctgctggtgaagtacctgtacctgtgcgtgttccacatgcagaccagcgaggtgatcgacgtgttcgagatcatgaaggccagatacaagaccctggagcccagaggctacagcctgctgatcagaggcctgatccacagcgacagatggagagaggccctgctgctgctggaggacatcaagaaggtgatcacccccagcaagaagaactacaacgactgcatccagggcgccctgctgcaccaggacgtgaacaccgcctggaacctgtaccaggagctgctgggccacgacatcgtgcccatgctggagaccctgaaggccttcttcgacttcggcaaggacatcaaggacgacaactacagcaacaagctgctggacatcctgagctacctgagaaacaaccagctgtaccccggcgagagcttcgcccacagcatcaagacctggttcgagagcggccagtgcagcggctgcggcaagaccatcgagagcatccagctgagccccgaggagtacgagtgcctgaagggcaagatcatgagagacgtgatcgacggcggcgaccagtacagaaagaccaccccccaggagctgaagagattcgagaacttcatcaagagcagaccccccttcgacgtggtgatcgacggcctgaacgtggccaagatgttccccaaggtgagagagagccagctgctgctgaacgtggtgagccagctggccaagagaaacctgagactgctggtgctgggcagaaagcacatgctgagaagaagcagccagtggagcagagacgagatggaggaggtgcagaagcaggccagctgcttcttcgccgacgacatcagcgaggacgaccccttcctgctgtacgccaccctgcacagcggcaaccactgcagattcatcaccagagacctgatgagagaccacaaggcctgcctgcccgacgccaagacccagagactgttcttcaagtggcagcagggccaccagctggccatcgtgaacagattccccggcagcaagctgaccttccagagaatcctgagctacgacaccgtggtgcagaccaccggcgacagctggcacatcccctacgacgaggacctggtggagagatgcagctgcgaggtgcccaccaagtggctgtgcctgcaccagaagacctag

SEQ ID NO: 19836 - DNA, 1752 bp, Artificial Sequence
  Description of Artificial Sequence: Synthetic coding sequence
atgaccttctacctgttcggcatcagaagcttccccaagctgtggaagagcccctacctgggcctgggccccggccacagctacgtgagcctgttcctggccgacagatgcggcatcagaaaccagcagagactgttcagcctgaagaccatgagcccccagaacaccaaggccaccaacctgatcgccaaggccagatacctgagaaaggacgagggcagcaacaagcaggtgtacagcgtgccccacttcttcctggccggcgccgccaaggagagaagccagatgaacagccagaccgaggaccacgccctggcccccgtgagaaacaccatccagctgcccacccagcccctgaacagcgaggagtgggacaagctgaaggaggacctgaaggagaacaccggcaagaccagcttcgagagctggatcatcagccagatggccggctgccacagcagcatcgacgtggccaagagcctgctggcctgggtggccgccaagaacaacggcatcgtgagctacgacctgctggtgaagtacctgtacctgtgcgtgttccacatgcagaccagcgaggtgatcgacgtgttcgagatcatgaaggccagatacaagaccctggagcccagaggctacagcctgctgatcagaggcctgatccacagcgacagatggagagaggccctgctgctgctggaggacatcaagaaggtgatcacccccagcaagaagaactacaacgactgcatccagggcgccctgctgcaccaggacgtgaacaccgcctggaacctgtaccaggagctgctgggccacgacatcgtgcccatgctggagaccctgaaggccttcttcgacttcggcaaggacatcaaggacgacaactacagcaacaagctgctggacatcctgagctacctgagaaacaaccagctgtaccccggcgagagcttcgcccacagcatcaagacctggttcgagagcgtgcccggcaagcagtggaagggccagttcaccaccgtgagaaagagcggccagtgcagcggctgcggcaagaccatcgagagcatccagctgagccccgaggagtacgagtgcctgaagggcaagatcatgagagacgtgatcgacggcggcgaccagtacagaaagaccaccccccaggagctgaagagattcgagaacttcatcaagagcagaccccccttcgacgtggtgatcgacggcctgaacgtggccaagatgttccccaaggtgagagagagccagctgctgctgaacgtggtgagccagctggccaagagaaacctgagactgctggtgctgggcagaaagcacatgctgagaagaagcagccagtggagcagagacgagatggaggaggtgcagaagcaggccagctgcttcttcgccgacgacatcagcgaggacgaccccttcctgctgtacgccaccctgcacagcggcaaccactgcagattcatcaccagagacctgatgagagaccacaaggcctgcctgcccgacgccaagacccagagactgttcttcaagtggcagcagggccaccagctggccatcgtgaacagattccccggcagcaagctgaccttccagagaatcctgagctacgacaccgtggtgcagaccaccggcgacagctggcacatcccctacgacgaggacctggtggagagatgcagctgcgaggtgcccaccaagtggctgtgcctgcaccagaagacctag

SEQ ID NO: 19837 - DNA, 105 bp, Artificial Sequence
  Description of Artificial Sequence: Synthetic coding sequence
atgaccttctacctgttcggcatcagaagcttccccaagctgtggaagagcccctacctgggcctgggccccggccacagctacgtgagcctgttcctggcctag

SEQ ID NO: 19838 - DNA, 63 bp, Artificial Sequence
  Description of Artificial Sequence: Synthetic coding sequence
atgaccttctacctgttcggcatcagaagcttccccaagctgtggaagagcccctacctgtag

SEQ ID NO: 19839 - DNA, 1467 bp, Artificial Sequence; identical to SEQ ID NO: 19834
  Description of Artificial Sequence: Synthetic coding sequence

SEQ ID NO: 19840 - DNA, 72 bp, Artificial Sequence
  Description of Artificial Sequence: Synthetic coding sequence
atgaccttctacctgttcggcatcagaagcttccccaagctgtggaagagcccctacctgggcctgggctag

SEQ ID NO: 19841 - DNA, 1704 bp, Artificial Sequence; identical to SEQ ID NO: 19835
  Description of Artificial Sequence: Synthetic coding sequence

SEQ ID NO: 19842 - DNA, 636 bp, Artificial Sequence
  Description of Artificial Sequence: Synthetic coding sequence
atgagagacgtgatcgacggcggcgaccagtacagaaagaccaccccccaggagctgaagagattcgagaacttcatcaagagcagaccccccttcgacgtggtgatcgacggcctgaacgtggccaagatgttccccaaggtgagagagagccagctgctgctgaacgtggtgagccagctggccaagagaaacctgagactgctggtgctgggcagaaagcacatgctgagaagaagcagccagtggagcagagacgagatggaggaggtgcagaagcaggccagctgcttcttcgccgacgacatcagcgaggacgaccccttcctgctgtacgccaccctgcacagcggcaaccactgcagattcatcaccagagacctgatgagagaccacaaggcctgcctgcccgacgccaagacccagagactgttcttcaagtggcagcagggccaccagctggccatcgtgaacagattccccggcagcaagctgaccttccagagaatcctgagctacgacaccgtggtgcagaccaccggcgacagctggcacatcccctacgacgaggacctggtggagagatgcagctgcgaggtgcccaccaagtggctgtgcctgcaccagaagacctag

SEQ ID NO: 19843 - DNA, 633 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaagggcagcctggacaagatcgccgtggtgaccgccgacggcaagctggccctgaaccagatcagccagatcagcatgaagagcccccagctgatcctggtgaacatggccagcttccccgagtgcaccgccgccgccatcaaggccatcagagagagcggcatgaacctgaaccccgaggtggagggcaccctgatcagagtgcccatcccccaggtgaccagagagcacagagagatgctggtgaagctggccaagcagaacaccaacaaggccaaggacagcctgagaaaggtgagaaccaacagcatgaacaagctgaagaagagcaaggacaccgtgagcgaggacaccatcagactgatcgagaagcagatcagccagatggccgacgacaccgtggccgagctggacagacacctggccgtgaagaccaaggagctgctgggctag

SEQ ID NO: 19844 - DNA, 789 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagtgcaccgccgccgccatcaaggccatcagagagagcggcatgaacctgaaccccgaggtggagggcaccctgatcagagtgcccatcccccaggtgaccagagagcacagagagatgctggtgaagctggccaagcagaacaccaacaaggccaaggacagcctgagaaaggtgagaaccaacagcatgaacaagctgaagaagagcaaggacaccgtgagcgaggacaccatcagactgatcgagaagcagatcagccagatggccgacgacaccgtggccgagctggacagacacctggccgtgaagaccaaggagctgctgggctag

SEQ ID NO: 19845 - DNA, 606 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagtgcaccgccgccgccatcaaggccatcagagagagcggcatgaacctgaaccccgaggtggagggcaccctgatcagagtgcccatcccccagagcgccaagtggcccatgacccagtggcagaactggaccggcatctggcagtag

SEQ ID NO: 19846 - DNA, 375 bp, Artificial Sequence
  Description of Artificial Sequence: Synthetic coding sequence
atggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagaccatgaagcagatcaagcagtacttcaacggccccaacgtggcctag

SEQ ID NO: 19847 - DNA, 477 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgaggtgagatggccctgctag

SEQ ID NO: 19848 - DNA, 477 bp, Artificial Sequence; identical to SEQ ID NO: 19847
  Description of Artificial Sequence: Synthetic coding sequence

SEQ ID NO: 19849 - DNA, 657 bp, Artificial Sequence
  Description of Artificial Sequence: Synthetic coding sequence
atggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagtgcaccgccgccgccatcaaggccatcagagagagcggcatgaacctgaaccccgaggtggagggcaccctgatcagagtgcccatcccccaggtgaccagagagcacagagagatgctggtgaagctggccaagcagaacaccaacaaggccaaggacagcctgagaaaggtgagaaccaacagcatgaacaagctgaagaagagcaaggacaccgtgagcgaggacaccatcagactgatcgagaagcagatcagccagatggccgacgacaccgtggccgagctggacagacacctggccgtgaagaccaaggagctgctgggctag

SEQ ID NO: 19850 - DNA, 531 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgaggagctggcctggatcagaagcctgagagtgcccggcatcagaagccacctgtaccaccagctggccgtgtag

SEQ ID NO: 19851 - DNA, 606 bp, Artificial Sequence; identical to SEQ ID NO: 19845
  Description of Artificial Sequence: Synthetic coding sequence

SEQ ID NO: 19852 - DNA, 462 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagtag

SEQ ID NO: 19853 - DNA, 507 bp, Artificial Sequence
  Description of Artificial Sequence: Synthetic coding sequence
atggccctgggcctgaagtgcttcagaatggtgcaccccaccttcagaaactacctggccgccagcatcagacccgtgagcgaggtgaccctgaagaccgtgcacgagagacagcacggccacagacagtacatggcctacagcgccgtgcccgtgagacacttcgccaccaagaaggccaaggccaagggcaagggccagagccagaccagagtgaacatcaacgccgccctggtggaggacatcatcaacctggaggaggtgaacgaggagatgaagagcgtgatcgaggccctgaaggacaacttcaacaagaccctgaacatcagaaccagccccggcagcctggacaagatcgccgtggtgaccgccgacggcaagctggccctgaaccagatcagccagatcagcatgaagagcccccagctgatcctggtgaacatggccagcttccccgagaccatgaagcagatcaagcagtacttcaacggccccaacgtggcctag

SEQ ID NO: 19854 - DNA, 1062 bp, Artificial Sequence
  Description of Artificial Sequence: Synthetic coding sequence
atggccctgctgagcaccgtgagaggcgccacctggggcagactggtgaccagacacttcagccacgccgccagacacggcgagagacccggcggcgaggagctgagcagactgctgctggacgacctggtgcccaccagcagactggagctgctgttcggcatgaccccctgcctgctggccctgcaggccgccagaagaagcgtggccagactgctgctgcaggccggcaaggccggcctgcagggcaagagagccgagctgctgagaatggccgaggccagagacatccccgtgctgagacccagaagacagaagctggacaccatgtgcagataccaggtgcaccagggcgtgtgcatggaggtgagccccctgagacccagaccctggagagaggccggcgaggccagccccggcgacgacccccagcagctgtggctggtgctggacggcatccaggaccccagaaacttcggcgccgtgctgagaagcgcccacttcctgggcgtggacaaggtgatcaccagcagaagaaacagctgccccctgacccccgtggtgagcaagagcagcgccggcgccatggaggtgatggacgtgttcagcaccgacgacctgaccggcttcctgcagaccaaggcccagcagggctggctggtggccggcaccgtgggctgccccagcaccgaggacccccagagcagcgagatccccatcatgagctgcctggagttcctgtgggagagacccaccctgctggtgctgggcaacgagggcagcggcctgagccaggaggtgcaggccagctgccagctgctgctgaccatcctgcccagaagacagctgccccccggcctggagagcctgaacgtgagcgtggccgccggcatcctgctgcacagcatctgcagccagagaaagggcttccccaccgagggcgagagaagacagctgctgcaggacccccaggagcccagcgccagaagcgagggcctgagcatggcccagcaccccggcctgagcagcggccccgagaaggagagacagaacgagggctag

SEQ ID NO: 19855 - DNA, 837 bp, Artificial Sequence
  Description of Artificial Sequence: Synthetic coding sequence
atggccgccctgttcctgaagagactgaccctgcagaccgtgaagagcgagaacagctgcatcagatgcttcggcaagcacatcctgcagaagaccgcccccgcccagctgagccccatcgccagcgcccccagactgagcttcctgatccacgccaaggccttcagcaccgccgaggacacccagaacgagggcaagaagaccaagaagaacaagaccgccttcagcaacgtgggcagaaagatcagccagagagtgatccacctgttcgacgagaagggcaacgacctgggcaacatgcacagagccaacgtgatcagactgatggacgagagagacctgagactggtgcagagaaacaccagcaccgagcccgccgagtaccagctgatgaccggcctgcagatcctgcaggagagacagagactgagagagatggagaaggccaaccccaagaccggccccaccctgagaaaggagctgatcctgagcagcaacatcggccagcacgacctggacaccaagaccaagcagatccagcagtggatcaagaagaagcacctggtgcagatcaccatcaagaagggcaagaacgtggacgtgagcgagaacgagatggaggagatcttccaccagatcctgcagaccatgcccggcatcgccaccttcagcagcagaccccaggccgtgcagggcggcaaggccctgatgtgcgtgctgagagccttcagcaagaacgaggagaaggcctacaaggagacccaggagacccaggagagagacaccctgaacaaggaccacggcaacgacaaggagagcaacgtgctgcaccagtag

SEQ ID NO: 19856 - DNA, 837 bp, Artificial Sequence; identical to SEQ ID NO: 19855
  Description of Artificial Sequence: Synthetic coding sequence

SEQ ID NO: 19857 - DNA, 837 bp, Artificial Sequence; identical to SEQ ID NO: 19855
  Description of Artificial Sequence: Synthetic coding sequence

SEQ ID NO: 19858 - DNA, 837 bp, Artificial Sequence; identical to SEQ ID NO: 19855
  Description of Artificial Sequence: Synthetic coding sequence

SEQ ID NO: 19859 - DNA, 681 bp, Artificial Sequence
  Description of Artificial Sequence: Synthetic coding sequence
atgaacgagaacctgttcgccagcttcatcgcccccaccatcctgggcctgcccgccgccgtgctgatcatcctgttcccccccctgctgatccccaccagcaagtacctgatcaacaacagactgatcaccacccagcagtggctgatcaagctgaccagcaagcagatgatgaccatgcacaacaccaagggcagaacctggagcctgatgctggtgagcctgatcatcttcatcgccaccaccaacctgctgggcctgctgccccacagcttcacccccaccacccagctgagcatgaacctggccatggccatccccctgtgggccggcaccgtgatcatgggcttcagaagcaagatcaagaacgccctggcccacttcctgccccagggcacccccacccccctgatccccatgctggtgatcatcgagaccatcagcctgctgatccagcccatggccctggccgtgagactgaccgccaacatcaccgccggccacctgctgatgcacctgatcggcagcgccaccctggccatgagcaccatcaacctgcccagcaccctgatcatcttcaccatcctgatcctgctgaccatcctggagatcgccgtggccctgatccaggcctacgtgttcaccctgctggtgagcctgtacctgcacgacaacacctag

SEQ ID NO: 19860 - DNA, 1143 bp, Artificial Sequence
  Description of Artificial Sequence: Synthetic coding sequence
atgacccccatgagaaagaccaaccccctgatgaagctgatcaaccacagcttcatcgacctgcccacccccagcaacatcagcgcctggtggaacttcggcagcctgctgggcgcctgcctgatcctgcagatcaccaccggcctgttcctggccatgcactacagccccgacgccagcaccgccttcagcagcatcgcccacatcaccagagacgtgaactacggctggatcatcagatacctgcacgccaacggcgccagcatgttcttcatctgcctgttcctgcacatcggcagaggcctgtactacggcagcttcctgtacagcgagacctggaacatcggcatcatcctgctgctggccaccatggccaccgccttcatgggctacgtgctgccctggggccagatgagcttctggggcgccaccgtgatcaccaacctgctgagcgccatcccctacatcggcaccgacctggtgcagtggatctggggcggctacagcgtggacagccccaccctgaccagattcttcaccttccacttcatcctgcccttcatcatcgccgccctggccaccctgcacctgctgttcctgcacgagaccggcagcaacaaccccctgggcatcaccagccacagcgacaagatcaccttccacccctactacaccatcaaggacgccctgggcctgctgctgttcctgctgagcctgatgaccctgaccctgttcagccccgacctgctgggcgaccccgacaactacaccctggccaaccccctgaacacccccccccacatcaagcccgagtggtacttcctgttcgcctacaccatcctgagaagcgtgcccaacaagctgggcggcgtgctggccctgctgctgagcatcctgatcctggccatgatccccatcctgcacatgagcaagcagcagagcatgatgttcagacccctgagccagagcctgtactggctgctggccgccgacctgctgatcctgacctggatcggcggccagcccgtgagctaccccttcaccatcatcggccaggtggccagcgtgctgtacttcaccaccatcctgatcctgatgcccaccatcagcctgatcgagaacaagatgctgaagtgggcctag

SEQ ID NO: 19861 - DNA, 1542 bp, Artificial Sequence
  Description of Artificial Sequence: Synthetic coding sequence
atgttcgccgacagatggctgttcagcaccaaccacaaggacatcggcaccctgtacctgctgttcggcgcctgggccggcgtgctgggcaccgccctgagcctgctgatcagagccgagctgggccagcccggcaacctgctgggcaacgaccacatctacaacgtgatcgtgaccgcccacgccttcgtgatgatcttcttcatggtgatgcccatcatgatcggcggcttcggcaactggctggtgcccctgatgatcggcgcccccgacatggccttccccagaatgaacaacatgagcttctggctgctgccccccagcctgctgctgctgctggccagcgccatggtggaggccggcgccggcaccggctggaccgtgtacccccccctggccggcaactacagccaccccggcgccagcgtggacctgaccatcttcagcctgcacctggccggcgtgagcagcatcctgggcgccatcaacttcatcaccaccatcatcaacatgaagccccccgccatgacccagtaccagacccccctgttcgtgtggagcgtgctgatcaccgccgtgctgctgctgctgagcctgcccgtgctggccgccggcatcaccatgctgctgaccgacagaaacctgaacaccaccttcttcgaccccgccggcggcggcgaccccatcctgtaccagcacctgttctggttcttcggccaccccgaggtgtacatcctgatcctgcccggcttcggcatgatcagccacatcgtgacctactacagcggcaagaaggagcccttcggctacatgggcatggtgtgggccatgatgagcatcggcttcctgggcttcatcgtgtgggcccaccacatgttcaccgtgggcatggacgtggacaccagagcctacttcaccagcgccaccatgatcatcgccatccccaccggcgtgaaggtgttcagctggctggccaccctgcacggcagcaacatgaagtggagcgccgccgtgctgtgggccctgggcttcatcttcctgttcaccgtgggcggcctgaccggcatcgtgctggccaacagcagcctggacatcgtgctgcacgacacctactacgtggtggcccacttccactacgtgctgagcatgggcgccgtgttcgccatcatgggcggcttcatccactggttccccctgttcagcggctacaccctggaccagacctacgccaagatccacttcaccatcatgttcatcggcgtgaacctgaccttcttcccccagcacttcctgggcctgagcggcatgcccagaagatacagcgactaccccgacgcctacaccacctggaacatcctgagcagcgtgggcagcttcatcagcctgaccgccgtgatgctgatgatcttcatgatctgggaggccttcgccagcaagagaaaggtgctgatggtggaggagcccagcatgaacctggagtggctgtacggctgcccccccccctaccacaccttcgaggagcccgtgtacatgaagagctag

SEQ ID NO: 19862 - DNA, 684 bp, Artificial Sequence
  Description of Artificial Sequence: Synthetic coding sequence
atggcccacgccgcccaggtgggcctgcaggacgccaccagccccatcatggaggagctgatcaccttccacgaccacgccctgatgatcatcttcctgatctgcttcctggtgctgtacgccctgttcctgaccctgaccaccaagctgaccaacaccaacatcagcgacgcccaggagatggagaccgtgtggaccatcctgcccgccatcatcctggtgctgatcgccctgcccagcctgagaatcctgtacatgaccgacgaggtgaacgaccccagcctgaccatcaagagcatcggccaccagtggtactggacctacgagtacaccgactacggcggcctgatcttcaacagctacatgctgccccccctgttcctggagcccggcgacctgagactgctggacgtggacaacagagtggtgctgcccatcgaggcccccatcagaatgatgatcaccagccaggacgtgctgcacagctgggccgtgcccaccctgggcctgaagaccgacgccatccccggcagactgaaccagaccaccttcaccgccaccagacccggcgtgtactacggccagtgcagcgagatctgcggcgccaaccacagcttcatgcccatcgtgctggagctgatccccctgaagatcttcgagatgggccccgtgttcaccctgtag

SEQ ID NO: 19863 - DNA, 786 bp, Artificial Sequence
  Description of Artificial Sequence: Synthetic coding sequence
atgacccaccagagccacgcctaccacatggtgaagcccagcccctggcccctgaccggcgccctgagcgccctgctgatgaccagcggcctggccatgtggttccacttccacagcatgaccctgctgatgctgggcctgctgaccaacaccctgaccatgtaccagtggtggagagacgtgaccagagagagcacctaccagggccaccacaccccccccgtgcagaagggcctgagatacggcatgatcctgttcatcaccagcgaggtgttcttcttcgccggcttcttctgggccttctaccacagcagcctggcccccaccccccagctgggcggccactggccccccaccggcatcacccccctgaaccccctggaggtgcccctgctgaacaccagcgtgctgctggccagcggcgtgagcatcacctgggcccaccacagcctgatggagaacaacagaaaccagatgatccaggccctgctgatcaccatcctgctgggcctgtacttcaccctgctgcaggccagcgagtacttcgagagccccttcaccatcagcgacggcatctacggcagcaccttcttcgtggccaccggcttccacggcctgcacgtgatcatcggcagcaccttcctgaccatctgcttcatcagacagctgatgttccacttcaccagcaagcaccacttcggcttcgaggccgccgcctggtactggcacttcgtggacgtggtgtggctgttcctgtacgtgagcatctactggtggggcagctag

SEQ ID NO: 19864 - DNA, 957 bp, Artificial Sequence
  Description of Artificial Sequence: Synthetic coding sequence
atgcccatggccaacctgctgctgctgatcgtgcccatcctgatcgccatggccttcctgatgctgaccgagagaaagatcctgggctacatgcagctgagaaagggccccaacgtggtgggcccctacggcctgctgcagcccttcgccgacgccatgaagctgttcaccaaggagcccctgaagcccgccaccagcaccatcaccctgtacatcaccgcccccaccctggccctgaccatcgccctgctgctgtggacccccctgcccatgcccaaccccctggtgaacctgaacctgggcctgctgttcatcctggccaccagcagcctggccgtgtacagcatcctgtggagcggctgggccagcaacagcaactacgccctgatcggcgccctgagagccgtggcccagaccatcagctacgaggtgaccctggccatcatcctgctgagcaccctgctgatgagcggcagcttcaacctgagcaccctgatcaccacccaggagcacctgtggctgctgctgcccagctggcccctggccatgatgtggttcatcagcaccctggccgagaccaacagaacccccttcgacctggccgagggcgagagcgagctggtgagcggcttcaacatcgagtacgccgccggccccttcgccctgttcttcatggccgagtacaccaacatcatcatgatgaacaccctgaccaccaccatcttcctgggcaccacctacgacgccctgagccccgagctgtacaccacctacttcgtgaccaagaccctgctgctgaccagcctgttcctgtggatcagaaccgcctaccccagattcagatacgaccagctgatgcacctgctgtggaagaacttcctgcccctgaccctggccctgctgatgtggtacgtgagcatgcccatcaccatcagcagcatccccccccagacctag

SEQ ID NO: 19865 - DNA, 1044 bp, Artificial Sequence
  Description of Artificial Sequence: Synthetic coding sequence
atcaaccccctggcccagcccgtgatctacagcaccatcttcgccggcaccctgatcaccgccctgagcagccactggttcttcacctgggtgggcctggagatgaacatgctggccttcatccccgtgctgaccaagaagatgaaccccagaagcaccgaggccgccatcaagtacttcctgacccaggccaccgccagcatgatcctgctgatggccatcctgttcaacaacatgctgagcggccagtggaccatgaccaacaccaccaaccagtacagcagcctgatgatcatgatggccatggccatgaagctgggcatggcccccttccacttctgggtgcccgaggtgacccagggcacccccctgaccagcggcctgctgctgctgacctggcagaagctggcccccatcagcatcatgtaccagatcagccccagcctgaacgtgagcctgctgctgaccctgagcatcctgagcatcatggccggcagctggggcggcctgaaccagacccagctgagaaagatcctggcctacagcagcatcacccacatgggctggatgatggccgtgctgccctacaaccccaacatgaccatcctgaacctgaccatctacatcatcctgaccaccaccgccttcctgctgctgaacctgaacagcagcaccaccaccctgctgctgagcagaacctggaacaagctgacctggctgacccccctgatccccagcaccctgctgagcctgggcggcctgccccccctgaccggcttcctgcccaagtgggccatcatcgaggagttcaccaagaacaacagcctgatcatccccaccatcatggccaccatcaccctgctgaacctgtacttctacctgagactgatctacagcaccagcatcaccctgctgcccatgagcaacaacgtgaagatgaagtggcagttcgagcacaccaagcccacccccttcctgcccaccctgatcgccctgaccaccctgctgctgcccatcagccccttcatgctgatgatcctgtag

SEQ ID NO: 19866 - DNA, 348 bp, Artificial Sequence
  Description of Artificial Sequence: Synthetic coding sequence
atgaacttcgccctgatcctgatgatcaacaccctgctggccctgctgctgatgatcatcaccttctggctgccccagctgaacggctacatggagaagagcaccccctacgagtgcggcttcgaccccatgagccccgccagagtgcccttcagcatgaagttcttcctggtggccatcaccttcctgctgttcgacctggagatcgccctgctgctgcccctgccctgggccctgcagaccaccaacctgcccctgatggtgatgagcagcctgctgctgatcatcatcctggccctgagcctggcctacgagtggctgcagaagggcctggactggaccgagtag

SEQ ID NO: 19867 - DNA, 1380 bp, Artificial Sequence
  Description of Artificial Sequence: Synthetic coding sequence
atgctgaagctgatcgtgcccaccatcatgctgctgcccctgacctggctgagcaagaagcacatgatctggatcaacaccaccacccacagcctgatcatcagcatcatccccctgctgttcttcaaccagatcaacaacaacctgttcagctgcagccccaccttcagcagcgaccccctgaccacccccctgctgatgctgaccacctggctgctgcccctgaccatcatggccagccagagacacctgagcagcgagcccctgagcagaaagaagctgtacctgagcatgctgatcagcctgcagatcagcctgatcatgaccttcaccgccaccgagctgatcatgttctacatcttcttcgagaccaccctgatccccaccctggccatcatcaccagatggggcaaccagcccgagagactgaacgccggcacctacttcctgttctacaccctggtgggcagcctgcccctgctgatcgccctgatctacacccacaacaccctgggcagcctgaacatcctgctgctgaccctgaccgcccaggagctgagcaacagctgggccaacaacctgatgtggctggcctacaccatggccttcatggtgaagatgcccctgtacggcctgcacctgtggctgcccaaggcccacgtggaggcccccatcgccggcagcatggtgctggccgccgtgctgctgaagctgggcggctacggcatgatgagactgaccctgatcctgaaccccctgaccaagcacatggcctaccccttcctggtgctgagcctgtggggcatgatcatgaccagcagcatctgcctgagacagaccgacctgaagagcctgatcgcctacagcagcatcagccacatggccctggtggtgaccgccatcctgatccagaccccctggagcttcaccggcgccgtgatcctgatgatcgcccacggcctgaccagcagcctgctgttctgcctggccaacagcaactacgagagaacccacagcagaatcatgatcctgagccagggcctgcagaccctgctgcccctgatggccttctggtggctgctggccagcctggccaacctggccctgccccccaccatcaacctgctgggcgagctgagcgtgctggtgaccaccttcagctggagcaacatcaccctgctgctgaccggcctgaacatgctggtgaccgccctgtacagcctgtacatgttcaccaccacccagtggggcagcctgacccaccacatcaacaacatgaagcccagcttcaccagagagaacaccctgatgttcatgcacctgagccccatcctgctgctgagcctgaaccccgacatcatcaccggcttcagcagctag

SEQ ID NO: 19868 - DNA, 297 bp, Artificial Sequence
  Description of Artificial Sequence: Synthetic coding sequence
atgcccctgatctacatgaacatcatgctggccttcaccatcagcctgctgggcatgctggtgtacagaagccacctgatgagcagcctgctgtgcctggagggcatgatgctgagcctgttcatcatggccaccctgatgaccctgaacacccacagcctgctggccaacatcgtgcccatcgccatgctggtgttcgccgcctgcgaggccgccgtgggcctggccctgctggtgagcatcagcaacacctacggcctggactacgtgcacaacctgaacctgctgcagtgctag

SEQ ID NO: 19869 - DNA, 1812 bp, Artificial Sequence
  Description of Artificial Sequence: Synthetic coding sequence
atgaccatgcacaccaccatgaccaccctgaccctgaccagcctgatcccccccatcctgaccaccctggtgaaccccaacaagaagaacagctacccccactacgtgaagagcatcgtggccagcaccttcatcatcagcctgttccccaccaccatgttcatgtgcctggaccaggaggtgatcatcagcaactggcactgggccaccacccagaccacccagctgagcctgagcttcaagctggactacttcagcatgatgttcatccccgtggccctgttcgtgacctggagcatcatggagttcagcctgtggtacatgaacagcgaccccaacatcaaccagttcttcaagtacctgctgatcttcctgatcaccatgctgatcctggtgaccgccaacaacctgttccagctgttcatcggctgggagggcgtgggcatcatgagcttcctgctgatcagctggtggtacgccagagccgacgccaacaccgccgccatccaggccatcctgtacaacagaatcggcgacatcggcttcatcctggccctggcctggttcatcctgcacagcaacagctgggacccccagcagatggccctgctgaacgccaaccccagcctgacccccctgctgggcctgctgctggccgccgccggcaagagcgcccagctgggcctgcacccctggctgcccagcgccatggagggccccacccccgtgagcgccctgctgcacagcagcaccatggtggtggccggcatcttcctgctgatcagattccaccccctggccgagaacagccccctgatccagaccctgaccctgtgcctgggcgccatcaccaccctgttcgccgccgtgtgcgccctgacccagaacgacatcaagaagatcgtggccttcagcaccagcagccagctgggcctgatgatggtgaccatcggcatcaaccagccccacctggccttcctgcacatctgcacccacgccttcttcaaggccatgctgttcatgtgcagcggcagcatcatccacaacctgaacaacgagcaggacatcagaaagatgggcggcctgctgaagaccatgcccctgaccagcaccagcctgaccatcggcagcctggccctggccggcatgcccttcctgaccggcttctacagcaaggaccacatcatcgagaccgccaacatgagctacaccaacgcctgggccctgagcatcaccctgatcgccaccagcctgaccagcgcctacagcaccagaatgatcctgctgaccctgaccggccagcccagattccccaccctgaccaacatcaacgagaacaaccccaccctgctgaaccccatcaagagactggccgccggcagcctgttcgccggcttcctgatcaccaacaacatcagccccgccagccccttccagaccaccatccccctgtacctgaagctgaccgccctggccgtgaccttcctgggcctgctgaccgccctggacctgaactacctgaccaacaagctgaagatgaagagccccctgtgcaccttctacttcagcaacatgctgggcttctaccccagcatcacccacagaaccatcccctacctgggcctgctgaccagccagaacctgcccctgctgctgctggacctgacctggctggagaagctgctgcccaagaccatcagccagcaccagatcagcaccagcatcatcaccagcacccagaagggcatgatcaagctgtacttcctgagcttcttcttccccctgatcctgaccctgctgctgatcacctag

SEQ ID NO: 19870 - DNA, 525 bp, Artificial Sequence
  Description of Artificial Sequence: Synthetic coding sequence
atgatgtacgccctgttcctgctgagcgtgggcctggtgatgggcttcgtgggcttcagcagcaagcccagccccatctacggcggcctggtgctgatcgtgagcggcgtggtgggctgcgtgatcatcctgaacttcggcggcggctacatgggcctgatggtgttcctgatctacctgggcggcatgatggtggtgttcggctacaccaccgccatggccatcgaggagtaccccgaggcctggggcagcggcgtggaggtgctggtgagcgtgctggtgggcctggccatggaggtgggcctggtgctgtgggtgaaggagtacgacggcgtggtggtggtggtgaacttcaacagcgtgggcagctggatgatctacgagggcgagggcagcggcctgatcagagaggaccccatcggcgccggcgccctgtacgactacggcagatggctggtggtggtgaccggctggaccctgttcgtgggcgtgtacatcgtgatcgagatcgccagaggcaactag

SEQ ID NO: 19871 - DNA, 2226 bp, Artificial Sequence
  Description of Artificial Sequence: Synthetic coding sequence
atggccgagcccgtgagccccctgaagcacttcgtgctggccaagaaggccatcaccgccatcttcgaccagctgctggagttcgtgaccgagggcagccacttcgtggaggccacctacaagaaccccgagctggacagaatcgccaccgaggacgacctggtggagatgcagggctacaaggacaagctgagcatcatcggcgaggtgctgagcagaagacacatgaaggtggccttcttcggcagaaccagcagcggcaagagcagcgtgatcaacgccatgctgtgggacaaggtgctgcccagcggcatcggccacatcaccaactgcttcctgagcgtggagggcaccgacggcgacaaggcctacctgatgaccgagggcagcgacgagaagaagagcgtgaagaccgtgaaccagctggcccacgccctgcacatggacaaggacctgaaggccggctgcctggtgagagtgttctggcccaaggccaagtgcgccctgctgagagacgacctggtgctggtggacagccccggcaccgacgtgaccaccgagctggacagctggatcgacaagttctgcctggacgccgacgtgttcgtgctggtggccaacagcgagagcaccctgatgaacaccgagaagcacttcttccacaaggtgaacgagagactgagcaagcccaacatcttcatcctgaacaacagatgggacgccagcgccagcgagcccgagtacatggaggacgtgagaagacagcacatggagagatgcctgcacttcctggtggaggagctgaaggtggtgaacgccctggaggcccagaacagaatcttcttcgtgagcgccaaggaggtgctgagcgccagaaagcagaaggcccagggcatgcccgagagcggcgtggccctggccgagggcttccacgccagactgcaggagttccagaacttcgagcagatcttcgaggagtgcatcagccagagcgccgtgaagaccaagttcgagcagcacaccatcagagccaagcagatcctggccaccgtgaagaacatcatggacagcgtgaacctggccgccgaggacaagagacactacagcgtggaggagagagaggaccagatcgacagactggacttcatcagaaaccagatgaacctgctgaccctggacgtgaagaagaagatcaaggaggtgaccgaggaggtggccaacaaggtgagctgcgccatgaccgacgagatctgcagactgagcgtgctggtggacgagttctgcagcgagttccaccccaaccccgacgtgctgaagatctacaagagcgagctgaacaagcacatcgaggacggcatgggcagaaacctggccgacagatgcaccgacgaggtgaacgccctggtgctgcagacccagcaggagatcatcgagaacctgaagcccctgctgcccgccggcatccaggacaagctgcacaccctgatcccctgcaagaagttcgacctgagctacaacctgaactaccacaagctgtgcagcgacttccaggaggacatcgtgttccccttcagcctgggctggagcagcctggtgcacagattcctgggccccagaaacgcccagagagtgctgctgggcctgagcgagcccatcttccagctgcccagaagcctggccagcacccccaccgcccccaccacccccgccacccccgacaacgccagccaggaggagctgatgatcaccctggtgaccggcctggccagcgtgaccagcagaaccagcatgggcatcatcatcgtgggcggcgtgatctggaagaccatcggctggaagctgctgagcgtgagcctgaccatgtacggcgccctgtacctgtacgagagactgagctggaccacccacgccaaggagagagccttcaagcagcagttcgtgaactacgccaccgagaagctgagaatgatcgtgagcagcaccagcgccaactgcagccaccaggtgaagcagcagatcgccaccaccttcgccagactgtgccagcaggtggacatcacccagaagcagctggaggaggagatcgccagactgcccaaggagatcgaccagctggagaagatccagaacaacagcaagctgctgagaaacaaggccgtgcagctggagaacgagctggagaacttcaccaagcagttcctgcccagcagcaacgaggagagctag

SEQ ID NO: 19872 - DNA, 1893 bp, Artificial Sequence
  Description of Artificial Sequence: Synthetic coding sequence
atggccgagcccgtgagccccctgaagcacttcgtgctggccaagaaggccatcaccgccatcttcgaccagctgctggagttcgtgaccgagggcagccacttcgtggaggccacctacaagaaccccgagctggacagaatcgccaccgaggacgacctggtggagatgcagggctacaaggacaagctgagcatcatcggcgaggtgctgagcagaagacacatgaaggtggccttcttcggcagaaccagcagcggcaagagcagcgtgatcaacgccatgctgtgggacaaggtgctgcccagcggcatcggccacatcaccaactgcttcctgagcgtggagggcaccgacggcgacaaggcctacctgatgaccgagggcagcgacgagaagaagagcgtgaagaccgtgaaccagctggcccacgccctgcacatggacaaggacctgaaggccggctgcctggtgagagtgttctggcccaaggccaagtgcgccctgctgagagacgacctggtgctggtggacagccccggcaccgacgtgaccaccgagctggacagctggatcgacaagttctgcctggacgccgacgtgttcgtgctggtggccaacagcgagagcaccctgatgaacaccgagaagcacttcttccacaaggtgaacgagagactgagcaagcccaacatcttcatcctgaacaacagatgggacgccagcgccagcgagcccgagtacatggaggacgtgagaagacagcacatggagagatgcctgcacttcctggtggaggagctgaaggtggtgaacgccctggaggcccagaacagaatcttcttcgtgagcgccaaggaggtgctgagcgccagaaagcagaaggcccagggcatgcccgagagcggcgtggccctggccgagggcttccacgccagactgcaggagttccagaacttcgagcagatcttcgaggagtgcatcagccagagcgccgtgaagaccaagttcgagcagcacaccatcagagccaagcagatcctggccaccgtgaagaacatcatggacagcgtgaacctggccgccgaggacaagagacactacagcgtggaggagagagaggaccagatcgacagactggacttcatcagaaaccagatgaacctgctgaccctggacgtgaagaagaagatcaaggaggtgaccgaggaggtggccaacaaggtgagctgcgccatgaccgacgagatctgcagactgagcgtgctggtggacgagttctgcagcgagttccaccccaaccccgacgtgctgaagatctacaagagcctgcccagaagcctggccagcacccccaccgcccccaccacccccgccacccccgacaacgccagccaggaggagctgatgatcaccctggtgaccggcctggccagcgtgaccagcagaaccagcatgggcatcatcatcgtgggcggcgtgatctggaagaccatcggctggaagctgctgagcgtgagcctgaccatgtacggcgccctgtacctgtacgagagactgagctggaccacccacgccaaggagagagccttcaagcagcagttcgtgaactacgccaccgagaagctgagaatgatcgtgagcagcaccagcgccaactgcagccaccaggtgaagcagcagatcgccaccaccttcgccagactgtgccagcaggtggacatcacccagaagcagctggaggaggagatcgccagactgcccaaggagatcgaccagctggagaagatccagaacaacagcaagctgctgagaaacaaggccgtgcagctggagaacgagctggagaacttcaccaagcagttcctgcccagcagcaacgaggagagctag

SEQ ID NO: 19873 - DNA, 468 bp, Artificial Sequence
  Description of Artificial Sequence: Synthetic coding sequence
atggccgagcccgtgagccccctgaagcacttcgtgctggccaagaaggccatcaccgccatcttcgaccagctgctggagttcgtgaccgagggcagccacttcgtggaggccacctacaagaaccccgagctggacagaatcgccaccgaggacgacctggtggagatgcagggctacaaggacaagctgagcatcatcggcgaggtgctgagcagaagacacatgaaggtggccttcttcggcagaaccagcagcggcaagagcagcgtgatcaacgccatgctgtgggacaaggtgctgcccagcggcatcggccacatcaccaactgcttcctgagcgtggagggcaccgacggcgacaaggcctacctgatgaccgagggcagcgacgagaagaagagcgtgaagaccgtgaaccagctggcccacgccctgcacatggacaaggacctgaaggccggctag

SEQ ID NO: 19874 - DNA, 2226 bp, Artificial Sequence; identical to SEQ ID NO: 19871
  Description of Artificial Sequence: Synthetic coding sequence

SEQ ID NO: 19875 - DNA, 1344 bp, Artificial Sequence
  Description of Artificial Sequence: Synthetic coding sequence
atggccgagcccgtgagccccctgaagcacttcgtgctggccaagaaggccatcaccgccatcttcgaccagctgctggagttcgtgaccgagggcagccacttcgtggaggccacctacaagaaccccgagctggacagaatcgccaccgaggacgacctggtggagatgcagggctacaaggacaagctgagcatcatcggcgaggtgctgagcagaagacacatgaaggtggccttcttcggcagaaccagcagcggcaagagcagcgtgatcaacgccatgctgtgggacaaggtgctgcccagcggcatcggccacatcaccaactgcttcctgagcgtggagggcaccgacggcgacaaggcctacctgatgaccgagggcagcgacgagaagaagagcgtgaagaccgtgaaccagctggcccacgccctgcacatggacaaggacctgaaggccggctgcctggtgagagtgttctggcccaaggccaagtgcgccctgctgagagacgacctggtgctggtggacagccccggcaccgacgtgaccaccgagctggacagctggatcgacaagttctgcctggacgccgacgtgttcgtgctggtggccaacagcgagagcaccctgatgaacaccgagaagcacttcttccacaaggtgaacgagagactgagcaagcccaacatcttcatcctgaacaacagatgggacgccagcgccagcgagcccgagtacatggaggacgtgagaagacagcacatggagagatgcctgcacttcctggtggaggagctgaaggtggtgaacgccctggaggcccagaacagaatcttcttcgtgagcgccaaggaggtgctgagcgccagaaagcagaaggcccagggcatgcccgagagcggcgtggccctggccgagggcttccacgccagactgcaggagttccagaacttcgagcagatcttcgaggagtgcatcagccagagcgccgtgaagaccaagttcgagcagcacaccatcagagccaagcagatcctggccaccgtgaagaacatcatggacagcgtgaacctggccgccgaggacaagagacactacagcgtggaggagagagaggaccagatcgacagactggacttcatcagaaaccagatgaacctgctgaccctggacgtgaagaagaagatcaaggaggtgaccgaggaggtggccaacaaggtgagctgcgccatgaccgacgagatctgcagactgagcgtgctggtggacgagttctgcagcgagttccaccccaaccccgacgtgctgaagatctacaagagcaagaagaagaagtag

SEQ ID NO: 19876 - DNA, 4011 bp, Artificial Sequence
  Description of Artificial Sequence: Synthetic coding sequence
atgatggagatccagatggacgagggcggcggcgtggtggtgtaccaggacgactactgcagcggcagcgtgatgagcgagagagtgagcggcctggccggcagcatctacagagagttcgagagactgatccactgctacgacgaggaggtggtgaaggagctgatgcccctggtggtgaacgtgctggagaacctggacagcgtgctgagcgagaaccaggagcacgaggtggagctggagctgctgagagaggacaacgagcagctgctgacccagtacgagagagagaaggccctgagaagacaggccgaggagaagttcatcgagttcgaggacgccctggagcaggagaagaaggagctgcagatccaggtggagcactacgagttccagaccagacagctggagctgaaggccaagaactacgccgaccagatcagcagactggaggagagagagagcgagatgaagaaggagtacaacgccctgcaccagagacacaccgagatgatccagacctacgtggagcacatcgagagaagcaagatgcagcaggtgggcggcaacagccagaccgagagcagcctgcccggcagaagaaaggagagacccaccagcctgaacgtgttccccctggccgacggcaccgtgagagcccagatcggcggcaagctggtgcccgccggcgaccactggcacctgagcgacctgggccagctgcagagcagcagcagctaccagtgcccccaggacgagatgagcgagagcggccagagcagcgccgccgccacccccagcaccaccggcaccaagagcaacacccccaccagcagcgtgcccagcgccgccgtgacccccctgaacgagagcctgcagcccctgggcgactacggcgtgggcagcaagaacagcaagagagccagagagaagagagacagcagaaacatggaggtgcaggtgacccaggagatgagaaacgtgagcatcggcatgggcagcagcgacgagtggagcgacgtgcaggacatcatcgacagcacccccgagctggacatgtgccccgagaccagactggacagaaccggcagcagccccacccagggcatcgtgaacaaggccttcggcatcaacaccgacagcctgtaccacgagctgagcaccgccggcagcgaggtgatcggcgacgtggacgagggcgccgacctgctgggcgagttcagcgtgagagacgacttcttcggcatgggcaaggaggtgggcaacctgctgctggagaacagccagctgctggagaccaagaacgccctgaacgtggtgaagaacgacctgatcgccaaggtggaccagctgagcggcgagcaggaggtgctgagaggcgagctggaggccgccaagcaggccaaggtgaagctggagaacagaatcaaggagctggaggaggagctgaagagagtgaagagcgaggccatcatcgccagaagagagcccaaggaggaggccgaggacgtgagcagctacctgtgcaccgagagcgacaagatccccatggcccagagaagaagattcaccagagtggagatggccagagtgctgatggagagaaaccagtacaaggagagactgatggagctgcaggaggccgtgagatggaccgagatgatcagagccagcagagagcaccccagcgtgcaggagaagaagaagagcaccatctggcagttcttcagcagactgttcagcagcagcagcagccccccccccgccaagagaccctaccccagcgtgaacatccactacaagagccccaccaccgccggcttcagccagagaagaaaccacgccatgtgccccatcagcgccggcagcagacccctggagttcttccccgacgacgactgcaccagcagcgccagaagagagcagaagagagagcagtacagacaggtgagagagcacgtgagaaacgacgacggcagactgcaggcctgcggctggagcctgcccgccaagtacaagcagctgagccccaacggcggccaggaggacaccagaatgaagaacgtgcccgtgcccgtgtactgcagacccctggtggagaaggaccccaccatgaagctgtggtgcgccgccggcgtgaacctgagcggctggagacccaacgaggacgacgccggcaacggcgtgaagcccgcccccggcagagaccccctgacctgcgacagagagggcgacggcgagcccaagagcgcccacaccagccccgagaagaagaaggccaaggagctgcccgagatggacgccaccagcagcagagtgtggatcctgaccagcaccctgaccaccagcaaggtggtgatcatcgacgccaaccagcccggcaccgtggtggaccagttcaccgtgtgcaacgcccacgtgctgtgcatcagcagcatccccgccgccagcgacagcgactacccccccggcgagatgttcctggacagcgacgtgaaccccgaggaccccggcgccgacggcgtgctggccggcatcaccctggtgggctgcgccaccagatgcaacgtgcccagaagcaactgcagcagcagaggcgacacccccgtgctggacaagggccagggcgaggtggccaccatcgccaacggcaaggtgaaccccagccagagcaccgaggaggccaccgaggccaccgaggtgcccgaccccggccccagcgagcccgagaccgccaccctgagacccggccccctgaccgagcacgtgttcaccgaccccgcccccacccccagcagcggcccccagcccggcagcgagaacggccccgagcccgacagcagcagcaccagacccgagcccgagcccagcggcgaccccaccggcgccggcagcagcgccgcccccaccatgtggctgggcgcccagaacggctggctgtacgtgcacagcgccgtggccaactggaagaagtgcctgcacagcatcaagctgaaggacagcgtgctgagcctggtgcacgtgaagggcagagtgctggtggccctggccgacggcaccctggccatcttccacagaggcgaggacggccagtgggacctgagcaactaccacctgatggacctgggccacccccaccacagcatcagatgcatggccgtggtgtacgacagagtgtggtgcggctacaagaacaaggtgcacgtgatccagcccaagaccatgcagatcgagaagagcttcgacgcccaccccagaagagagagccaggtgagacagctggcctggatcggcgacggcgtgtgggtgagcatcagactggacagcaccctgagactgtaccacgcccacacccaccagcacctgcaggacgtggacatcgagccctacgtgagcaagatgctgggcaccggcaagctgggcttcagcttcgtgagaatcaccgccctgctggtggccggcagcagactgtgggtgggcaccggcaacggcgtggtgatcagcatccccctgaccgagaccgtggtgctgcacagaggccagctgctgggcctgagagccaacaagaccagccccaccagcggcgagggcgccagacccggcggcatcatccacgtgtacggcgacgacagcagcgacagagccgccagcagcttcatcccctactgcagcatggcccaggcccagctgtgcttccacggccacagagacgccgtgaagttcttcgtgagcgtgcccggcaacgtgctggccaccctgaacggcagcgtgctggacagccccgccgagggccccggccccgccgcccccgccagcgaggtggagggccagaagctgagaaacgtgctggtgctgagcggcggcgagggctacatcgacttcagaatcggcgacggcgaggacgacgagaccgaggagggcgccggcgacatgagccaggtgaagcccgtgctgagcaaggccgagagaagccacatcatcgtgtggcaggtgagctacacccccgagtag

SEQ ID NO: 19877 - DNA, 3993 bp, Artificial Sequence
  Description of Artificial Sequence: Synthetic coding sequence
atgatggagatccagatggacgagggcggcggcgtggtggtgtaccaggacgactactgcagcggcagcgtgatgagcgagagagtgagcggcctggccggcagcatctacagagagttcgagagactgatccactgctacgacgaggaggtggtgaaggagctgatgcccctggtggtgaacgtgctggagaacctggacagcgtgctgagcgagaaccaggagcacgaggtggagctggagctgctgagagaggacaacgagcagctgctgacccagtacgagagagagaaggccctgagaagacaggccgaggagaagttcatcgagttcgaggacgccctggagcaggagaagaaggagctgcagatccaggtggagcactacgagttccagaccagacagctggagctgaaggccaagaactacgccgaccagatcagcagactggaggagagagagagcgagatgaagaaggagtacaacgccctgcaccagagacacaccgagatgatccagacctacgtggagcacatcgagagaagcaagatgcagcaggtgggcggcaacagccagaccgagagcagcctgcccggcagaagaaaggagagacccaccagcctgaacgtgttccccctggccgacggcaccgtgagagcccagatcggcggcaagctggtgcccgccggcgaccactggcacctgagcgacctgggccagctgcagagcagcagcagctaccagtgcccccaggacgagatgagcgagagcggccagagcagcgccgccgccacccccagcaccaccggcaccaagagcaacacccccaccagcagcgtgcccagcgccgccgtgacccccctgaacgagagcctgcagcccctgggcgactacggcgtgggcagcaagaacagcaagagagccagagagaagagagacagcagaaacatggaggtgcaggtgacccaggagatgagaaacgtgagcatcggcatgggcagcagcgacgagtggagcgacgtgcaggacatcatcgacagcacccccgagctggacatgtgccccgagaccagactggacagaaccggcagcagccccacccagggcatcgtgaacaaggccttcggcatcaacaccgacagcctgtaccacgagctgagcaccgccggcagcgaggtgatcggcgacgtggacgagggcgccgacctgctgggcgagttcagcggcatgggcaaggaggtgggcaacctgctgctggagaacagccagctgctggagaccaagaacgccctgaacgtggtgaagaacgacctgatcgccaaggtggaccagctgagcggcgagcaggaggtgctgagaggcgagctggaggccgccaagcaggccaaggtgaagctggagaacagaatcaaggagctggaggaggagctgaagagagtgaagagcgaggccatcatcgccagaagagagcccaaggaggaggccgaggacgtgagcagctacctgtgcaccgagagcgacaagatccccatggcccagagaagaagattcaccagagtggagatggccagagtgctgatggagagaaaccagtacaaggagagactgatggagctgcaggaggccgtgagatggaccgagatgatcagagccagcagagagcaccccagcgtgcaggagaagaagaagagcaccatctggcagttcttcagcagactgttcagcagcagcagcagccccccccccgccaagagaccctaccccagcgtgaacatccactacaagagccccaccaccgccggcttcagccagagaagaaaccacgccatgtgccccatcagcgccggcagcagacccctggagttcttccccgacgacgactgcaccagcagcgccagaagagagcagaagagagagcagtacagacaggtgagagagcacgtgagaaacgacgacggcagactgcaggcctgcggctggagcctgcccgccaagtacaagcagctgagccccaacggcggccaggaggacaccagaatgaagaacgtgcccgtgcccgtgtactgcagacccctggtggagaaggaccccaccatgaagctgtggtgcgccgccggcgtgaacctgagcggctggagacccaacgaggacgacgccggcaacggcgtgaagcccgcccccggcagagaccccctgacctgcgacagagagggcgacggcgagcccaagagcgcccacaccagccccgagaagaagaaggccaaggagctgcccgagatggacgccaccagcagcagagtgtggatcctgaccagcaccctgaccaccagcaaggtggtgatcatcgacgccaaccagcccggcaccgtggtggaccagttcaccgtgtgcaacgcccacgtgctgtgcatcagcagcatccccgccgccagcgacagcgactacccccccggcgagatgttcctggacagcgacgtgaaccccgaggaccccggcgccgacggcgtgctggccggcatcaccctggtgggctgcgccaccagatgcaacgtgcccagaagcaactgcagcagcagaggcgacacccccgtgctggacaagggccagggcgaggtggccaccatcgccaacggcaaggtgaaccccagccagagcaccgaggaggccaccgaggccaccgaggtgcccgaccccggccccagcgagcccgagaccgccaccctgagacccggccccctgaccgagcacgtgttcaccgaccccgcccccacccccagcagcggcccccagcccggcagcgagaacggccccgagcccgacagcagcagcaccagacccgagcccgagcccagcggcgaccccaccggcgccggcagcagcgccgcccccaccatgtggctgggcgcccagaacggctggctgtacgtgcacagcgccgtggccaactggaagaagtgcctgcacagcatcaagctgaaggacagcgtgctgagcctggtgcacgtgaagggcagagtgctggtggccctggccgacggcaccctggccatcttccacagaggcgaggacggccagtgggacctgagcaactaccacctgatggacctgggccacccccaccacagcatcagatgcatggccgtggtgtacgacagagtgtggtgcggctacaagaacaaggtgcacgtgatccagcccaagaccatgcagatcgagaagagcttcgacgcccaccccagaagagagagccaggtgagacagctggcctggatcggcgacggcgtgtgggtgagcatcagactggacagcaccctgagactgtaccacgcccacacccaccagcacctgcaggacgtggacatcgagccctacgtgagcaagatgctgggcaccggcaagctgggcttcagcttcgtgagaatcaccgccctgctggtggccggcagcagactgtgggtgggcaccggcaacggcgtggtgatcagcatccccctgaccgagaccgtggtgctgcacagaggccagctgctgggcctgagagccaacaagaccagccccaccagcggcgagggcgccagacccggcggcatcatccacgtgtacggcgacgacagcagcgacagagccgccagcagcttcatcccctactgcagcatggcccaggcccagctgtgcttccacggccacagagacgccgtgaagttcttcgtgagcgtgcccggcaacgtgctggccaccctgaacggcagcgtgctggacagccccgccgagggccccggccccgccgcccccgccagcgaggtggagggccagaagctgagaaacgtgctggtgctgagcggcggcgagggctacatcgacttcagaatcggcgacggcgaggacgacgagaccgaggagggcgccggcgacatgagccaggtgaagcccgtgctgagcaaggccgagagaagccacatcatcgtgtggcaggtgagctacacccccgagtag

SEQ ID NO: 19878 - DNA, 1569 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacggcgagacccagggctacgtgtacgcccagagcgtggacatcaccagcagctgggacttcggcatcagaagaagaagcaacaccgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtacagcaagttcgacggcaagggccacgtgggcaccaccgccaccaagaagatcgacgtgtacctgcccctgcacagcagccaggacagactgctgcccatgaccgtggtgaccatggccagcgccagagtgcaggacctgatcggcctgatctgctggcagtacaccagcgagggcagagagcccaagctgaacgacaacgtgagcgcctactgcctgcacatcgccgaggacgacggcgaggtggacaccgacttcccccccctggacagcaacgagcccatccacaagttcggcttcagcaccctggccctggtggagaagtacagcagccccggcctgaccagcaaggagagcctgttcgtgagaatcaacgccgcccacggcttcagcctgatccaggtggacaacaccaaggtgaccatgaaggagatcctgctgaaggccgtgaagagaagaaagggcagccagaaggtgagcggcccccagtacagactggagaagcagagcgagcccaacgtggccgtggacctggacagcaccctggagagccagagcgcctgggagttctgcctggtgagagagaacagcagcagagccgacggcgtgttcgaggaggacagccagatcgacatcgccaccgtgcaggacatgctgagcagccaccactacaagagcttcaaggtgagcatgatccacagactgagattcaccaccgacgtgcagctgggcatcagcggcgacaaggtggagatcgaccccgtgaccaaccagaaggccagcaccaagttctggatcaagcagaagcccatcagcatcgacagcgacctgctgtgcgcctgcgacctggccgaggagaagagccccagccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19879 - DNA, 1461 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacggcgagacccagggctacgtgtacgcccagagcgtggacatcaccagcagctgggacttcggcatcagaagaagaagcaacaccgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtacagcaagttcgacggcaagggccacgtgggcaccaccgccaccaagaagatcgacgtgtacctgcccctgcacagcagccaggacagactgctgcccatgaccgtggtgaccatggccagcgccagagtgcaggacctgatcggcctgatctgctggcagtacaccagcgagggcagagagcccaagctgaacgacaacgtgagcgcctactgcctgcacatcgccgaggacgacggcgaggtggacaccgacttcccccccctggacagcaacgagcccatccacaagttcggcttcagcaccctggccctggtggagaagtacagcagccccggcctgaccagcaaggagagcctgttcgtgagaatcaacgccgcccacggcttcagcctgatccaggtggacaacaccaaggtgaccatgaaggagatcctgctgaaggccgtgaagagaagaaagggcagccagaaggtgagcggcagcagagccgacggcgtgttcgaggaggacagccagatcgacatcgccaccgtgcaggacatgctgagcagccaccactacaagagcttcaaggtgagcatgatccacagactgagattcaccaccgacgtgcagctgggcatcagcggcgacaaggtggagatcgaccccgtgaccaaccagaaggccagcaccaagttctggatcaagcagaagcccatcagcatcgacagcgacctgctgtgcgcctgcgacctggccgaggagaagagccccagccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19880 - DNA, 399 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtactag

SEQ ID NO: 19881 - DNA, 708 bp, Artificial Sequence
  Description of Artificial Sequence: Synthetic coding sequence
atgaccgtggtgaccatggccagcgccagagtgcaggacctgatcggcctgatctgctggcagtacaccagcgagggcagagagcccaagctgaagaacgccgcccacggcttcagcctgatccaggtggacaacaccaaggtgaccatgaaggagatcctgctgaaggccgtgaagagaagaaagggcagccagaaggtgagcggcagcagagccgacggcgtgttcgaggaggacagccagatcgacatcgccaccgtgcaggacatgctgagcagccaccactacaagagcttcaaggtgagcatgatccacagactgagattcaccaccgacgtgcagctgggcatcagcggcgacaaggtggagatcgaccccgtgaccaaccagaaggccagcaccaagttctggatcaagcagaagcccatcagcatcgacagcgacctgctgtgcgcctgcgacctggccgaggagaagagccccagccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19882 - DNA, 1569 bp, Artificial Sequence; identical to SEQ ID NO: 19878
  Description of Artificial Sequence: Synthetic coding sequence

SEQ ID NO: 19883 - DNA, 993 bp, Artificial Sequence
  Description of Artificial Sequence: Synthetic coding sequence
atgaccgtggtgaccatggccagcgccagagtgcaggacctgatcggcctgatctgctggcagtacaccagcgagggcagagagcccaagctgaacgacaacgtgagcgcctactgcctgcacatcgccgaggacgacggcgaggtggacaccgacttcccccccctggacagcaacgagcccatccacaagttcggcttcagcaccctggccctggtggagaagtacagcagccccggcctgaccagcaaggagagcctgttcgtgagaatcaacgccgcccacggcttcagcctgatccaggtggacaacaccaaggtgaccatgaaggagatcctgctgaaggccgtgaagagaagaaagggcagccagaaggtgagcggcccccagtacagactggagaagcagagcgagcccaacgtggccgtggacctggacagcaccctggagagccagagcgcctgggagttctgcctggtgagagagaacagcagcagagccgacggcgtgttcgaggaggacagccagatcgacatcgccaccgtgcaggacatgctgagcagccaccactacaagagcttcaaggtgagcatgatccacagactgagattcaccaccgacgtgcagctgggcatcagcggcgacaaggtggagatcgaccccgtgaccaaccagaaggccagcaccaagttctggatcaagcagaagcccatcagcatcgacagcgacctgctgtgcgcctgcgacctggccgaggagaagagccccagccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19884 - DNA, 678 bp, Artificial Sequence
  Description of Artificial Sequence: Synthetic coding sequence
atgcccggcgacagcggcagcgagatccagggcagcaacggcgagacccagggctacgtgtacgcccagagcgtggacatcaccagcagctgggacttcggcatcagaagaagaagcaacaccgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtacagcaagttcgacggcaagcactgcagcagcctgtgcagaatcatcatgaacaagtgcttcctgcagagcctggccctgaacagcagcctgcagagaaagagcctgaagaccctgcagaagagcatgaagccccccagaaacgtggccaacagcgagaagggccacgtgggcaccaccgccaccaagaagatcgacgtgtacctgcccctgcacagcagccaggacagactgctgcccatgaccgtggtgaccatggccagcgccagagtgcaggacctgatcggcctgatctgctggcagtacaccagcgagggcagagagcccaagctgtag

SEQ ID NO: 19885 - DNA, 1428 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacggcgagacccagggctacgtgtacgcccagagcgtggacatcaccagcagctgggacttcggcatcagaagaagaagcaacaccgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtacagcaagttcgacggcaagggccacgtgggcaccaccgccaccaagaagatcgacgtgtacctgcccctgcacagcagccaggacagactgctgcccatgaccgtggtgaccatggccagcgccagagtgcaggacctgatcggcctgatctgctggcagtacaccagcgagggcagagagcccaagctgaacgacaacgtgagcgcctactgcctgcacatcgccgaggacgacggcgaggtggacaccgacttcccccccctggacagcaacgagcccatccacaagttcggcttcagcaccctggccctggtggagaagtacagcagccccggcctgaccagcaaggagagcctgttcgtgagaatcaacgccgcccacggcttcagcctgatccaggtggacaacaccaaggtgaccatgaaggagatcctgctgaaggccgtgaagagaagaaagggcagccagaaggtgagcggcccccagtacagactggagaagcagagcgagcccaacgtggccgtggacctggacagcaccctggagagccagagcgcctgggagttctgcctggtgagagagaacagcatcagcggcgacaaggtggagatcgaccccgtgaccaaccagaaggccagcaccaagttctggatcaagcagaagcccatcagcatcgacagcgacctgctgtgcgcctgcgacctggccgaggagaagagccccagccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19886 - DNA, 993 bp, Artificial Sequence; identical to SEQ ID NO: 19883
  Description of Artificial Sequence: Synthetic coding sequence

SEQ ID NO: 19887 - DNA, 282 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacggcgagacccagggctacgtgtacgcccagagcgtggacatcaccagcagctgggacttcggcatcagaagaagaagcaacaccgcccagagactggagagactgtag

SEQ ID NO: 19888 - DNA, 285 bp, Artificial Sequence
  Description of Artificial Sequence: Synthetic coding sequence
tgaaagagcttcaaggtgagcatgatccacagactgagattcaccaccgacgtgcagctgggccacgccatcttcaagctgacctacctgagcaaccacgactacaagcacctgtacttcgagagcgacgccgccaccgtgaacgagatcgtgctgaaggtgaactacatcctggagagcagagccagcaccgccagagccgactacttcgcccagaagcagagaaagctgaacagaagaaccagcttcagcttccagaaggagaagaagagcggccagcagtag

SEQ ID NO: 19889 - DNA, 972 bp, Artificial Sequence
  Description of Artificial Sequence: Synthetic coding sequence
atggccttcctggacaaccccaccatcatcctggcccacatcagacagagccacgtgaccagcgacgacaccggcatgtgcgagatggtgctgatcgaccacgacgtggacctggagaagatccacccccccagcatgcccggcgacagcggcagcgagatccagggcagcaacggcgagacccagggctacgtgtacgcccagagcgtggacatcaccagcagctgggacttcggcatcagaagaagaagcaacaccgcccagagactggagagactgagaaaggagagacagaaccagatcaagtgcaagaacatccagtggaaggagagaaacagcaagcagagcgcccaggagctgaagagcctgttcgagaagaagagcctgaaggagaagccccccatcagcggcaagcagagcatcctgagcgtgagactggagcagtgccccctgcagctgaacaaccccttcaacgagtacagcaagttcgacggcaagggccacgtgggcaccaccgccaccaagaagatcgacgtgtacctgcccctgcacagcagccaggacagactgctgcccatgaccgtggtgaccatggccagcgccagagtgcaggacctgatcggcctgatctgctggcagtacaccagcgagggcagagagcccaagctgaacgacaacgtgagcgcctactgcctgcacatcgccgaggacgacggcgaggtggacaccgacttcccccccctggacagcaacgagcccatccacaagttcggcttcagcaccctggccctggtggagaagtacagcagccccggcctgaccagcaaggagagcctgttcgtgagaatcaacgccgcccacggcttcagcctgatccaggtggacaacaccaaggtgaccatgaaggagatcctgctgaaggccgtgaagagaagaaagggcagccagaaggtgagcggcgcctgcgactag

SEQ ID NO: 19890 - DNA, 1008 bp, Artificial Sequence
  Description of Artificial Sequence: Synthetic coding sequence
atgaaggtggagttcgcccccctgaacatccagctggccagaagactgcagaccgtggccgtgctgcagtgggtgctgaagtacctgctgctgggccccatgagcatcggcatcaccgtgatgctgatcatccacaactacctgttcctgtacatcccctacctgatgtggctgtacttcgactggcacacccccgagagaggcggcagaagaagcagctggatcaagaactggaccctgtggaagcacttcaaggactacttccccatccacctgatcaagacccaggacctggaccccagccacaactacatcttcggcttccacccccacggcatcatggccgtgggcgccttcggcaacttcagcgtgaactacagcgacttcaaggacctgttccccggcttcaccagctacctgcacgtgctgcccctgtggttctggtgccccgtgttcagagagtacgtgatgagcgtgggcctggtgagcgtgagcaagaagagcgtgagctacatggtgagcaaggagggcggcggcaacatcagcgtgatcgtgctgggcggcgccaaggagagcctggacgcccaccccggcaagttcaccctgttcatcagacagagaaagggcttcgtgaagatcgccctgacccacggcgccagcctggtgcccgtggtgagcttcggcgagaacgagctgttcaagcagaccgacaaccccgagggcagctggatcagaaccgtgcagaacaagctgcagaagatcatgggcttcgccctgcccctgttccacgccagaggcgtgttccagtacaacttcggcctgatgacctacagaaaggccatccacaccgtggtgggcagacccatccccgtgagacagaccctgaaccccacccaggagcagatcgaggagctgcaccagacctacatggaggagctgagaaagctgttcgaggagcacaagggcaagtacggcatccccgagcacgagaccctggtgctgaagtag

SEQ ID NO: 19891 - DNA, 1005 bp, Artificial Sequence
  Description of Artificial Sequence: Synthetic coding sequence
atggtggagttcgcccccctgttcatgccctgggagagaagactgcagaccctggccgtgctgcagttcgtgttcagcttcctggccctggccgagatctgcaccgtgggcttcatcgccctgctgttcaccagattctggctgctgaccgtgctgtacgccgcctggtggtacctggacagagacaagcccagacagggcggcagacacatccaggccatcagatgctggaccatctggaagtacatgaaggactacttccccatcagcctggtgaagaccgccgagctggaccccagcagaaactacatcgccggcttccacccccacggcgtgctggccgtgggcgccttcgccaacctgtgcaccgagagcaccggcttcagcagcatcttccccggcatcagaccccacctgatgatgctgaccctgtggttcagagcccccttcttcagagactacatcatgagcgccggcctggtgaccagcgagaaggagagcgccgcccacatcctgaacagaaagggcggcggcaacctgctgggcatcatcgtgggcggcgcccaggaggccctggacgccagacccggcagcttcaccctgctgctgagaaacagaaagggcttcgtgagactggccctgacccacggcgcccccctggtgcccatcttcagcttcggcgagaacgacctgttcgaccagatccccaacagcagcggcagctggctgagatacatccagaacagactgcagaagatcatgggcatcagcctgcccctgttccacggcagaggcgtgttccagtacagcttcggcctgatcccctacagaagacccatcaccaccgtggtgggcaagcccatcgaggtgcagaagaccctgcaccccagcgaggaggaggtgaaccagctgcaccagagatacatcaaggagctgtgcaacctgttcgaggcccacaagctgaagttcaacatccccgccgaccagcacctggagttctgctag

SEQ ID NO: 19892 - DNA, 759 bp, Artificial Sequence
  Description of Artificial Sequence: Synthetic coding sequence
atgaaggactacttccccatcagcctggtgaagaccgccgagctggaccccagcagaaactacatcgccggcttccacccccacggcgtgctggccgtgggcgccttcgccaacctgtgcaccgagagcaccggcttcagcagcatcttccccggcatcagaccccacctgatgatgctgaccctgtggttcagagcccccttcttcagagactacatcatgagcgccggcctggtgaccagcgagaaggagagcgccgcccacatcctgaacagaaagggcggcggcaacctgctgggcatcatcgtgggcggcgcccaggaggccctggacgccagacccggcagcttcaccctgctgctgagaaacagaaagggcttcgtgagactggccctgacccacggcgcccccctggtgcccatcttcagcttcggcgagaacgacctgttcgaccagatccccaacagcagcggcagctggctgagatacatccagaacagactgcagaagatcatgggcatcagcctgcccctgttccacggcagaggcgtgttccagtacagcttcggcctgatcccctacagaagacccatcaccaccgtggtgggcaagcccatcgaggtgcagaagaccctgcaccccagcgaggaggaggtgaaccagctgcaccagagatacatcaaggagctgtgcaacctgttcgaggcccacaagctgaagttcaacatccccgccgaccagcacctggagttctgctag

SEQ ID NO: 19893 - DNA, 1209 bp, Artificial Sequence
  Description of Artificial Sequence: Synthetic coding sequence
atgcagatgagccccgccctgacctgcctggtgctgggcctggccctggtgttcggcgagggcagcgccgtgcaccacccccccagctacgtggcccacctggccagcgacttcggcgtgagagtgttccagcaggtggcccaggccagcaaggacagaaacgtggtgttcagcccctacggcgtggccagcgtgctggccatgctgcagctgaccaccggcggcgagacccagcagcagatccaggccgccatgggcttcaagatcgacgacaagggcatggcccccgccctgagacacctgtacaaggagctgatgggcccctggaacaaggacgagatcagcaccaccgacgccatcttcgtgcagagagacctgaagctggtgcagggcttcatgccccacttcttcagactgttcagaagcaccgtgaagcaggtggacttcagcgaggtggagagagccagattcatcatcaacgactgggtgaagacccacaccaagggcatgatcagcaacctgctgggcaagggcgccgtggaccagctgaccagactggtgctggtgaacgccctgtacttcaacggccagtggaagacccccttccccgacagcagcacccacagaagactgttccacaagagcgacggcagcaccgtgagcgtgcccatgatggcccagaccaacaagttcaactacaccgagttcaccacccccgacggccactactacgacatcctggagctgccctaccacggcgacaccctgagcatgttcatcgccgccccctacgagaaggaggtgcccctgagcgccctgaccaacatcctgagcgcccagctgatcagccactggaagggcaacatgaccagactgcccagactgctggtgctgcccaagttcagcctggagaccgaggtggacctgagaaagcccctggagaacctgggcatgaccgacatgttcagacagttccaggccgacttcaccagcctgagcgaccaggagcccctgcacgtggcccaggccctgcagaaggtgaagatcgaggtgaacgagagcggcaccgtggccagcagcagcaccgccgtgatcgtgagcgccagaatggcccccgaggagatcatcatggacagacccttcctgttcgtggtgagacacaaccccaccggcaccgtgctgttcatgggccaggtgatggagccctag

SEQ ID NO: 19894 - DNA, 846 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtacgtgctgaccttcctgttcatgggccccttcttcagcctgctggtgttcgtgctgctgttcaccagcctgtggcccttcagcgtgttctacctggtgtggctgtacgtggactgggacacccccaaccagggcggcagaagaagcgagtggatcagaaacagagccatctggagacagctgagagactactaccccgtgaagctggtgaagaccgccgagctgccccccgacagaaactacgtgctgggcgcccacccccacggcatcatgtgcaccggcttcctgtgcaacttcagcaccgagagcaacggcttcagccagctgttccccggcctgagaccctggctggccgtgctggccggcctgttctacctgcccgtgtacagagactacatcatgagcttcggcctgtgccccgtgagcagacagagcctggacttcatcctgagccagccccagctgggccaggccgtggtgatcatggtgggcggcgcccacgaggccctgtacagcgtgcccggcgagcactgcctgaccctgcagaagagaaagggcttcgtgagactggccctgagacacggcggccccccccaccccagaccccccgccccccccccccacagaggcggcagccagagcctgagcagacccctgcacgacggccccggcgccgccctgagaggcgcccagggcaagctgtggggccccagattccacctgccccacctgcacctgggcctggccgccgccttcagatag

SEQ ID NO: 19895 - DNA, 1035 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtacgtgctgaccttcctgttcatgggccccttcttcagcctgctggtgttcgtgctgctgttcaccagcctgtggcccttcagcgtgttctacctggtgtggctgtacgtggactgggacacccccaaccagggcggcagaagaagcgagtggatcagaaacagagccatctggagacagctgagagactactaccccgtgaagctggtgaagaccgccgagctgccccccgacagaaactacgtgctgggcgcccacccccacggcatcatgtgcaccggcttcctgtgcaacttcagcaccgagagcaacggcttcagccagctgttccccggcctgagaccctggctggccgtgctggccggcctgttctacctgcccgtgtacagagactacatcatgagcttcggcctgtgccccgtgagcagacagagcctggacttcatcctgagccagccccagctgggccaggccgtggtgatcatggtgggcggcgcccacgaggccctgtacagcgtgcccggcgagcactgcctgaccctgcagaagagaaagggcttcgtgagactggccctgagacacggcgccagcctggtgcccgtgtacagcttcggcgagaacgacatcttcagactgaaggccttcgccaccggcagctggcagcactggtgccagctgaccttcaagaagctgatgggcttcagcccctgcatcttctggggcagaggcctgttcagcgccaccagctggggcctgctgcccttcgccgtgcccatcaccaccgtgggcgagtgccccccccccggcggcagaccccccgccgccgcctgggccagcggcatccccagaccccccgtgagcctgagcctgcagtgggccgcccccagccccagccccagcgccagcaccccccccagaagaaagagcatcaccatcacccccagcacctag

SEQ ID NO: 19896 - DNA, 645 bp, Artificial Sequence
  Description of Artificial Sequence: Synthetic coding sequence
atgcaccagcagaagagacagcccgagctggtggagggcaacctgcccgtgttcgtgttccccaccgagctgatcttctacgccgacgaccagagcacccacaagcaggtgctgaccctgtacaacccctacgagttcgccctgaagttcaaggtgctgtgcaccacccccaacaagtacgtggtggtggacgccgccggcgccgtgaagccccagtgctgcgtggacatcgtgatcagacacagagacgtgagaagctgccactacggcgtgatcgacaagttcagactgcaggtgagcgagcagagccagagaaaggccctgggcagaaaggaggtggtggccaccctgctgcccagcgccaaggagcagcagaaggaggaggaggagaagagactgaaggagcacctgaccgagagcctgttcttcgagcagagcttccagcccggcaagaacagagccgtgagcagcggccccagcctgctgaccgtgttcctgggcgtggtgtgcatcgccgccctgatgctgcccaccctgggcgacgtggagagcctggtgcccctgtacctgcacctgagcgtgaaccagaagctggtggccgcctacatcctgggcctgatcaccatggccatcctgagaacctag

SEQ ID NO: 19897 - DNA, 480 bp, Artificial Sequence
  Description of Artificial Sequence: Synthetic coding sequence
atgcaccagcagaagagacagcccgagctggtggagggcaacctgcccgtgttcgtgttccccaccgagctgatcttctacgccgacgaccagagcacccacaagcaggtgctgaccctgtacaacccctacgagttcgccctgaagttcaaggtgctgtgcaccacccccaacaagtacgtggtggtggacgccgccggcgccgtgaagccccagtgctgcgtggacatcgtgatcagacacagagacgtgagaagctgccactacggcgtgatcgacaagttcagactgcaggtgagcgagcagagccagagaaaggccctgggcagaaaggaggtggtggccaccctgctgcccagcgccaaggagcagcagaaggaggaggaggagaagagactgaaggagcacctgaccgagagcctgttcttcgagcagagcttccagcccggcctgatcaccatggccatcctgagaacctag

SEQ ID NO: 19898 - DNA, 642 bp, Artificial Sequence
  Description of Artificial Sequence: Synthetic coding sequence
atgcaccagcagaagagacagcccgagctggtggagggcaacctgcccgtgttcgtgttccccaccgagctgatcttctacgccgacgaccagagcacccacaagcaggtgctgaccctgtacaacccctacgagttcgccctgaagttcaaggtgctgtgcaccacccccaacaagtacgtggtggtggacgccgccggcgccgtgaagccccagtgctgcgtggacatcgtgatcagacacagagacgtgagaagctgccactacggcgtgatcgacaagttcagactgcaggtgagcgagcagagccagagaaaggccctgggcagaaaggaggtggtggccaccctgctgcccagcgccaaggagcagcagaaggaggaggaggagaagagactgaaggagcacctgaccgagagcctgttcttcgagcagagcttccagcccgagaacagagccgtgagcagcggccccagcctgctgaccgtgttcctgggcgtggtgtgcatcgccgccctgatgctgcccaccctgggcgacgtggagagcctggtgcccctgtacctgcacctgagcgtgaaccagaagctggtggccgcctacatcctgggcctgatcaccatggccatcctgagaacctag

SEQ ID NO: 19899 - DNA, 1557 bp, Artificial Sequence
  Description of Artificial Sequence: Synthetic coding sequence
atggccgagaaccacgcccagaacaaggccaagctgatcagcgagaccagaagaagattcgaggccgagtacgtgaccgacaagagcgacaagtacgacgccagagacgtggagagactgcagcaggacgacaactgggtggagagctacctgagctggagacacaacatcgtggacgagaccctgaagatgctggacgagagcttccagtggagaaaggagatcagcgtgaacgacctgaacgagagcagcatccccagatggctgctggagatcggcgtgatctacctgcacggctacgacaaggagggcaacaagctgttctggatcagagtgaagtaccacgtgaaggaccagaagaccatcctggacaagaagaagctgatcgccttctggctggagagatacgccaagagagagaacggcaagcccgtgaccgtgatgttcgacctgagcgagaccggcatcaacagcatcgacatggacttcgtgagattcatcatcaactgcttcaaggtgtactaccccaagtacctgagcaagatcgtgatcttcgacatgccctggctgatgaacgccgccttcaagatcgtgaagacctggctgggccccgaggccgtgagcctgctgaagttcaccagcaagaacgaggtgcaggactacgtgagcgtggagtacctgcccccccacatgggcggcaccgaccccttcaagtacagctacccccccctggtggacgacgacttccagacccccctgtgcgagaacggccccatcaccagcgaggacgagaccagcagcaaggaggacatcgagagcgacggcaaggagaccctggagaccatcagcaacgaggagcagacccccctgctgaagaagatcaaccccaccgagagcaccagcaaggccgaggagaacgagaaggtggacagcaaggtgaaggccttcaagaagcccctgagcgtgttcaagggccccctgctgcacatcagccccgccgaggagctgtacttcggcagcaccgagagcggcgagaagaagaccctgatcgtgctgaccaacgtgaccaagaacatcgtggccttcaaggtgagaaccaccgcccccgagaagtacagagtgaagcccagcaacagcagctgcgaccccggcgccagcgtggacatcgtggtgagcccccacggcggcctgaccgtgagcgcccaggacagattcctgatcatggccgccgagatggagcagagcagcggcaccggccccgccgagctgacccagttctggaaggaggtgcccagaaacaaggtgatggagcacagactgagatgccacaccgtggagagcagcaagcccaacaccctgaccctgaaggacaacgccttcaacatgagcgacaagaccagcgaggacatctgcctgcagctgagcagactgctggagagcaacagaaagctggaggaccaggtgcagagatgcatctggttccagcagctgctgctgagcctgaccatgctgctgctggccttcgtgaccagcttcttctacctgctgtacagctag

SEQ ID NO: 19900 - DNA, 2406 bp, Artificial Sequence
  Description of Artificial Sequence: Synthetic coding sequence
atggagagactgtggggcctgttccagagagcccagcagctgagccccagaagcagccagaccgtgtaccagagagtggagggccccagaaagggccacctggaggaggaggaggaggacggcgaggagggcgccgagaccctggcccacttctgccccatggagctgagaggccccgagcccctgggcagcagacccagacagcccaacctgatcccctgggccgccgccggcagaagagccgccccctacctggtgctgaccgccctgctgatcttcaccggcgccttcctgctgggctacgtggccttcagaggcagctgccaggcctgcggcgacagcgtgctggtggtgagcgaggacgtgaactacgagcccgacctggacttccaccagggcagactgtactggagcgacctgcaggccatgttcctgcagttcctgggcgagggcagactggaggacaccatcagacagaccagcctgagagagagagtggccggcagcgccggcatggccgccctgacccaggacatcagagccgccctgagcagacagaagctggaccacgtgtggaccgacacccactacgtgggcctgcagttccccgaccccgcccaccccaacaccctgcactgggtggacgaggccggcaaggtgggcgagcagctgcccctggaggaccccgacgtgtactgcccctacagcgccatcggcaacgtgaccggcgagctggtgtacgcccactacggcagacccgaggacctgcaggacctgagagccagaggcgtggaccccgtgggcagactgctgctggtgagagtgggcgtgatcagcttcgcccagaaggtgaccaacgcccaggacttcggcgcccagggcgtgctgatctaccccgagcccgccgacttcagccaggacccccccaagcccagcctgagcagccagcaggccgtgtacggccacgtgcacctgggcaccggcgacccctacacccccggcttccccagcttcaaccagacccagttcccccccgtggccagcagcggcctgcccagcatccccgcccagcccatcagcgccgacatcgccagcagactgctgagaaagctgaagggccccgtggccccccaggagtggcagggcagcctgctgggcagcccctaccacctgggccccggccccagactgagactggtggtgaacaaccacagaaccagcacccccatcaacaacatcttcggctgcatcgagggcagaagcgagcccgaccactacgtggtgatcggcgcccagagagacgcctggggccccggcgccgccaagagcgccgtgggcaccgccatcctgctggagctggtgagaaccttcagcagcatggtgagcaacggcttcagacccagaagaagcctgctgttcatcagctgggacggcggcgacttcggcagcgtgggcagcaccgagtggctggagggctacctgagcgtgctgcacctgaaggccgtggtgtacgtgagcctggacaacgccgtgctgggcgacgacaagttccacgccaagaccagccccctgctgaccagcctgatcgagagcgtgctgaagcaggtggacagccccaaccacagcggccagaccctgtacgagcaggtggtgttcaccaaccccagctgggacgccgaggtgatcagacccctgcccatggacagcagcgcctacagcttcaccgccttcgtgggcgtgcccgccgtggagttcagcttcatggaggacgaccaggcctaccccttcctgcacaccaaggaggacacctacgagaacctgcacaaggtgctgcagggcagactgcccgccgtggcccaggccgtggcccagctggccggccagctgctgatcagactgagccacgacagactgctgcccctggacttcggcagatacggcgacgtggtgctgagacacatcggcaacctgaacgagttcagcggcgacctgaaggccagaggcctgaccctgcagtgggtgtacagcgccagaggcgactacatcagagccgccgagaagctgagacaggagatctacagcagcgaggagagagacgagagactgaccagaatgtacaacgtgagaatcatgagagtggagttctacttcctgagccagtacgtgagccccgccgacagccccttcagacacatcttcatgggcagaggcgaccacaccctgggcgccctgctggaccacctgagactgctgagaagcaacagcagcggcacccccggcgccaccagcagcaccggcttccaggagagcagattcagaagacagctggccctgctgacctggaccctgcagggcgccgccaacgccctgagcggcgacgtgtggaacatcgacaacaacttctag

SEQ ID NO: 19901 - DNA, 708 bp, Artificial Sequence
  Description of Artificial Sequence: Synthetic coding sequence
atgagaagaggcgccccccaggaccaggagctggtgggccccggcccccccggcagaggcagcagaggcgcccccccccccctgggccccgtggtgcccgtgctggtgttcccccccgacctggtgttcagagccgaccagagaagcggccccagacagctgctgaccctgtacaaccccaccggcaccgccctgagattcagagtgctgtgcaccgcccccgccaagtacaccgtgttcgacgccgagggctacgtgaagccccagagctgcatcgacatcgtgatcagacacgtggcccccatccccagccactacgacgtgcaggacagattcagaatcgagctgagcgaggagggcgccgagggcagagtggtgggcagaaaggacatcaccagcatcctgagagcccccgcctaccccctggagctgcagggccagcccgaccccgcccccagacccggcccccccgccggcacccccccccccaccgccagacacttccaggagcaccccagacagcagctggccaccagcagcttcctgctgttcctgctgaccggcatcgtgagcgtggccttcctgctgctgcccctgcccgacgagctgggcagccagctgccccaggtgctgcacgtgagcctgggccagaagctggtggccgcctacgtgctgggcctgctgaccatggtgttcctgagaacctag

SEQ ID NO: 19902 - DNA, 708 bp, Artificial Sequence; identical to SEQ ID NO: 19901
  Description of Artificial Sequence: Synthetic coding sequence

SEQ ID NO: 19903 - DNA, 666 bp, Artificial Sequence
  Description of Artificial Sequence: Synthetic coding sequence
atgagcgacagacccgagcccgcctgcgcccccccccccctgggccccgtggtgcccgtgctggtgttcccccccgacctggtgttcagagccgaccagagaagcggccccagacagctgctgaccctgtacaaccccaccggcaccgccctgagattcagagtgctgtgcaccgcccccgccaagtacaccgtgttcgacgccgagggctacgtgaagccccagagctgcatcgacatcgtgatcagacacgtggcccccatccccagccactacgacgtgcaggacagattcagaatcgagctgagcgaggagggcgccgagggcagagtggtgggcagaaaggacatcaccagcatcctgagagcccccgcctaccccctggagctgcagggccagcccgaccccgcccccagacccggcccccccgccggcacccccccccccaccgccagacacttccaggagcaccccagacagcagctggccaccagcagcttcctgctgttcctgctgaccggcatcgtgagcgtggccttcctgctgctgcccctgcccgacgagctgggcagccagctgccccaggtgctgcacgtgagcctgggccagaagctggtggccgcctacgtgctgggcctgctgaccatggtgttcctgagaacctag

SEQ ID NO: 19904 - DNA, 678 bp, Artificial Sequence
  Description of Artificial Sequence: Synthetic coding sequence
atgagaagaggcgccccccaggaccaggagctggtgggccccggcccccccggcagaggcagcagaggcgcccccccccccctgggccccgtggtgcccgtgctggtgttcccccccgacctggtgttcagagccgaccagagaagcggccccagacagctgctgaccctgtacaaccccaccggcaccgccctgagattcagagtgctgtgcaccgcccccgccaagtacaccgtgttcgacgccgagggctacgtgaagccccagagctgcatcgacatccactacgacgtgcaggacagattcagaatcgagctgagcgaggagggcgccgagggcagagtggtgggcagaaaggacatcaccagcatcctgagagcccccgcctaccccctggagctgcagggccagcccgaccccgcccccagacccggcccccccgccggcacccccccccccaccgccagacacttccaggagcaccccagacagcagctggccaccagcagcttcctgctgttcctgctgaccggcatcgtgagcgtggccttcctgctgctgcccctgcccgacgagctgggcagccagctgccccaggtgctgcacgtgagcctgggccagaagctggtggccgcctacgtgctgggcctgctgaccatggtgttcctgagaacctag

SEQ ID NO: 19905 - DNA, 444 bp, Artificial Sequence
  Description of Artificial Sequence: Synthetic coding sequence
atggccggctggtggcccgccctgagcagagccgccagaagacacccctggcccaccaacgtgctgctgtacggcagcctggtgagcgccggcgacgccctgcagcagagactgcagggcagagaggccaactggagacagaccagaagagtggccaccctggtggtgaccttccacgccaacttcaactacgtgtggctgagactgctggagagagccctgcccggcagagccccccacgccctgctggccaagctgctgtgcgaccaggtggtgggcgcccccatcgccgtgagcgccttctacgtggagtggaccgacgtgctggccctgtgcaccgccgaccagctgcagccctgcagctgcagcatggagaacagcctgagatggagcctgtggttcagcctgggccacctgcacctgttcttccccgccgagtggtag

SEQ ID NO: 19906 - DNA, 591 bp, Artificial Sequence
  Description of Artificial Sequence: Synthetic coding sequence
atggccggctggtggcccgccctgagcagagccgccagaagacacccctggcccaccaacgtgctgctgtacggcagcctggtgagcgccggcgacgccctgcagcagagactgcagggcagagaggccaactggagacagaccagaagagtggccaccctggtggtgaccttccacgccaacttcaactacgtgtggctgagactgctggagagagccctgcccggcagagccccccacgccctgctggccaagctgctgtgcgaccaggtggtgggcgcccccatcgccgtgagcgccttctacgtgggcatgagcatcctgcagggcaaggacgacatcttcctggacctgaagcagaagttctggaacacctacctgagcggcctgatgtactggcccttcgtgcagctgaccaacttcagcctggtgcccgtgcagtggagaaccgcctacgccggcgtgtgcggcttcctgtgggccaccttcatctgcttcagccagcagagcggcgacggcaccttcaagagcgccttcaccatcctgtacaccaagggcaccagcgccaccgagggctaccccaagaagtag

SEQ ID NO: 19907 - DNA, 621 bp, Artificial Sequence
  Description of Artificial Sequence: Synthetic coding sequence
atggccagaggcggctggagaagactgagaagactgctgagcgccggccagctgctgttccagggcagagccctgctggtgaccaacaccctgggctgcggcgccctgatggccgccggcgacggcgtgagacagagctgggagatcagagccagacccggccaggtgttcgaccccagaagaagcgccagcatgttcgccgtgggctgcagcatgggccccttcctgcactactggtacctgagcctggacagactgttccccgccagcggcctgagaggcttccccaacgtgctgaagaaggtgctggtggaccagctggtggccagccccctgctgggcgtgtggtacttcctgggcctgggctgcctggagggccagaccgtgggcgagagctgccaggagctgagagagaagttctgggagttctacaaggccgactggtgcgtgtggcccgccgcccagttcgtgaacttcctgttcgtgcccccccagttcagagtgacctacatcaacggcctgaccctgggctgggacacctacctgagctacctgaagtacagaagccccgtgcccctgaccccccccggctgcgtggccctggacaccagagccgactag

SEQ ID NO: 19908 - DNA, 354 bp, Artificial Sequence
  Description of Artificial Sequence: Synthetic coding sequence
atggagtgcctgagaagcctgccctgcctgctgcccagagccatgagactgcccagaagaaccctgtgcgccctggccctggacgtgaccagcgtgggcccccccgtggccgcctgcggcagaagagccaacctgatcggcagaagcagagccgcccagctgtgcggccccgacagactgagagtggccggcgaggtgcacagattcagaaccagcgacgtgagccaggccaccctggccagcgtggcccccgtgttcaccgtgaccaagttcgacaagcagggcaacgtgaccagcttcgtgttcgagagctgcgacaacagcagagtgagcagcgacatcagactgagctag

SEQ ID NO: 19909 - DNA, 1227 bp, Artificial Sequence
  Description of Artificial Sequence: Synthetic coding sequence
atggagtgcctgagaagcctgccctgcctgctgcccagagccatgagactgcccagaagaaccctgtgcgccctggccctggacgtgaccagcgtgggcccccccgtggccgcctgcggcagaagagccaacctgatcggcagaagcagagccgcccagctgtgcggccccgacagactgagagtggccggcgaggtgcacagattcagaaccagcgacgtgagccaggccaccctggccagcgtggcccccgtgttcaccgtgaccaagttcgacaagcagggcaacgtgaccagcttcgagagaaagaagaccgagctgtaccaggagctgggcctgcaggccagagacctgagattccagcacgtgatgagcatcaccgtgagaaacaacagaatcatcatgagaatggagtacctgaaggccgtgatcacccccgagtgcctgctgatcctggactacagaaacctgaacctggagcagtggctgttcagagagctgcccagccagctgagcggcgagggccagctggtgacctaccccctgcccttcgagttcagagccatcgaggccctgctgcagtactggatcaacaccctgcagggcaagctgagcatcctgcagcccctgatcctggagaccctggacgccctggtggaccccaagcacagcagcgtggacagaagcaagctgcacatcctgctgcagaacggcaagagcctgagcgagctggagaccgacatcaagatcttcaaggagagcatcctggagatcctggacgaggaggagctgctggaggagctgtgcgtgagcaagtggagcgacccccaggtgttcgagaagagcagcgccggcatcgaccacgccgaggagatggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctggagagcagcctggaggaggaccacagaatcttctggctgatcaccggcatcatgttcatgggcagcggcctgatctggagaagactgctgagcttcctgggcagacagctggaggcccccctgccccccatggtgtag

SEQ ID NO: 19910 - DNA, 1332 bp, Artificial Sequence
  Description of Artificial Sequence: Synthetic coding sequence
atggagtgcctgagaagcctgccctgcctgctgcccagagccatgagactgcccagaagaaccctgtgcgccctggccctggacgtgaccagcgtgggcccccccgtggccgcctgcggcagaagagccaacctgatcggcagaagcagagccgcccagctgtgcggccccgacagactgagagtggccggcgaggtgcacagattcagaaccagcgacgtgagccaggccaccctggccagcgtggcccccgtgttcaccgtgaccaagttcgacaagcagggcaacgtgaccagcttcgagagaaagaagaccgagctgtaccaggagctgggcctgcaggccagagacctgagattccagcacgtgatgagcatcaccgtgagaaacaacagaatcatcatgagaatggagtacctgaaggccgtgatcacccccgagtgcctgctgatcctggactacagaaacctgaacctggagcagtggctgttcagagagctgcccagccagctgagcggcgagggccagctggtgacctaccccctgcccttcgagttcagagccatcgaggccctgctgcagtactggatcaacaccctgcagggcaagctgagcatcctgcagcccctgatcctggagaccctggacgccctggtggaccccaagcacagcagcgtggacagaagcaagctgcacatcctgctgcagaacggcaagagcctgagcgagctggagaccgacatcaagatcttcaaggagagcatcctggagatcctggacgaggaggagctgctggaggagctgtgcgtgagcaagtggagcgacccccaggtgttcgagaagagcagcgccggcatcgaccacgccgaggagatggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctggagagcagcctggaggaggaccacagaatcttctggctgatcaccggcatcatgttcatgggcagcggcctgatctggagaagactgctgagcttcctgggcagacagctggaggcccccctgccccccatgatggccagcctgcccaagaagaccctgctggccgacagaagcatggagctgaagaacagcctgagactggacggcctgggcagcggcagaagcatcctgaccaacagatag

SEQ ID NO: 19911 - DNA, 1341 bp, Artificial Sequence
  Description of Artificial Sequence: Synthetic coding sequence
atggagtgcctgagaagcctgccctgcctgctgcccagagccatgagactgcccagaagaaccctgtgcgccctggccctggacgtgaccagcgtgggcccccccgtggccgcctgcggcagaagagccaacctgatcggcagaagcagagccgcccagctgtgcggccccgacagactgagagtggccggcgaggtgcacagattcagaaccagcgacgtgagccaggccaccctggccagcgtggcccccgtgttcaccgtgaccaagttcgacaagcagggcaacgtgaccagcttcgagagaaagaagaccgagctgtaccaggagctgggcctgcaggccagagacctgagattccagcacgtgatgagcatcaccgtgagaaacaacagaatcatcatgagaatggagaagtacagcctgctgctggagagcgtggccagcatcctgcagaacagcgtgagcttcatggagagacagaccgagcagtggctgttcagagagctgcccagccagctgagcggcgagggccagctggtgacctaccccctgcccttcgagttcagagccatcgaggccctgctgcagtactggatcaacaccctgcagggcaagctgagcatcctgcagcccctgatcctggagaccctggacgccctggtggaccccaagcacagcagcgtggacagaagcaagctgcacatcctgctgcagaacggcaagagcctgagcgagctggagaccgacatcaagatcttcaaggagagcatcctggagatcctggacgaggaggagctgctggaggagctgtgcgtgagcaagtggagcgacccccaggtgttcgagaagagcagcgccggcatcgaccacgccgaggagatggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctggagagcagcctggaggaggaccacagaatcttctggctgatcaccggcatcatgttcatgggcagcggcctgatctggagaagactgctgagcttcctgggcagacagctggaggcccccctgccccccatgatggccagcctgcccaagaagaccctgctggccgacagaagcatggagctgaagaacagcctgagactggacggcctgggcagcggcagaagcatcctgaccaacagatag

SEQ ID NO: 19912 - DNA, 549 bp, Artificial Sequence
  Description of Artificial Sequence: Synthetic coding sequence
tgaagagccgcccagctgtgcggccccgacagactgagagtggccggcgaggtgcacagattcagaaccagcgacgtgagccaggccaccctggccagcgtggcccccgtgttcaccgtgaccaagttcgacaagcagggcaacgtgaccagcttcgagagaaagaagaccgagctgtaccaggagctggagaccgacatcaagatcttcaaggagagcatcctggagatcctggacgaggaggagctgctggaggagctgtgcgtgagcaagtggagcgacccccaggtgttcgagaagagcagcgccggcatcgaccacgccgaggagatggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctgtag

SEQ ID NO: 19913 - DNA, 1182 bp, Artificial Sequence
  Description of Artificial Sequence: Synthetic coding sequence
atggagtgcctgagaagcctgccctgcctgctgcccagagccatgagactgcccagaagaaccctgtgcgccctggccctggacgtgaccagcgtgggcccccccgtggccgcctgcggcagaagagccaacctgatcggcagaagcagagccgcccagctgtgcggccccgacagactgagagtggccggcgaggtgcacagattcagaaccagcgacgtgagccaggccaccctggccagcgtggcccccgtgttcaccgtgtacctgaaggccgtgatcacccccgagtgcctgctgatcctggactacagaaacctgaacctggagcagtggctgttcagagagctgcccagccagctgagcggcgagggccagctggtgacctaccccctgcccttcgagttcagagccatcgaggccctgctgcagtactggatcaacaccctgcagggcaagctgagcatcctgcagcccctgatcctggagaccctggacgccctggtggaccccaagcacagcagcgtggacagaagcaagctgcacatcctgctgcagaacggcaagagcctgagcgagctggagaccgacatcaagatcttcaaggagagcatcctggagatcctggacgaggaggagctgctggaggagctgtgcgtgagcaagtggagcgacccccaggtgttcgagaagagcagcgccggcatcgaccacgccgaggagatggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctggagagcagcctggaggaggaccacagaatcttctggctgatcaccggcatcatgttcatgggcagcggcctgatctggagaagactgctgagcttcctgggcagacagctggaggcccccctgccccccatgatggccagcctgcccaagaagaccctgctggccgacagaagcatggagctgaagaacagcctgagactggacggcctgggcagcggcagaagcatcctgaccaacagatag

SEQ ID NO: 19914 - DNA, 459 bp, Artificial Sequence
  Description of Artificial Sequence: Synthetic coding sequence
atggagctgctgctggagaactactacagactggccgacgacctgagcaacgccgccagagagctgagagtgctgatcgacgacagccagagcatcatcttcatcaacctggacagccacagaaacgtgatgatgagactgaacctgcagctgaccatgggcaccttcagcctgagcctgttcggcctgatgggcgtggccttcggcatgaacctggagagcagcctggaggaggaccacagaatcttctggctgatcaccggcatcatgttcatgggcagcggcctgatctggagaagactgctgagcttcctgggcagacagctggaggcccccctgccccccatgatggccagcctgcccaagaagaccctgctggccgacagaagcatggagctgaagaacagcctgagactggacggcctgggcagcggcagaagcatcctgaccaacagatag

SEQ ID NO: 19915 - DNA, 1254 bp, Artificial Sequence
  Description of Artificial Sequence: Synthetic coding sequence
atggccctgagcgcccagcagatccccagatggttcaacagcgtgaagctgagaagcctgatcaacgccgcccagctgaccaagagattcaccagacccgccagaaccctgctgcacggcttcagcgcccagccccagatcagcagcgacaactgcttcctgcagtggggcttcaagacctacagaaccagcagcctgtggaacagcagccagagcaccagcagcagcagccaggagaacaacagcgcccagagcagcctgctgcccagcatgaacgagcagagccagaagacccagaacatcagcagcttcgacagcgagctgttcctggaggagctggacgagctgccccccctgagccccatgcagcccatcagcgaggaggaggccatccagatcatcgccgacccccccctgccccccgccagcttcaccctgagagactacgtggaccacagcgagaccctgcagaagctggtgctgctgggcgtggacctgagcaagatcgagaagcaccccgaggccgccaacctgctgctgagactggacttcgagaaggacatcaagcagatgctgctgttcctgaaggacgtgggcatcgaggacaaccagctgggcgccttcctgaccaagaaccacgccatcttcagcgaggacctggagaacctgaagaccagagtggcctacctgcacagcaagaacttcagcaaggccgacgtggcccagatggtgagaaaggcccccttcctgctgaacttcagcgtggagagactggacaacagactgggcttcttccagaaggagctggagctgagcgtgaagaagaccagagacctggtggtgagactgcccagactgctgaccggcagcctggagcccgtgaaggagaacatgaaggtgtacagactggagctgggcttcaagcacaacgagatccagcacatgatcaccagaatccccaagatgctgaccgccaacaagatgaagctgaccgagaccttcgacttcgtgcacaacgtgatgagcatcccccaccacatcatcgtgaagttcccccaggtgttcaacaccagactgttcaaggtgaaggagagacacctgttcctgacctacctgggcagagcccagtacgaccccgccaagcccaactacatcagcctggacaagctggtgagcatccccgacgagatcttctgcgaggagatcgccaaggccagcgtgcaggacttcgagaagttcctgaagaccctgtag

SEQ ID NO: 19916 - DNA, 1158 bp, Artificial Sequence
  Description of Artificial Sequence: Synthetic coding sequence
atgctgtggaagctgctgctgagaagccagagctgcagactgtgcagcttcagaaagatgagaagcccccccaagtacagacccttcctggcctgcttcacctacaccaccgacaagcagagcagcaaggagaacaccagaaccgtggagaagctgtacaagtgcagcgtggacatcagaaagatcagaagactgaagggctgggtgctgctggaggacgagacctacgtggaggagatcgccaacatcctgcaggagctgggcgccgacgagaccgccgtggccagcatcctggagagatgccccgaggccatcgtgtgcagccccaccgccgtgaacacccagagaaagctgtggcagctggtgtgcaagaacgaggaggagctgatcaagctgatcgagcagttccccgagagcttcttcaccatcaaggaccaggagaaccagaagctgaacgtgcagttcttccaggagctgggcctgaagaacgtggtgatcagcagactgctgaccgccgcccccaacgtgttccacaaccccgtggagaagaacaagcagatggtgagaatcctgcaggagagctacctggacgtgggcggcagcgaggccaacatgaaggtgtggctgctgaagctgctgagccagaaccccttcatcctgctgaacagccccaccgccatcaaggagaccctggagttcctgcaggagcagggcttcaccagcttcgagatcctgcagctgctgagcaagctgaagggcttcctgttccagctgtgccccagaagcatccagaacagcatcagcttcagcaagaacgccttcaagtgcaccgaccacgacctgaagcagctggtgctgaagtgccccgccctgctgtactacagcgtgcccgtgctggaggagagaatgcagggcctgctgagagagggcatcagcatcgcccagatcagagagacccccatggtgctggagctgaccccccagatcgtgcagtacagaatcagaaagctgaacagcagcggctacagaatcaaggacggccacctggccaacctgaacggcagcaagaaggagttcgaggccaacttcggcaagatccaggccaagaaggtgagacccctgttcaaccccgtggcccccctgaacgtggaggagtag

SEQ ID NO: 19917 - DNA, 1158 bp, Artificial Sequence; identical to SEQ ID NO: 19916
  Description of Artificial Sequence: Synthetic coding sequence

SEQ ID NO: 19918 - DNA, 537 bp, Artificial Sequence
  Description of Artificial Sequence: Synthetic coding sequence
atgctgtggaagctgctgctgagaagccagagctgcagactgtgcagcttcagaaagatgagaagcccccccaagtacagacccttcctggcctgcttcacctacaccaccgacaagcagagcagcaaggagaacaccagaaccgtggagaagctgtacaagtgcagcgtggacatcagaaagatcagaagactgaagggctgggtgctgctggaggacgagacctacgtggaggagatcgccaacatcctgcaggagctgggcgccgacgagaccgccgtggccagcatcctggagagatgccccgaggccatcgtgtgcagccccaccgccgtgaacacccagagaaagctgtggcagctggtgtgcaagaacgaggaggagctgatcaagctgatcgagcagttccccgagagcttcttcaccatcaaggaccaggagaaccagaagctgaacgtgcagttcttccaggagctgggcctgaagaacgtggtgatcagcagactgctgaccgccgcccccaacgtgttccactag

SEQ ID NO: 19919 - DNA, 102 bp, Artificial Sequence
  Description of Artificial Sequence: Synthetic coding sequence
atgctgtggaagctgctgctgagaagccagagctgcagactgtgcagcttcagaaagatgagaagcccccccaagtacagacccttcctggcctgcttctag

SEQ ID NO: 19920 - DNA, 261 bp, Artificial Sequence
  Description of Artificial Sequence: Synthetic coding sequence
atgctgtggaagctgctgctgagaagccagagctgcagactgtgcagcttcagaaagatgagaagcccccccaagtacagacccttcctggcctgcttcacctacaccaccgacaagcagagcagcaaggagaacaccagaaccgtggagaagctgtacaagtgcagcgtggacatcagaaagatcagaagactgaagggctgggtgctgctggaggacgagacctacgtggaggagatcgccaacatcctgcaggagtag

SEQ ID NO: 19921 - DNA, 1158 bp, Artificial Sequence; identical to SEQ ID NO: 19916
  Description of Artificial Sequence: Synthetic coding sequence

SEQ ID NO: 19922 - DNA, 1701 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgtgagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgagagcagcacccccagcagcggcgccggcaccgccaccaacagcgagagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgacagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 19923 - DNA, 1251 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgtgagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 19924 - DNA, 483 bp, Artificial Sequence
  Description of Artificial Sequence: Synthetic coding sequence
atgaccctggaggagctggtggcctgcgacaacgccgcccagaagatgcagaccgtgaccgccgccgtggaggagctgctggtggccgcccagagacaggacagactgaccgtgggcgtgtacgagagcgccaagctgatgaacgtggaccccgacagcgtggtgctgtgcctgctggccatcgacgaggaggaggaggacgacatcgccctgcagatccacttcaccctgatccagagcttctgctgcgacaacgacatcaacatcgtgagagtgagcggcatgcagagactggcccagctgctgggcgagcccgccgagacccagggcaccaccgaggccagagacctgcactgcctgctggtgaccaacccccacaccgacgcctggaagagccacggcctggtggaggtggccagctactgcgaggagagcagaggcaacaaccagtgggtgccctacatcagcctgcaggagagatag

SEQ ID NO: 19925 - DNA, 888 bp, Artificial Sequence
  Description of Artificial Sequence: Synthetic coding sequence
atggacttcggcctggccctgctgctggccggcctgctgggcctgctgctgggccagagcctgcaggtgaagcccctgcaggtggagccccccgagcccgtggtggccgtggccctgggcgccagcagacagctgacctgcagactggcctgcgccgacagaggcgccagcgtgcagtggagaggcctggacaccagcctgggcgccgtgcagagcgacaccggcagaagcgtgctgaccgtgagaaacgccagcctgagcgccgccggcaccagagtgtgcgtgggcagctgcggcggcagaaccttccagcacaccgtgcagctgctggtgtacgccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgccagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 19926 - DNA, 603 bp, Artificial Sequence
  Description of Artificial Sequence: Synthetic coding sequence
atggacttcggcctggccctgctgctggccggcctgctgggcctgctgctggccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgccagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 19927 - DNA, 1221 bp, Artificial Sequence
  Description of Artificial Sequence: Synthetic coding sequence
atggacttcggcctggccctgctgctggccggcctgctgggcctgctgctgggccagagcctgcaggtgaagcccctgcaggtggagccccccgagcccgtggtggccgtggccctgggcgccagcagacagctgacctgcagactggcctgcgccgacagaggcgccagcgtgcagtggagaggcctggacaccagcctgggcgccgtgcagagcgacaccggcagaagcgtgctgaccgtgagaaacgccagcctgagcgccgccggcaccagagtgtgcgtgggcagctgcggcggcagaaccttccagcacaccgtgcagctgctggtgtacgccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgccctgcacgccctgagcaaccccgaggcccccgccgccgagagcccccaggcccccagcctgagcacccccgccagcagccaccccaccagccccgagccccccgacaccaccagccccgagagccccgacaccaccagccccgagagccccgacaccaccagccaggagccccccgacaccaccagccccgagccccccgacaagaccagccccgagcccgccccccagcagggcagcacccacacccccagaagccccggcagcaccagaaccagaagacccgagatcagccaggccggccccacccagggcgaggtgatccccaccggcagcagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 19928 - DNA, 1197 bp, Artificial Sequence
  Description of Artificial Sequence: Synthetic coding sequence
atggacttcggcctggccctgctgctggccggcctgctgggcctgctgctgggccagagcctgcaggtgaagcccctgcaggtggagccccccgagcccgtggtggccgtggccctgggcgccagcagacagctgacctgcagactggcctgcgccgacagaggcgccagcgtgcagtggagaggcctggacaccagcctgggcgccgtgcagagcgacaccggcagaagcgtgctgaccgtgagaaacgccagcctgagcgccgccggcaccagagtgtgcgtgggcagctgcggcggcagaaccttccagcacaccgtgcagctgctggtgtacgccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgccctgcacggctggctgagccccccccccccccagaacaccggcccccacggcccccaccccaccagccccgagccccccgacaccaccagccccgagagccccgacaccaccagccccgagagccccgacaccaccagccaggagccccccgacaccaccagccccgagccccccgacaagaccagccccgagcccgccccccagcagggcagcacccacacccccagaagccccggcagcaccagaaccagaagacccgagatcagccaggccggccccacccagggcgaggtgatccccaccggcagcagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 19929 - DNA, 1173 bp, Artificial Sequence
  Description of Artificial Sequence: Synthetic coding sequence
atggacttcggcctggccctgctgctggccggcctgctgggcctgctgctgggccagagcctgcaggtgaagcccctgcaggtggagccccccgagcccgtggtggccgtggccctgggcgccagcagacagctgacctgcagactggcctgcgccgacagaggcgccagcgtgcagtggagaggcctggacaccagcctgggcgccgtgcagagcgacaccggcagaagcgtgctgaccgtgagaaacgccagcctgagcgccgccggcaccagagtgtgcgtgggcagctgcggcggcagaaccttccagcacaccgtgcagctgctggtgtacgccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgccctgcacgccctgagcaaccccgaggcccccgcccccaccagccccgagccccccgacaccaccagccccgagagccccgacaccaccagccccgagagccccgacaccaccagccaggagccccccgacaccaccagccccgagccccccgacaagaccagccccgagcccgccccccagcagggcagcacccacacccccagaagccccggcagcaccagaaccagaagacccgagatcagccaggccggccccacccagggcgaggtgatccccaccggcagcagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 19930 - DNA, 921 bp, Artificial Sequence
  Description of Artificial Sequence: Synthetic coding sequence
atgggcatcctggacatcgaggtgtggggcaaggacaacaagaagcacgaggagagactgggcacctgcaaggtggacatcagcgccctgcccctgaagcaggccaactgcctggagctgcccctggacagctgcctgggcgccctgctgatgctggtgaccctgaccccctgcgccggcgtgagcgtgagcgacctgtgcgtgtgccccctggccgacctgagcgagagaaagcagatcacccagagatactgcctgcagaacagcctgaaggacgtgaaggacgtgggcatcctgcaggtgaaggtgctgaaggccgccgacctgctggccgccgacttcagcggcaagagcgaccccttctgcctgctggagctgggcaacgacagactgcagacccacaccgtgtacaagaacctgaaccccgagtggaacaaggtgttcaccttccccatcaaggacatccacgacgtgctggaggtgaccgtgttcgacgaggacggcgacaagccccccgacttcctgggcaaggtggccatccccctgctgagcatcagagacggccagcccaactgctacgtgctgaagaacaaggacctggagcaggccttcaagggcgtgatctacctggagatggacctgatctacaaccccgtgaaggccagcatcagaaccttcacccccagagagaagagattcgtggaggacagcagaaagctgagcaagaagatcctgagcagagacgtggacagagtgaagagaatcaccatggccatctggaacaccatgcagttcctgaagagctgcttccagtgggagagcaccctgagaagcaccatcgccttcgcccacagaaaggaggagccccccctgagcatgaagtgcaccctgttcagcggcgacatcggccccagcctgtag

SEQ ID NO: 19931 - DNA, 2337 bp, Artificial Sequence
  Description of Artificial Sequence: Synthetic coding sequence
atgctggacagctgcaagctgaagagcgcctgcaacctgcccttcatctgcaacaagaagatcatcaacaccgccggcaccagcaacgccgaggtgcccctggccgaccccggcatgtaccagctggacatcaccctgagaagaggccagagcctggccgccagagacagaggcggcaccagcgacccctacgtgaagttcaagatcggcggcaaggaggtgttcagaagcaagatcatccacaagaacctgaaccccgtgtgggaggagaaggcctgcatcctggtggaccacctgagagagcccctgtacatcaaggtgttcgactacgacttcggcctgcaggacgacttcatgggcagcgccttcctggacctgacccagctggagctgaacagacccaccgacgtgaccctgaccctgaaggacccccactaccccgaccacgacctgggcatcatcctgctgagcgtgatcctgacccccaaggagggcgagagcagagacgtgaccatgctgatgagaaagagctggaagagaagcagcaaggagctgagcgagaacgaggtggtgggcagctacttcagcgtgaagagcctgttctggagaacctgcggcagacccgccctgcccgtgctgggcttctgcagagccgagctgcagaacccctactgcaagaacgtgcagttccagacccagagcctgagactgagcgacctgcacagaaagagccacctgtggagaggcatcgtgagcatcaccctgatcgagggcagagacctgaaggccatggacagcaacggcctgagcgacccctacgtgaagttcagactgggccaccagaagtacaagagcaagatcatgcccaagaccctgaacccccagtggagagagcagttcgacttccacctgtacgaggagagaggcggcgtgatcgacatcaccgcctgggacaaggacgccggcaagagagacgacttcatcggcagatgccaggtggacctgagcgccctgagcagagagcagacccacaagctggagctgcagctggaggagggcgagggccacctggtgctgctggtgaccctgaccgccagcgccaccgtgagcatcagcgacctgagcgtgaacagcctggaggaccagaaggagagagaggagatcctgaagagatacagccccctgagaatcttccacaacctgaaggacgtgggcttcctgcaggtgaaggtgatcagagccgagggcctgatggccgccgacgtgaccggcaagagcgaccccttctgcgtggtggagctgaacaacgacagactgctgacccacaccgtgtacaagaacctgaaccccgagtggaacaaggtgttcaccttcaacatcaaggacatccacagcgtgctggaggtgaccgtgtacgacgaggacagagacagaagcgccgacttcctgggcaaggtggccatccccctgctgagcatccagaacggcgagcagaaggcctacgtgctgaagaacaagcagctgaccggccccaccaagggcgtgatctacctggagatcgacgtgatcttcaacgccgtgaaggccagcctgagaaccctgatccccaaggagcagaagtacatcgaggaggagaacagactgagcaagcagctgctgctgagaaacttcatcagaatgaagagatgcgtgatggtgctggtgaacgccgcctactacgtgaacagctgcttcgactgggacagcccccccagaagcctggccgccttcgtgctgttcctgttcgtggtgtggaacttcgagctgtacatgatccccctggtgctgctgctgctgctgacctggaactacttcctgatcatcagcggcaaggacaacagacagagagacaccgtggtggaggacatgctggaggacgaggaggaggaggacgacaaggacgacaaggacagcgagaagaagggcttcatcaacaagatctacgccatccaggaggtgtgcgtgagcgtgcagaacatcctggacgaggtggccagcttcggcgagagaatcaagaacaccttcaactggaccgtgcccttcctgagctggctggccatcgtggccctgtgcgtgttcaccgccatcctgtactgcatccccctgagatacatcgtgctggtgtggggcatcaacaagttcaccaagaagctgagaagcccctacgccatcgacaacaacgagctgctggacttcctgagcagagtgcccagcgacgtgcaggtggtgcagtaccaggagctgaagcccgaccccagccacagcccctacaagagaaagaagaacaacctgggctag

SEQ ID NO: 19932 - DNA, 738 bp, Artificial Sequence
  Description of Artificial Sequence: Synthetic coding sequence
atgtaccagctggacatcaccctgagaagaggccagagcctggccgccagagacagaggcggcaccagcgacccctacgtgaagttcaagatcggcggcaaggaggtgttcagaagcaagatcatccacaagaacctgaaccccgtgtgggaggagaaggcctgcatcctggtggaccacctgagagagcccctgtacatcaaggtgttcgactacgacttcggcctgcaggacgacttcatgggcagcgccttcctggacctgacccagctggagctgaacagacccaccgacgtgaccctgaccctgaaggacccccactaccccgaccacgacctgggcatcatcctgctgagcgtgatcctgacccccaaggagggcgagagcagagacgtgaccatgctgatgagaaagagctggaagagaagcagcaagttccagacccagagcctgagactgagcgacctgcacagaaagagccacctgtggagaggcatcgtgagcatcaccctgatcgagggcagagacctgaaggccatggacagcaacggcctgagcgacccctacgtgaagttcagactgggccaccagaagtacaagagcaagatcatgcccaagaccctgaacccccagtggagagagcagttcgacttccacctgtacgaggagagatgcggcatcagccccggcgagagccaccagagcggcagagtgaacggctgcagaagacactggtag

SEQ ID NO: 19933 - DNA, 2079 bp, Artificial Sequence
  Description of Artificial Sequence: Synthetic coding sequence
atgctggacagctgcaagctgaagagcgcctgcaacctgcccttcatctgcaacaagaagatcatcaacaccgccggcaccagcaacgccgaggtgcccctggccgaccccggcatgtaccagctggacatcaccctgagaagaggccagagcctggccgccagagacagaggcggcaccagcgacccctacgtgaagttcaagatcggcggcaaggaggtgttcagaagcaagatcatccacaagaacctgaaccccgtgtgggaggagaaggcctgcatcctggtggaccacctgagagagcccctgtacatcaaggtgttcgactacgacttcggcctgcaggacgacttcatgggcagcgccttcctggacctgacccagctggagctgaacagacccaccgacgtgaccctgaccctgaaggacccccactaccccgaccacgacctgggcatcatcctgctgagcgtgatcctgacccccaaggagggcgagagcagagacgtgaccatgctgatgagaaagagctggaagagaagcagcaagttccagacccagagcctgagactgagcgacctgcacagaaagagccacctgtggagaggcatcgtgagcatcaccctgatcgagggcagagacctgaaggccatggacagcaacggcctgagcgacccctacgtgaagttcagactgggccaccagaagtacaagagcaagatcatgcccaagaccctgaacccccagtggagagagcagttcgacttccacctgtacgaggagagaggcggcgtgatcgacatcaccgcctgggacaaggacgccggcaagagagacgacttcatcggcagatgccaggtggacctgagcgccctgagcagagagcagacccacaagctggagctgcagctggaggagggcgagggccacctggtgctgctggtgaccctgaccgccagcgccaccgtgagcatcagcgacctgagcgtgaacagcctggaggaccagaaggagagagaggagatcctgaagagatacagccccctgagaatcttccacaacctgaaggacgtgggcttcctgcaggtgaaggtgatcagagccgagggcctgatggccgccgacgtgaccggcaagagcgaccccttctgcgtggtggagctgaacaacgacagactgctgacccacaccgtgtacaagaacctgaaccccgagtggaacaaggtgttcaccttcaacatcaaggacatccacagcgtgctggaggtgaccgtgtacgacgaggacagagacagaagcgccgacttcctgggcaaggtggccatccccctgctgagcatccagaacggcgagcagaaggcctacgtgctgaagaacaagcagctgaccggccccaccaagggcgtgatctacctggagatcgacgtgatcttcaacgccgtgaaggccagcctgagaaccctgatccccaaggagcagaagtacatcgaggaggagaacagactgagcaagcagctgctgctgagaaacttcatcagaatgaagagatgcgtgatggtgctggtgaacgccgcctactacgtgaacagctgcttcgactgggacagcccccccagaagcctggccgccttcgtggtggtggaggacatgctggaggacgaggaggaggaggacgacaaggacgacaaggacagcgagaagaagggcttcatcaacaagatctacgccatccaggaggtgtgcgtgagcgtgcagaacatcctggacgaggtggccagcttcggcgagagaatcaagaacaccttcaactggaccgtgcccttcctgagctggctggccatcgtggccctgtgcgtgttcaccgccatcctgtactgcatccccctgagatacatcgtgctggtgtggggcatcaacaagttcaccaagaagctgagaagcccctacgccatcgacaacaacgagctgctggacttcctgagcagagtgcccagcgacgtgcaggtggtgcagtaccaggagctgaagcccgaccccagccacagcccctacaagagaaagaagaacaacctgggctag

SEQ ID NO: 19934 - DNA, 1548 bp, Artificial Sequence
  Description of Artificial Sequence: Synthetic coding sequence
atggacagcaacggcctgagcgacccctacgtgaagttcagactgggccaccagaagtacaagagcaagatcatgcccaagaccctgaacccccagtggagagagcagttcgacttccacctgtacgaggagagaggcggcgtgatcgacatcaccgcctgggacaaggacgccggcaagagagacgacttcatcggcagatgccaggtggacctgagcgccctgagcagagagcagacccacaagctggagctgcagctggaggagggcgagggccacctggtgctgctggtgaccctgaccgccagcgccaccgtgagcatcagcgacctgagcgtgaacagcctggaggaccagaaggagagagaggagatcctgaagagatacagccccctgagaatcttccacaacctgaaggacgtgggcttcctgcaggtgaaggtgatcagagccgagggcctgatggccgccgacgtgaccggcaagagcgaccccttctgcgtggtggagctgaacaacgacagactgctgacccacaccgtgtacaagaacctgaaccccgagtggaacaaggtgttcaccttcaacatcaaggacatccacagcgtgctggaggtgaccgtgtacgacgaggacagagacagaagcgccgacttcctgggcaaggtggccatccccctgctgagcatccagaacggcgagcagaaggcctacgtgctgaagaacaagcagctgaccggccccaccaagggcgtgatctacctggagatcgacgtgatcttcaacgccgtgaaggccagcctgagaaccctgatccccaaggagcagaagtacatcgaggaggagaacagactgagcaagcagctgctgctgagaaacttcatcagaatgaagagatgcgtgatggtgctggtgaacgccgcctactacgtgaacagctgcttcgactgggacagcccccccagaagcctggccgccttcgtgctgttcctgttcgtggtgtggaacttcgagctgtacatgatccccctggtgctgctgctgctgctgacctggaactacttcctgatcatcagcggcaaggacaacagacagagagacaccgtggtggaggacatgctggaggacgaggaggaggaggacgacaaggacgacaaggacagcgagaagaagggcttcatcaacaagatctacgccatccaggaggtgtgcgtgagcgtgcagaacatcctggacgaggtggccagcttcggcgagagaatcaagaacaccttcaactggaccgtgcccttcctgagctggctggccatcgtggccctgtgcgtgttcaccgccatcctgtactgcatccccctgagatacatcgtgctggtgtggggcatcaacaagttcaccaagaagctgagaagcccctacgccatcgacaacaacgagctgctggacttcctgagcagagtgcccagcgacgtgcaggtggtgcagtaccaggagctgaagcccgaccccagccacagcccctacaagagaaagaagaacaacctgggctag

SEQ ID NO: 19935 - DNA, 1803 bp, Artificial Sequence
  Description of Artificial Sequence: Synthetic coding sequence
atgctggacagctgcaagctgaagagcgcctgcaacctgcccttcatctgcaacaagaagatcatcaacaccgccggcaccagcaacgccgaggtgcccctggccgaccccggcatgtaccagctggacatcaccctgagaagaggccagagcctggccgccagagacagaggcggcaccagcgacccctacgtgaagttcaagatcggcggcaaggaggtgttcagaagcaagatcatccacaagaacctgaaccccgtgtgggaggagaaggcctgcatcctggtggaccacctgagagagcccctgtacatcaaggtgttcgactacgacttcggcctgcaggacgacttcatgggcagcgccttcctggacctgacccagctggagctgaacagacccaccgacgtgaccctgaccctgaaggacccccactaccccgaccacgacctgggcatcatcctgctgagcgtgatcctgacccccaaggagggcgagagcagagacgtgaccatgctgatgagaaagagctggaagagaagcagcaaggagctgagcgagaacgaggtggtgggcagctacttcagcgtgaagagcctgttctggagaacctgcggcagacccgccctgcccgtgctgggcttctgcagagccgagctgcagaacccctactgcaagaacgtgcagttccagacccagagcctgagactgagcgacctgcacagaaagagccacctgtggagaggcatcgtgagcatcaccctgatcgagggcagagacctgaaggccatggacagcaacggcctgagcgacccctacgtgaagttcagactgggccaccagaagtacaagagcaagatcatgcccaagaccctgaacccccagtggagagagcagttcgacttccacctgtacgaggagagaggcggcgtgatcgacatcaccgcctgggacaaggacgccggcaagagagacgacttcatcggcagatgccaggtggacctgagcgccctgagcagagagcagacccacaagctggagctgcagctggaggagggcgagggccacctggtgctgctggtgaccctgaccgccagcgccaccgtgagcatcagcgacctgagcgtgaacagcctggaggaccagaaggagagagaggagatcctgaagagatacagccccctgagaatcttccacaacctgaaggacgtgggcttcctgcaggtgaaggtgatcagagccgagggcctgatggccgccgacgtgaccggcaagagcgaccccttctgcgtggtggagctgaacaacgacagactgctgacccacaccgtgtacaagaacctgaaccccgagtggaacaaggtgttcaccttcaacatcaaggacatccacagcgtgctggaggtgaccgtgtacgacgaggacagagacagaagcgccgacttcctgggcaaggtggccatccccctgctgagcatccagaacggcgagcagaaggcctacgtgctgaagaacaagcagctgaccggccccaccaagggcgtgatctacctggagatcgacgtgatcttcaacgccgtgaaggccagcctgagaaccctgatccccaaggagcagaagtacatcgaggaggagaacagactgagcaagcagctgctgctgagaaacttcatcagaatgaagagatgcgtgatggtgctggtgaacgccgcctactacgtgaacagctgcttcgactgggacagcccccccagaagcctggccgccttcgtggccctgtacggcaccttcatcaacgtgtag

SEQ ID NO: 19936 - DNA, 246 bp, Artificial Sequence
  Description of Artificial Sequence: Synthetic coding sequence
atgctggacagctgcaagctgaagagcgcctgcaacctgcccttcatctgcaacaagaagatcatcaacaccgccggcaccagcaacgccgaggtgcccctggccgaccccggcatgtaccagctggacatcaccctgagaagaggccagagcctggccgccagagacagaggcggcaccagcgacccctacgtgaagttcaagatcggcggcaaggaggtgttcagaagcaagatcatccactag

SEQ ID NO: 19937 - DNA, 3000 bp, Artificial Sequence
  Description of Artificial Sequence: Synthetic coding sequence
atggagcccagagccgccgccgccggcgagcccgagccccccgccgccagcagcagcttccaggccagactgtggaagaacctgcagctgggcgtgggcagaagcaagggcggcggcggcggcagagccggcggccccgagagaagaaccgccgacacccccagccccagcccccccccccccgtgggcaccggcaacgcccccgccagaggcagcggcgccggcagcagatggagcggcttcaagaagagaaagcaggtgctggacagagtgttcagcagcagccagcccaacctgtgctgcagcagccccgagcccctggagcccggcggcgccggcagagccgagcagggcagcaccctgagaagaagaatcagagagcacctgctgcccgccgtgaagggccccgccgccgccagcggcgccgccggcggcaccccccccggcggcagaagccccgacagcgcccccagcagcagcagcgccagcagcagcctgagcagcagcccccagcccccccccagaggcgacagagccagagacgagggcgccagaagacagggccccggcgcccacctgtgccaccagaagagcagcagcctgcccggcaccgcctgcctggagcagctgctggagcccccccccccccccgccgagcccgccagaagccccgccgagagcagagcccccgagaccggcgaggagcacggcagcagccagaagatcatcaacaccgccggcaccagcaacgccgaggtgcccctggccgaccccggcatgtaccagctggacatcaccctgagaagaggccagagcctggccgccagagacagaggcggcaccagcgacccctacgtgaagttcaagatcggcggcaaggaggtgttcagaagcaagatcatccacaagaacctgaaccccgtgtgggaggagaaggcctgcatcctggtggaccacctgagagagcccctgtacatcaaggtgttcgactacgacttcggcctgcaggacgacttcatgggcagcgccttcctggacctgacccagctggagctgaacagacccaccgacgtgaccctgaccctgaaggacccccactaccccgaccacgacctgggcatcatcctgctgagcgtgatcctgacccccaaggagggcgagagcagagacgtgaccatgctgatgagaaagagctggaagagaagcagcaaggagctgagcgagaacgaggtggtgggcagctacttcagcgtgaagagcctgttctggagaacctgcggcagacccgccctgcccgtgctgggcttctgcagagccgagctgcagaacccctactgcaagaacgtgcagttccagacccagagcctgagactgagcgacctgcacagaaagagccacctgtggagaggcatcgtgagcatcaccctgatcgagggcagagacctgaaggccatggacagcaacggcctgagcgacccctacgtgaagttcagactgggccaccagaagtacaagagcaagatcatgcccaagaccctgaacccccagtggagagagcagttcgacttccacctgtacgaggagagaggcggcgtgatcgacatcaccgcctgggacaaggacgccggcaagagagacgacttcatcggcagatgccaggtggacctgagcgccctgagcagagagcagacccacaagctggagctgcagctggaggagggcgagggccacctggtgctgctggtgaccctgaccgccagcgccaccgtgagcatcagcgacctgagcgtgaacagcctggaggaccagaaggagagagaggagatcctgaagagatacagccccctgagaatcttccacaacctgaaggacgtgggcttcctgcaggtgaaggtgatcagagccgagggcctgatggccgccgacgtgaccggcaagagcgaccccttctgcgtggtggagctgaacaacgacagactgctgacccacaccgtgtacaagaacctgaaccccgagtggaacaaggtgttcaccttcaacatcaaggacatccacagcgtgctggaggtgaccgtgtacgacgaggacagagacagaagcgccgacttcctgggcaaggtggccatccccctgctgagcatccagaacggcgagcagaaggcctacgtgctgaagaacaagcagctgaccggccccaccaagggcgtgatctacctggagatcgacgtgatcttcaacgccgtgaaggccagcctgagaaccctgatccccaaggagcagaagtacatcgaggaggagaacagactgagcaagcagctgctgctgagaaacttcatcagaatgaagagatgcgtgatggtgctggtgaacgccgcctactacgtgaacagctgcttcgactgggacagcccccccagaagcctggccgccttcgtgctgttcctgttcgtggtgtggaacttcgagctgtacatgatccccctggtgctgctgctgctgctgacctggaactacttcctgatcatcagcggcaaggacaacagacagagagacaccgtggtggaggacatgctggaggacgaggaggaggaggacgacaaggacgacaaggacagcgagaagaagggcttcatcaacaagatctacgccatccaggaggtgtgcgtgagcgtgcagaacatcctggacgaggtggccagcttcggcgagagaatcaagaacaccttcaactggaccgtgcccttcctgagctggctggccatcgtggccctgtgcgtgttcaccgccatcctgtactgcatccccctgagatacatcgtgctggtgtggggcatcaacaagttcaccaagaagctgagaagcccctacgccatcgacaacaacgagctgctggacttcctgagcagagtgcccagcgacgtgcaggtggtgcagtaccaggagctgaagcccgaccccagccacagcccctacaagagaaagaagaacaacctgggctag

SEQ ID NO: 19938 - DNA, 921 bp, Artificial Sequence; identical to SEQ ID NO: 19930
  Description of Artificial Sequence: Synthetic coding sequence

SEQ ID NO: 19939 - DNA, 2637 bp, Artificial Sequence
  Description of Artificial Sequence: Synthetic coding sequence
atggacctggacaagcccagcgtgtggggcagcctgaagcagagaaccagacccctgctgatcaacctgagcaagaagaaggtgaagaagaaccccagcaagccccccgacctgagagccagacaccacctggacagaagactgagcctgagcgtgcccgacctgctggaggccgaggccctggcccccgagggcagaccctacagcggcccccagagcagctacaccagcgtgcccagcagcctgagcaccgccggcatcttccccaagagcagcagcagcagcctgaagcagagcgaggaggagctggactggagccaggaggaggccagccacctgcacgtggtggagaccgacagcgaggaggcctacgccagccccgccgagagaagaagagtgagcagcaacggcatcttcgacctgcagaagaccagcctgggcggcgacgcccccgaggagcccgagaagctgtgcggcagcagcgacctgaacgccagcatgaccagccagcacttcgaggagcagagcgtgcccggcgaggccagcgacggcctgagcaacctgcccagccccttcgcctacctgctgaccatccacctgaaggagggcagaaacctggtggtgagagacagatgcggcaccagcgacccctacgtgaagttcaagctgaacggcaagaccctgtacaagagcaaggtgatctacaagaacctgaaccccgtgtgggacgagatcgtggtgctgcccatccagagcctggaccagaagctgagagtgaaggtgtacgacagagacctgaccaccagcgacttcatgggcagcgccttcgtgatcctgagcgacctggagctgaacagaaccaccgagcacatcctgaagctggaggaccccaacagcctggaggacgacatgggcgtgatcgtgctgaacctgaacctggtggtgaagcagggcgacttcaagagacacagatggagcaacagaaagagactgagcgccagcaagagcagcctgatcagaaacctgagactgagcgagagcctgaagaagaaccagctgtggaacggcatcatcagcatcaccctgctggagggcaagaacgtgagcggcggcagcatgaccgagatgttcgtgcagctgaagctgggcgaccagagatacaagagcaagaccctgtgcaagagcgccaacccccagtggcaggagcagttcgacttccactacttcagcgacagaatgggcatcctggacatcgaggtgtggggcaaggacaacaagaagcacgaggagagactgggcacctgcaaggtggacatcagcgccctgcccctgaagcaggccaactgcctggagctgcccctggacagctgcctgggcgccctgctgatgctggtgaccctgaccccctgcgccggcgtgagcgtgagcgacctgtgcgtgtgccccctggccgacctgagcgagagaaagcagatcacccagagatactgcctgcagaacagcctgaaggacgtgaaggacgtgggcatcctgcaggtgaaggtgctgaaggccgccgacctgctggccgccgacttcagcggcaagagcgaccccttctgcctgctggagctgggcaacgacagactgcagacccacaccgtgtacaagaacctgaaccccgagtggaacaaggtgttcaccttccccatcaaggacatccacgacgtgctggaggtgaccgtgttcgacgaggacggcgacaagccccccgacttcctgggcaaggtggccatccccctgctgagcatcagagacggccagcccaactgctacgtgctgaagaacaaggacctggagcaggccttcaagggcgtgatctacctggagatggacctgatctacaaccccgtgaaggccagcatcagaaccttcacccccagagagaagagattcgtggaggacagcagaaagctgagcaagaagatcctgagcagagacgtggacagagtgaagagaatcaccatggccatctggaacaccatgcagttcctgaagagctgcttccagtgggagagcaccctgagaagcaccatcgccttcgccgtgttcctgatcaccgtgtggaacttcgagctgtacatgatccccctggccctgctgctgatcttcgtgtacaacttcatcagacccgtgaagggcaaggtgagcagcatccaggacagccaggagagcaccgacatcgacgacgaggaggacgaggacgacaaggagagcgagaagaagggcctgatcgagagaatctacatggtgcaggacatcgtgagcaccgtgcagaacgtgctggaggagatcgccagcttcggcgagagaatcaagaacaccttcaactggaccgtgcccttcctgagcagcctggcctgcctgatcctggccgccgccaccatcatcctgtacttcatccccctgagatacatcatcctgatctggggcatcaacaagttcaccaagaagctgagaaacccctacagcatcgacaacaacgagctgctggacttcctgagcagagtgcccagcgacgtgcagaaggtgcagtacgccgagctgaagctgtgcagcagccacagccccctgagaaagaagagaagcgccctgtag

SEQ ID NO: 19940 - DNA, 2472 bp, Artificial Sequence
  Description of Artificial Sequence: Synthetic coding sequence
atggacctggacaagcccagcgtgtggggcagcctgaagcagagaaccagacccctgctgatcaacctgagcaagaagaaggtgaagaagaaccccagcaagccccccgacctgagagccagacaccacctggacagaagactgagcctgagcgtgcccgacctgctggaggccgaggccctggcccccgagggcagaccctacagcggcccccagagcagctacaccagcgtgcccagcagcctgagcaccgccggcatcttccccaagagcagcagcagcagcctgaagcagagcgaggaggagctggactggagccaggaggaggccagccacctgcacgtggtggagaccgacagcgaggaggcctacgccagccccgccgagagaagaagagtgagcagcaacggcatcttcgacctgcagaagaccagcctgggcggcgacgcccccgaggagcccgagaagctgtgcggcagcagcgacctgaacgccagcatgaccagccagcacttcgaggagcagagcgtgcccggcgaggccagcgacggcctgagcaacctgcccagccccttcgcctacctgctgaccatccacctgaaggagggcagaaacctggtggtgagagacagatgcggcaccagcgacccctacgtgaagttcaagctgaacggcaagaccctgtacaagagcaaggtgatctacaagaacctgaaccccgtgtgggacgagatcgtggtgctgcccatccagagcctggaccagaagctgagagtgaaggtgtacgacagagacctgaccaccagcgacttcatgggcagcgccttcgtgatcctgagcgacctggagctgaacagaaccaccgagcacatcctgaagctggaggaccccaacagcctggaggacgacatgggcgtgatcgtgctgaacctgaacctggtggtgaagcagggcgacttcaagagacacagatggagcaacagaaagagactgagcgccagcaagagcagcctgatcagaaacctgagactgagcgagagcctgaagaagaaccagctgtggaacggcatcatcagcatcaccctgctggagggcaagaacgtgagcggcggcagcatgaccgagatgttcgtgcagctgaagctgggcgaccagagatacaagagcaagaccctgtgcaagagcgccaacccccagtggcaggagcagttcgacttccactacttcagcgacagaatgggcatcctggacatcgaggtgtggggcaaggacaacaagaagcacgaggagagactgggcacctgcaaggtggacatcagcgccctgcccctgaagcaggccaactgcctggagctgcccctggacagctgcctgggcgccctgctgatgctggtgaccctgaccccctgcgccggcgtgagcgtgagcgacctgtgcgtgtgccccctggccgacctgagcgagagaaagcagatcacccagagatactgcctgcagaacagcctgaaggacgtgaaggacgtgggcatcctgcaggtgaaggtgctgaaggccgccgacctgctggccgccgacttcagcggcaagagcgaccccttctgcctgctggagctgggcaacgacagactgcagacccacaccgtgtacaagaacctgaaccccgagtggaacaaggtgttcaccttccccatcaaggacatccacgacgtgctggaggtgaccgtgttcgacgaggacggcgacaagccccccgacttcctgggcaaggtggccatccccctgctgagcatcagagacggccagcccaactgctacgtgctgaagaacaaggacctggagcaggccttcaagggcgtgatctacctggagatggacctgatctacaaccccgtgaaggccagcatcagaaccttcacccccagagagaagagattcgtggaggacagcagaaagctgagcaagaagatcctgagcagagacgtggacagagtgaagagaatcaccatggccatctggaacaccatgcagttcctgaagagctgcttccagtgggagagcaccctgagaagcaccatcgccttcgccgagagcgagaagaagggcctgatcgagagaatctacatggtgcaggacatcgtgagcaccgtgcagaacgtgctggaggagatcgccagcttcggcgagagaatcaagaacaccttcaactggaccgtgcccttcctgagcagcctggcctgcctgatcctggccgccgccaccatcatcctgtacttcatccccctgagatacatcatcctgatctggggcatcaacaagttcaccaagaagctgagaaacccctacagcatcgacaacaacgagctgctggacttcctgagcagagtgcccagcgacgtgcagaaggtgcagtacgccgagctgaagctgtgcagcagccacagccccctgagaaagaagagaagcgccctgtag

SEQ ID NO: 19941 - DNA, 1191 bp, Artificial Sequence
  Description of Artificial Sequence: Synthetic coding sequence
atggacctggacaagcccagcgtgtggggcagcctgaagcagagaaccagacccctgctgatcaacctgagcaagaagaaggtgaagaagaaccccagcaagccccccgacctgagagccagacaccacctggacagaagactgagcctgagcgtgcccgacctgctggaggccgaggccctggcccccgagggcagaccctacagcggcccccagagcagctacaccagcgtgcccagcagcctgagcaccgccggcatcttccccaagagcagcagcagcagcctgaagcagagcgaggaggagctggactggagccaggaggaggccagccacctgcacgtggtggagaccgacagcgaggaggcctacgccagccccgccgagagaagaagagtgagcagcaacggcatcttcgacctgcagaagaccagcctgggcggcgacgcccccgaggagcccgagaagctgtgcggcagcagcgacctgaacgccagcatgaccagccagcacttcgaggagcagagcgtgcccggcgaggccagcgacggcctgagcaacctgcccagccccttcgcctacctgctgaccatccacctgaaggagggcagaaacctggtggtgagagacagatgcggcaccagcgacccctacgtgaagttcaagctgaacggcaagaccctgtacaagagcaaggtgatctacaagaacctgaaccccgtgtgggacgagatcgtggtgctgcccatccagagcctggaccagaagctgagagtgaaggtgtacgacagagacctgaccaccagcgacttcatgggcagcgccttcgtgatcctgagcgacctggagctgaacagaaccaccgagcacatcctgaagctggaggaccccaacagcctggaggacgacatgggcgtgatcgtgctgaacctgaacctggtggtgaagcagggcgacttcaagagacacagatggagcaacagaaagagactgagcgccagcaagagcagcctgatcagaaacctgagactgagcgagagcctgaagaagaaccagctgtggaacggcatcatcagcatcaccctgctggagggcaagaacgtgagcggcggcagcatgaccgagatgttcgtgcagctgaagctgggcgaccagagatacaagagcaaggacggccacttcggccactag

SEQ ID NO: 19942 - DNA, 2661 bp, Artificial Sequence
  Description of Artificial Sequence: Synthetic coding sequence
atgggcatggacctgacctgccccttcggcatcagccccgcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagcagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccgagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19943 - DNA, 2712 bp, Artificial Sequence
  Description of Artificial Sequence: Synthetic coding sequence
atgggcatggacctgacctgccccttcggcatcagccccgcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagaagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19944 - DNA, 1794 bp, Artificial Sequence
  Description of Artificial Sequence: Synthetic coding sequence
atggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19945 - DNA, 2658 bp, Artificial Sequence
  Description of Artificial Sequence: Synthetic coding sequence
atgggcatggacctgacctgccccttcggcatcagccccgcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccgacggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19946 - DNA, 2466 bp, Artificial Sequence
  Description of Artificial Sequence: Synthetic coding sequence
ctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagaagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19947 - DNA, 1794 bp, Artificial Sequence; identical to SEQ ID NO: 19944
  Description of Artificial Sequence: Synthetic coding sequence

SEQ ID NO: 19948 - DNA, 2466 bp, Artificial Sequence; identical to SEQ ID NO: 19946
  Description of Artificial Sequence: Synthetic coding sequence

SEQ ID NO: 19949 - DNA, 2466 bp, Artificial Sequence
  Description of Artificial Sequence: Synthetic coding sequence
atgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagaagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19950 - DNA, 1794 bp, Artificial Sequence; identical to SEQ ID NO: 19944
  Description of Artificial Sequence: Synthetic coding sequence

SEQ ID NO: 19951 - DNA, 2739 bp, Artificial Sequence
  Description of Artificial Sequence: Synthetic coding sequence
atggtgaaggccccccagagcgaggagagactggccagaggcggcaaggagaacaacagcgtgctggcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagaagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19952 - DNA, 2715 bp, Artificial Sequence
  Description of Artificial Sequence: Synthetic coding sequence
atgggcatggacctgacctgccccttcggcatcagccccgcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagcagaagggcgacgaggccgacgtgagcagcccccaccccggcgagcccaacgtgcccaagggcctggccgacagaaagcagaacgaccagagaaaggtgagccagggcagactggcccccagacccccccccgtggagaagagcaaggagatcgccatcgagcagaaggagaacttcgaccccctgcagtaccccgagaccacccccaagggcctggcccccgtgaccaacagcagcggcaagatggccctgaacagcccccagcccggccccgtggagagcgagctgggcaagcagctgctgaagaccggctgggagggcagccccctgcccagaagccccacccaggacgccgccggcgtgggcccccccgccagccagggcagaggccccgccggcgagcccatgggccccgaggccggcagcaaggccgagctgccccccaccgtgagcagaccccccctgctgagaggcctgagctgggacagcggccccgaggagcccggccccagactgcagaaggtgctggccaagctgcccctggccgaggaggagaagagattcgccggcaaggccggcggcaagctggccaaggcccccggcctgaaggacttccagatccaggtgcagcccgtgagaatgcagaagctgaccaagctgagagaggagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19953 - DNA, 2121 bp, Artificial Sequence
  Description of Artificial Sequence: Synthetic coding sequence
atggtgaaggccccccagagcgaggagagactggccagaggcggcaaggagaacaacagcgtgctggcctgcggcgcccaggccagctggagcatcttcggcgccgacgccgccgaggtgcccggcaccagaggccacagccagcaggaggccgccatgccccacatccccgaggacgaggagccccccggcgagccccaggccgcccagagccccgccggccagggcccccccgccgccggcgtgagctgcagccccacccccaccatcgtgctgaccggcgacgccaccagccccgagggcgagaccgacaagaacctggccaacagagtgcacagcccccacaagagactgagccacagacacctgaaggtgagcaccgccagcctgaccagcgtggaccccgccggccacatcatcgacctggtgaacgaccagctgcccgacatcagcatcagcgaggaggacaagaagaagaacctggccctgctggaggaggccaagctggtgagcgagagattcctgaccagaagaggcagaaagagcagaagcagccccggcgacagccccagcgccgtgagccccaacctgagccccagcgccagccccaccagcagcagaagcaacagcctgaccgtgcccaccccccccggcctggacgtgtgcagcggcccccccagccccctgcccggcgcccccccccagaagggcgacgaggccgacgtgagcagcccccaccccggcgagcccgagcacatcctgatgagaaaccagaacctggtgggcctgaagctgcccgacctgagcgaggccgccgagcaggagaagggcctgcccagcgagctgagccccgccatcgaggaggaggagagcaagagcggcctggacgtgatgcccaacatcagcgacgtgctgctgagaaagctgagagtgcacagaagcctgcccggcagcgccccccccctgaccgagaaggaggtggagaacgtgttcgtgcagctgagcctggccttcagaaacgacagctacaccctggagagcagaatcaaccaggccgagagagagagaaacctgaccgaggagaacaccgagaaggagctggagaacttcaaggccagcatcaccagcagcgccagcctgtggcaccactgcgagcacagagagacctaccagaagctgctggaggacatcgccgtgctgcacagactggccgccagactgagcagcagagccgaggtggtgggcgccgtgagacaggagaagagaatgagcaaggccaccgaggtgatgatgcagtacgtggagaacctgaagagaacctacgagaaggaccacgccgagctgatggagttcaagaagctggccaaccagaacagcagcagaagctgcggccccagcgaggacggcgtgcccagaaccgccagaagcatgagcctgaccctgggcaagaacatgcccagaagaagagtgagcgtggccgtggtgcccaagttcaacgccctgaacctgcccggccagacccccagcagcagcagcatccccagcctgcccgccctgagcgagagccccaacggcaagggcagcctgcccgtgaccagcgccctgcccgccctgctggagaacggcaagaccaacggcgaccccgactgcgaggccagcgcccccgccctgaccctgagctgcctggaggagctgagccaggagaccaaggccagaatggaggaggaggcctacagcaagggcttccaggagggcctgaagaagaccaaggagctgcaggacctgaaggaggaggaggaggagcagaagagcgagagccccgaggagcccgaggaggtggaggagaccgaggaggaggagaagggccccagaagcagcaagctggaggagctggtgcacttcctgcaggtgatgtaccccaagctgtgccagcactggcaggtgatctggatgatggccgccgtgatgctggtgctgaccgtggtgctgggcctgtacaacagctacaacagctgcgccgagcaggccgacggccccctgggcagaagcacctgcagcgccgcccagagagacagctggtggagcagcggcctgcagcacgagcagcccaccgagcagtag

SEQ ID NO: 19954 - DNA, 1731 bp, Artificial Sequence
  Description of Artificial Sequence: Synthetic coding sequence
atggccgacgccaacaaggccgaggtgcccggcgccaccggcggcgacagcccccacctgcagcccgccgagccccccggcgagcccagaagagagccccaccccgccgaggccgagaagcagcagccccagcacagcagcagcagcaacggcgtgaagatggagaacgacgagagcgccaaggaggagaagagcgacctgaaggagaagagcaccggcagcaagaaggccaacagattccacccctacagcaaggacaagaacagcggcgccggcgagaagaagggccccaacagaaacagagtgttcatcagcaacatcccctacgacatgaagtggcaggccatcaaggacctgatgagagagaaggtgggcgaggtgacctacgtggagctgttcaaggacgccgagggcaagagcagaggctgcggcgtggtggagttcaaggacgaggagttcgtgaagaaggccctggagaccatgaacaagtacgacctgagcggcagacccctgaacatcaaggaggaccccgacggcgagaacgccagaagagccctgcagagaaccggcggcagcttccccggcggccacgtgcccgacatgggcagcggcctgatgaacctgccccccagcatcctgaacaaccccaacatcccccccgaggtgatcagcaacctgcaggccggcagactgggcagcaccatcttcgtggccaacctggacttcaaggtgggctggaagaagctgaaggaggtgttcagcatcgccggcaccgtgaagagagccgacatcaaggaggacaaggacggcaagagcagaggcatgggcaccgtgaccttcgagcaggccatcgaggccgtgcaggccatcagcatgttcaacggccagttcctgttcgacagacccatgcacgtgaagatggacgacaagagcgtgccccacgaggagtacagaagccacgacggcaagaccccccagctgcccagaggcctgggcggcatcggcatgggcctgggccccggcggccagcccatcagcgccagccagctgaacatcggcggcgtgatgggcaacctgggccccggcggcatgggcatggacggccccggcttcggcggcatgaacagaatcggcggcggcatcggcttcggcggcctggaggccatgaacagcatgggcggcttcggcggcgtgggcagaatgggcgagctgtacagaggcgccatgaccagcagcatggagagagacttcggcagaggcgacatcggcatcaaccagggcttcggcgacagcttcggcagactgggcggcggcatgggcagcatgaacagcgtgaccggcggcatgggcatgggcctggacagaatgagcagcagcttcgacagaatgggccccggcatcggcgccatcctggagagaagcatcgacatggacagaggcttcctgagcggccccatgggcagcggcatgagagagagaatcggcagcaagggcaaccagatcttcgtgagaaacctgcccttcgacctgacctggcagaagctgaaggagaagttcagccagtgcggccacgtgatgttcgccgagatcaagatggagaacggcaagagcaagggctgcggcaccgtgagattcgacagccccgagagcgccgagaaggcctgcagaatcatgaacggcatcaagatcagcggcagagagatcgacgtgagactggacagaaacgcctag

SEQ ID NO: 19955 - DNA, 1803 bp, Artificial Sequence
  Description of Artificial Sequence: Synthetic coding sequence
atggccgacgccaacaaggccgaggtgcccggcgccaccggcggcgacagcccccacctgcagcccgccgagccccccggcgagcccagaagagagccccaccccgccgaggccgagaagcagcagccccagcacagcagcagcagcaacggcgtgaagatggagaacgacgagagcgccaaggaggagaagagcgacctgaaggagaagagcaccggcagcaagaaggccaacagattccacccctacagcaaggacaagaacagcggcgccggcgagaagaagggccccaacagaaacagagtgttcatcagcaacatcccctacgacatgaagtggcaggccatcaaggacctgatgagagagaaggtgggcgaggtgacctacgtggagctgttcaaggacgccgagggcaagagcagaggctgcggcgtggtggagttcaaggacgaggagttcgtgaagaaggccctggagaccatgaacaagtacgacctgagcggcagacccctgaacatcaaggaggaccccgacggcgagaacgccagaagagccctgcagagaaccggcggcagcttccccggcggccacgtgcccgacatgggcagcggcctgatgaacctgccccccagcatcctgaacaaccccaacatcccccccgaggtgatcagcaacctgcaggccggcagactgggcagcaccatcttcgtggccaacctggacttcaaggtgggctggaagaagctgaaggaggtgttcagcatcgccggcaccgtgaagagagccgacatcaaggaggacaaggacggcaagagcagaggcatgggcaccgtgaccttcgagcaggccatcgaggccgtgcaggccatcagcatgttcaacggccagttcctgttcgacagacccatgcacgtgaagatggacgacaagagcgtgccccacgaggagtacagaagccacgacggcaagaccccccagctgcccagaggcctgggcggcatcggcatgggcctgggccccggcggccagcccatcagcgccagccagctgaacatcggcggcgtgatgggcaacctgggccccggcggcatgggcatggacggccccggcttcggcggcatgaacagaatcggcggcggcatcggcttcggcggcctggaggccatgaacagcatgggcggcttcggcggcgtgggcagaatgggcgagctgtacagaggcgccatgaccagcagcatggagagagacttcggcagaggcgacatcggcatcaaccagggcttcggcgacagcttcggcagactgggcagcgccatgatcggcggcttcgccggcagaatcggcagcagcaacatgggccccgtgggcagcggcatcagcggcggcatgggcagcatgaacagcgtgaccggcggcatgggcatgggcctggacagaatgagcagcagcttcgacagaatgggccccggcatcggcgccatcctggagagaagcatcgacatggacagaggcttcctgagcggccccatgggcagcggcatgagagagagaatcggcagcaagggcaaccagatcttcgtgagaaacctgcccttcgacctgacctggcagaagctgaaggagaagttcagccagtgcggccacgtgatgttcgccgagatcaagatggagaacggcaagagcaagggctgcggcaccgtgagattcgacagccccgagagcgccgagaaggcctgcagaatcatgaacggcatcaagatcagcggcagagagatcgacgtgagactggacagaaacgcctag

SEQ ID NO: 19956 - DNA, 567 bp, Artificial Sequence
  Description of Artificial Sequence: Synthetic coding sequence
atgaacagcatgggcggcttcggcggcgtgggcagaatgggcgagctgtacagaggcgccatgaccagcagcatggagagagacttcggcagaggcgacatcggcatcaaccagggcttcggcgacagcttcggcagactgggcggcggcatgggcagcatgaacagcgtgaccggcggcatgggcatgggcctggacagaatgagcagcagcttcgacagaatgggccccggcatcggcgccatcctggagagaagcatcgacatggacagaggcttcctgagcggccccatgggcagcggcatgagagagagaatcggcagcaagggcaaccagatcttcgtgagaaacctgcccttcgacctgacctggcagaagctgaaggagaagttcagccagtgcggccacgtgatgttcgccgagatcaagatggagaacggcaagagcaagggctgcggcaccgtgagattcgacagccccgagagcgccgagaaggcctgcagaatcatgaacggcatcaagatcagcggcagagagatcgacgtgagactggacagaaacgcctag

SEQ ID NO: 19957 - DNA, 381 bp, Artificial Sequence
  Description of Artificial Sequence: Synthetic coding sequence
tgaggcctggacagaatgagcagcagcttcgacagaatgggccccggcatcggcgccatcctggagagaagcatcgacatggacagaggcttcctgagcggccccatgggcagcggcatgagagagagaatcggcagcaagggcaaccagatcttcgtgagaaacctgcccttcgacctgacctggcagaagctgaaggagaagttcagccagtgcggccacgtgatgttcgccgagatcaagatggagaacggcaagagcaagggctgcggcaccgtgagattcgacagccccgagagcgccgagaaggcctgcagaatcatgaacggcatcaagatcagcggcagagagatcgacgtgagactggacagaaacgcctag

SEQ ID NO: 19958 - DNA, 810 bp, Artificial Sequence
  Description of Artificial Sequence: Synthetic coding sequence
atggccgccagcgccggcgccggcgccgtgatcgccgcccccgacagcagaagatggctgtggagcgtgctggccgccgccctgggcctgctgaccgccggcgtgagcgccctggaggtgtacacccccaaggagatcttcgtggccaacggcacccagggcaagctgacctgcaagttcaagagcaccagcaccaccggcggcctgaccagcgtgagctggagcttccagcccgagggcgccgacaccaccgtgagcttcttccactacagccagggccaggtgtacctgggcaactacccccccttcaaggacagaatcagctgggccggcgacctggacaagaaggacgccagcatcaacatcgagaacatgcagttcatccacaacggcacctacatctgcgacgtgaagaacccccccgacatcgtggtgcagcccggccacatcagactgtacgtggtggagaaggagaacctgcccgtgttccccgtgtgggtggtggtgggcatcgtgaccgccgtggtgctgggcctgaccctgctgatcagcatgatcctggccgtgctgtacagaagaaagaacagcaagagagactacaccggctgcagcaccagcgagagcctgagccccgtgaagcaggcccccagaaagagccccagcgacaccgagggcctggtgaagagcctgcccagcggcagccaccagggccccgtgatctacgcccagctggaccacagcggcggccaccacagcgacaagatcaacaagagcgagagcgtggtgtacgccgacatcagaaagaactag

SEQ ID NO: 19959 - DNA, 630 bp, Artificial Sequence
  Description of Artificial Sequence: Synthetic coding sequence
atggccgccagcgccggcgccggcgccgtgatcgccgcccccgacagcagaagatggctgtggagcgtgctggccgccgccctgggcctgctgaccgccggcgtgagcgccctggaggtgtacacccccaaggagatcttcgtggccaacggcacccagggcaagctgacctgcaagttcaagagcaccagcaccaccggcggcctgaccagcgtgagctggagcttccagcccgagggcgccgacaccaccgtgagcttcttccactacagccagggccaggtgtacctgggcaactacccccccttcaaggacagaatcagctgggccggcgacctggacaagaaggacgccagcatcaacatcgagaacatgcagttcatccacaacggcacctacatctgcgacgtgaagaacccccccgacatcgtggtgcagcccggccacatcagactgtacgtggtggagaaggagaacctgcccgtgttccccgtgtgggtggtggtgggcatcgtgaccgccgtggtgctgggcctgaccctgctgatcagcatgatcctggccgtgctgtacagaagaaagaacagcaagagagactacaccggcgcccagagctacatgcacagctag

SEQ ID NO: 19960 - DNA, 360 bp, Artificial Sequence
  Description of Artificial Sequence: Synthetic coding sequence
atggccgccagcgccggcgccggcgccgtgatcgccgcccccgacagcagaagatggctgtggagcgtgctggccgccgccctgggcctgctgaccgccggcgtgagcgccctggaggtgtacacccccaaggagatcttcgtggccaacggcacccagggcaagctgacctgcaagttcaagagcaccagcaccaccggcggcctgaccagcgtgagctggagcttccagcccgagggcgccgacaccaccgtgagcggccccgtgatctacgcccagctggaccacagcggcggccaccacagcgacaagatcaacaagagcgagagcgtggtgtacgccgacatcagaaagaactag

SEQ ID NO: 19961 - DNA, 6147 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcgacggcgaggaggacgagggcgacgaggacagactggacaacgccgtgagaggccccggccccaagggccccgtgggcaccgtgagcgaggcccagctggccagaagactgaccaaggtgaagaacagcagaagaatgctgagcaacaagccccaggacttccagatcagagtgagagtgatcgagggcagacagctgagcggcaacaacatcagacccgtggtgaaggtgcacgtgtgcggccagacccacagaaccagaatcaagagaggcaacaaccccttcttcgacgagctgttcttctacaacgtgaacatgacccccagcgagctgatggacgagatcatcagcatcagagtgtacaacagccacagcctgagagccgactgcctgatgggcgagttcaagatcgacgtgggcttcgtgtacgacgagcccggccacgccgtgatgagaaagtggctgctgctgaacgaccccgaggacaccagcagcggcagcaagggctacatgaaggtgagcatgttcgtgctgggcaccggcgacgagcccccccccgagagaagagacagagacaacgacagcgacgacgtggagagcaacctgctgctgcccgccggcatcgccctgagatgggtgaccttcctgctgaagatctacagagccgaggacatcccccagatggacgacgccttcagccagaccgtgaaggagatcttcggcggcaacgccgacaagaagaacctggtggaccccttcgtggaggtgagcttcgccggcaagaaggtgtgcaccaacatcatcgagaagaacgccaaccccgagtggaaccaggtggtgaacctgcagatcaagttccccagcgtgtgcgagaagatcaagctgaccatctacgactgggacagactgaccaagaacgacgtggtgggcaccacctacctgcacctgagcaagatcgccgccagcggcggcgaggtggaggtgaacaccggcgagaccgaggtgggcttcgtgcccaccttcggcccctgctacctgaacctgtacggcagccccagagagtacaccggcttccccgacccctacgacgagctgaacaccggcaagggcgagggcgtggcctacagaggcagaatcctggtggagctggccaccttcctggagaagaccccccccgacaagaagctggagcccatcagcaacgacgacctgctggtggtggagaagtaccagagaagaagaaagtacagcctgagcgccgtgttccacagcgccaccatgctgcaggacgtgggcgaggccatccagttcgaggtgagcatcggcaactacggcaacaagttcgacaccacctgcaagcccctggccagcaccacccagtacagcagagccgtgttcgacggcaactactactactacctgccctgggcccacaccaagcccgtggtgaccctgaccagctactgggaggacatcagccacagactggacgccgtgaacaccctgctggccatggccgagagactgcagaccaacatcgaggccctgaagagcggcatccagggcaagatccccgccaaccagctggccgagctgtggctgaagctgatcgacgaggtgatcgaggacaccagatacaccctgcccctgaccgagggcaaggccaacgtgaccgtgctggacacccagatcagaaagctgagaagcagaagcctgagccagatccacgaggccgccgtgagaatgagaagcgaggccaccgacgtgaagagcaccctggccgagatcgaggactggctggacaagctgatgcagctgaccgaggagccccagaacagcatgcccgacatcatcatctggatgatcagaggcgagaagagactggcctacgccagaatccccgcccaccaggtgctgtacagcaccagcggcgagaacgccagcggcaagtactgcggcaagacccagaccatcttcctgaagtacccccaggagaagaacaacggccccaaggtgcccgtggagctgagagtgaacatctggctgggcctgagcgccgtggagaagaagttcaacagcttcgccgagggcaccttcaccgtgttcgccgagatgtacgagaaccaggccctgatgttcggcaagtggggcaccagcggcctggtgggcagacacaagttcagcgacgtgaccggcaagatcaagctgaagagagagttcttcctgccccccaagggctgggagtgggagggcgagtggatcgtggaccccgagagaagcctgctgaccgaggccgacgccggccacaccgagttcaccgacgaggtgtaccagaacgagagcagataccccggcggcgactggaagcccgccgaggacacctacaccgacgccaacggcgacaaggccgccagccccagcgagctgacctgcccccccggctgggagtgggaggacgacgcctggagctacgacatcaacagagccgtggacgagaagggctgggagtacggcatcaccatcccccccgaccacaagcccaagagctgggtggccgccgagaagatgtaccacacccacagaagaagaagactggtgagaaagagaaagaaggacctgacccagaccgccagcagcaccgccagagccatggaggagctgcaggaccaggagggctgggagtacgccagcctgatcggctggaagttccactggaagcagagaagcagcgacaccttcagaagaagaagatggagaagaaagatggcccccagcgagacccacggcgccgccgccatcttcaagctggagggcgccctgggcgccgacaccaccgaggacggcgacgagaagagcctggagaagcagaagcacagcgccaccaccgtgttcggcgccaacacccccatcgtgagctgcaacttcgacagagtgtacatctaccacctgagatgctacgtgtaccaggccagaaacctgctggccctggacaaggacagcttcagcgacccctacgcccacatctgcttcctgcacagaagcaagaccaccgagatcatccacagcaccctgaaccccacctgggaccagaccatcatcttcgacgaggtggagatctacggcgagccccagaccgtgctgcagaacccccccaaggtgatcatggagctgttcgacaacgaccaggtgggcaaggacgagttcctgggcagaagcatcttcagccccgtggtgaagctgaacagcgagatggacatcacccccaagctgctgtggcaccccgtgatgaacggcgacaaggcctgcggcgacgtgctggtgaccgccgagctgatcctgagaggcaaggacggcagcaacctgcccatcctgcccccccagagagcccccaacctgtacatggtgccccagggcatcagacccgtggtgcagctgaccgccatcgagatcctggcctggggcctgagaaacatgaagaacttccagatggccagcatcaccagccccagcctggtggtggagtgcggcggcgagagagtggagagcgtggtgatcaagaacctgaagaagacccccaacttccccagcagcgtgctgttcatgaaggtgttcctgcccaaggaggagctgtacatgccccccctggtgatcaaggtgatcgaccacagacagttcggcagaaagcccgtggtgggccagtgcaccatcgagagactggacagattcagatgcgacccctacgccggcaaggaggacatcgtgccccagctgaaggccagcctgctgagcgcccccccctgcagagacatcgtgatcgagatggaggacaccaagcccctgctggccagcaagctgaccgagaaggaggaggagatcgtggactggtggagcaagttctacgccagcagcggcgagcacgagaagtgcggccagtacatccagaagggctacagcaagctgaagatctacaactgcgagctggagaacgtggccgagttcgagggcctgaccgacttcagcgacaccttcaagctgtacagaggcaagagcgacgagaacgaggaccccagcgtggtgggcgagttcaagggcagcttcagaatctaccccctgcccgacgaccccagcgtgcccgccccccccagacagttcagagagctgcccgacagcgtgccccaggagtgcaccgtgagaatctacatcgtgagaggcctggagctgcagccccaggacaacaacggcctgtgcgacccctacatcaagatcaccctgggcaagaaggtgatcgaggacagagaccactacatccccaacaccctgaaccccgtgttcggcagaatgtacgagctgagctgctacctgccccaggagaaggacctgaagatcagcgtgtacgactacgacaccttcaccagagacgagaaggtgggcgagaccatcatcgacctggagaacagattcctgagcagattcggcagccactgcggcatccccgaggagtactgcgtgagcggcgtgaacacctggagagaccagctgagacccacccagctgctgcagaacgtggccagattcaagggcttcccccagcccatcctgagcgaggacggcagcagaatcagatacggcggcagagactacagcctggacgagttcgaggccaacaagatcctgcaccagcacctgggcgcccccgaggagagactggccctgcacatcctgagaacccagggcctggtgcccgagcacgtggagaccagaaccctgcacagcaccttccagcccaacatcagccagggcaagctgcagatgtgggtggacgtgttccccaagagcctgggcccccccggcccccccttcaacatcacccccagaaaggccaagaagtactacctgagagtgatcatctggaacaccaaggacgtgatcctggacgagaagagcatcaccggcgaggagatgagcgacatctacgtgaagggctggatccccggcaacgaggagaacaagcagaagaccgacgtgcactacagaagcctggacggcgagggcaacttcaactggagattcgtgttccccttcgactacctgcccgccgagcagctgtgcatcgtggccaagaaggagcacttctggagcatcgaccagaccgagttcagaatcccccccagactgatcatccagatctgggacaacgacaagttcagcctggacgactacctgggcttcctggagctggacctgagacacaccatcatccccgccaagagccccgagaagtgcagactggacatgatccccgacctgaaggccatgaaccccctgaaggccaagaccgccagcctgttcgagcagaagagcatgaagggctggtggccctgctacgccgagaaggacggcgccagagtgatggccggcaaggtggagatgaccctggagatcctgaacgagaaggaggccgacgagagacccgccggcaagggcagagacgagcccaacatgaaccccaagctggacctgcccaacagacccgagaccagcttcctgtggttcaccaacccctgcaagaccatgaagttcatcgtgtggagaagattcaagtgggtgatcatcggcctgctgttcctgctgatcctgctgctgttcgtggccgtgctgctgtacagcctgcccaactacctgagcatgaagatcgtgaagcccaacgtgtag

SEQ ID NO: 19962 - DNA, 6186 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcgacggcgaggaggacgagggcgacgaggacagactggacaacgccgtgagaggccccggccccaagggccccgtgggcaccgtgagcgaggcccagctggccagaagactgaccaaggtgaagaacagcagaagaatgctgagcaacaagccccaggacttccagatcagagtgagagtgatcgagggcagacagctgagcggcaacaacatcagacccgtggtgaaggtgcacgtgtgcggccagacccacagaaccagaatcaagagaggcaacaaccccttcttcgacgagctgttcttctacaacgtgaacatgacccccagcgagctgatggacgagatcatcagcatcagagtgtacaacagccacagcctgagagccgactgcctgatgggcgagttcaagatcgacgtgggcttcgtgtacgacgagcccggccacgccgtgatgagaaagtggctgctgctgaacgaccccgaggacaccagcagcggcagcaagggctacatgaaggtgagcatgttcgtgctgggcaccggcgacgagcccccccccgagagaagagacagagacaacgacagcgacgacgtggagagcaacctgctgctgcccgccggcatcgccctgagatgggtgaccttcctgctgaagatctacagagccgaggacatcccccagatggacgacgccttcagccagaccgtgaaggagatcttcggcggcaacgccgacaagaagaacctggtggaccccttcgtggaggtgagcttcgccggcaagaaggtgtgcaccaacatcatcgagaagaacgccaaccccgagtggaaccaggtggtgaacctgcagatcaagttccccagcgtgtgcgagaagatcaagctgaccatctacgactgggacagactgaccaagaacgacgtggtgggcaccacctacctgcacctgagcaagatcgccgccagcggcggcgaggtggaggacttcagcagcagcggcaccggcgccgccagctacaccgtgaacaccggcgagaccgaggtgggcttcgtgcccaccttcggcccctgctacctgaacctgtacggcagccccagagagtacaccggcttccccgacccctacgacgagctgaacaccggcaagggcgagggcgtggcctacagaggcagaatcctggtggagctggccaccttcctggagaagaccccccccgacaagaagctggagcccatcagcaacgacgacctgctggtggtggagaagtaccagagaagaagaaagtacagcctgagcgccgtgttccacagcgccaccatgctgcaggacgtgggcgaggccatccagttcgaggtgagcatcggcaactacggcaacaagttcgacaccacctgcaagcccctggccagcaccacccagtacagcagagccgtgttcgacggcaactactactactacctgccctgggcccacaccaagcccgtggtgaccctgaccagctactgggaggacatcagccacagactggacgccgtgaacaccctgctggccatggccgagagactgcagaccaacatcgaggccctgaagagcggcatccagggcaagatccccgccaaccagctggccgagctgtggctgaagctgatcgacgaggtgatcgaggacaccagatacaccctgcccctgaccgagggcaaggccaacgtgaccgtgctggacacccagatcagaaagctgagaagcagaagcctgagccagatccacgaggccgccgtgagaatgagaagcgaggccaccgacgtgaagagcaccctggccgagatcgaggactggctggacaagctgatgcagctgaccgaggagccccagaacagcatgcccgacatcatcatctggatgatcagaggcgagaagagactggcctacgccagaatccccgcccaccaggtgctgtacagcaccagcggcgagaacgccagcggcaagtactgcggcaagacccagaccatcttcctgaagtacccccaggagaagaacaacggccccaaggtgcccgtggagctgagagtgaacatctggctgggcctgagcgccgtggagaagaagttcaacagcttcgccgagggcaccttcaccgtgttcgccgagatgtacgagaaccaggccctgatgttcggcaagtggggcaccagcggcctggtgggcagacacaagttcagcgacgtgaccggcaagatcaagctgaagagagagttcttcctgccccccaagggctgggagtgggagggcgagtggatcgtggaccccgagagaagcctgctgaccgaggccgacgccggccacaccgagttcaccgacgaggtgtaccagaacgagagcagataccccggcggcgactggaagcccgccgaggacacctacaccgacgccaacggcgacaaggccgccagccccagcgagctgacctgcccccccggctgggagtgggaggacgacgcctggagctacgacatcaacagagccgtggacgagaagggctgggagtacggcatcaccatcccccccgaccacaagcccaagagctgggtggccgccgagaagatgtaccacacccacagaagaagaagactggtgagaaagagaaagaaggacctgacccagaccgccagcagcaccgccagagccatggaggagctgcaggaccaggagggctgggagtacgccagcctgatcggctggaagttccactggaagcagagaagcagcgacaccttcagaagaagaagatggagaagaaagatggcccccagcgagacccacggcgccgccgccatcttcaagctggagggcgccctgggcgccgacaccaccgaggacggcgacgagaagagcctggagaagcagaagcacagcgccaccaccgtgttcggcgccaacacccccatcgtgagctgcaacttcgacagagtgtacatctaccacctgagatgctacgtgtaccaggccagaaacctgctggccctggacaaggacagcttcagcgacccctacgcccacatctgcttcctgcacagaagcaagaccaccgagatcatccacagcaccctgaaccccacctgggaccagaccatcatcttcgacgaggtggagatctacggcgagccccagaccgtgctgcagaacccccccaaggtgatcatggagctgttcgacaacgaccaggtgggcaaggacgagttcctgggcagaagcatcttcagccccgtggtgaagctgaacagcgagatggacatcacccccaagctgctgtggcaccccgtgatgaacggcgacaaggcctgcggcgacgtgctggtgaccgccgagctgatcctgagaggcaaggacggcagcaacctgcccatcctgcccccccagagagcccccaacctgtacatggtgccccagggcatcagacccgtggtgcagctgaccgccatcgagatcctggcctggggcctgagaaacatgaagaacttccagatggccagcatcaccagccccagcctggtggtggagtgcggcggcgagagagtggagagcgtggtgatcaagaacctgaagaagacccccaacttccccagcagcgtgctgttcatgaaggtgttcctgcccaaggaggagctgtacatgccccccctggtgatcaaggtgatcgaccacagacagttcggcagaaagcccgtggtgggccagtgcaccatcgagagactggacagattcagatgcgacccctacgccggcaaggaggacatcgtgccccagctgaaggccagcctgctgagcgcccccccctgcagagacatcgtgatcgagatggaggacaccaagcccctgctggccagcaagctgaccgagaaggaggaggagatcgtggactggtggagcaagttctacgccagcagcggcgagcacgagaagtgcggccagtacatccagaagggctacagcaagctgaagatctacaactgcgagctggagaacgtggccgagttcgagggcctgaccgacttcagcgacaccttcaagctgtacagaggcaagagcgacgagaacgaggaccccagcgtggtgggcgagttcaagggcagcttcagaatctaccccctgcccgacgaccccagcgtgcccgccccccccagacagttcagagagctgcccgacagcgtgccccaggagtgcaccgtgagaatctacatcgtgagaggcctggagctgcagccccaggacaacaacggcctgtgcgacccctacatcaagatcaccctgggcaagaaggtgatcgaggacagagaccactacatccccaacaccctgaaccccgtgttcggcagaatgtacgagctgagctgctacctgccccaggagaaggacctgaagatcagcgtgtacgactacgacaccttcaccagagacgagaaggtgggcgagaccatcatcgacctggagaacagattcctgagcagattcggcagccactgcggcatccccgaggagtactgcgtgagcggcgtgaacacctggagagaccagctgagacccacccagctgctgcagaacgtggccagattcaagggcttcccccagcccatcctgagcgaggacggcagcagaatcagatacggcggcagagactacagcctggacgagttcgaggccaacaagatcctgcaccagcacctgggcgcccccgaggagagactggccctgcacatcctgagaacccagggcctggtgcccgagcacgtggagaccagaaccctgcacagcaccttccagcccaacatcagccagggcaagctgcagatgtgggtggacgtgttccccaagagcctgggcccccccggcccccccttcaacatcacccccagaaaggccaagaagtactacctgagagtgatcatctggaacaccaaggacgtgatcctggacgagaagagcatcaccggcgaggagatgagcgacatctacgtgaagggctggatccccggcaacgaggagaacaagcagaagaccgacgtgcactacagaagcctggacggcgagggcaacttcaactggagattcgtgttccccttcgactacctgcccgccgagcagctgtgcatcgtggccaagaaggagcacttctggagcatcgaccagaccgagttcagaatcccccccagactgatcatccagatctgggacaacgacaagttcagcctggacgactacctgggcttcctggagctggacctgagacacaccatcatccccgccaagagccccgagaagtgcagactggacatgatccccgacctgaaggccatgaaccccctgaaggccaagaccgccagcctgttcgagcagaagagcatgaagggctggtggccctgctacgccgagaaggacggcgccagagtgatggccggcaaggtggagatgaccctggagatcctgaacgagaaggaggccgacgagagacccgccggcaagggcagagacgagcccaacatgaaccccaagctggacctgcccaacagacccgagaccagcttcctgtggttcaccaacccctgcaagaccatgaagttcatcgtgtggagaagattcaagtgggtgatcatcggcctgctgttcctgctgatcctgctgctgttcgtggccgtgctgctgtacagcctgcccaactacctgagcatgaagatcgtgaagcccaacgtgtag

SEQ ID NO: 19963 - DNA, 483 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcaagctgaccctgctgaaggcccagcccccccccggcggcggctgctag

SEQ ID NO: 19964 - DNA, 1338 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcgacggcgaggaggacgagggcgacgaggacagactggacaacgccgtgagaggccccggccccaagggccccgtgggcaccgtgagcgaggcccagctggccagaagactgaccaaggtgaagaacagcagaagaatgctgagcaacaagccccaggacttccagatcagagtgagagtgatcgagggcagacagctgagcggcaacaacatcagacccgtggtgaaggtgcacgtgtgcggccagacccacagaaccagaatcaagagaggcaacaaccccttcttcgacgagctgttcttctacaacgtgaacatgacccccagcgagctgatggacgagatcatcagcatcagagtgtacaacagccacagcctgagagccgactgcctgatgggcgagttcaagatcgacgtgggcttcgtgtacgacgagcccggccacgccgtgatgagaaagtggctgctgctgaacgaccccgaggacaccagcagcggcagcaagggctacatgaaggtgagcatgttcgtgctgggcaccggcgacgagcccccccccgagagaagagacagagacaacgacagcgacgacgtggagagcaacctgctgctgcccgccggcatcgccctgagatgggtgaccttcctgctgaagatctacagagccgaggacatcccccagatggacgacgccttcagccagaccgtgaaggagatcttcggcggcaacgccgacaagaagaacctggtggaccccttcgtggaggtgagcttcgccggcaagaaggtgtgcaccaacatcatcgagaagaacgccaaccccgagtggaaccaggtggtgaacctgcagatcaagttccccagcgtgtgcgagaagatcaagctgaccatctacgactggtag

SEQ ID NO: 19965 - DNA, 6186 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcgacggcgaggaggacgagggcgacgaggacagactggacaacgccgtgagaggccccggccccaagggccccgtgggcaccgtgagcgaggcccagctggccagaagactgaccaaggtgaagaacagcagaagaatgctgagcaacaagccccaggacttccagatcagagtgagagtgatcgagggcagacagctgagcggcaacaacatcagacccgtggtgaaggtgcacgtgtgcggccagacccacagaaccagaatcaagagaggcaacaaccccttcttcgacgagctgttcttctacaacgtgaacatgacccccagcgagctgatggacgagatcatcagcatcagagtgtacaacagccacagcctgagagccgactgcctgatgggcgagttcaagatcgacgtgggcttcgtgtacgacgagcccggccacgccgtgatgagaaagtggctgctgctgaacgaccccgaggacaccagcagcggcagcaagggctacatgaaggtgagcatgttcgtgctgggcaccggcgacgagcccccccccgagagaagagacagagacaacgacagcgacgacgtggagagcaacctgctgctgcccgccggcatcgccctgagatgggtgaccttcctgctgaagatctacagagccgaggacatcccccagatggacgacgccttcagccagaccgtgaaggagatcttcggcggcaacgccgacaagaagaacctggtggaccccttcgtggaggtgagcttcgccggcaagaaggtgtgcaccaacatcatcgagaagaacgccaaccccgagtggaaccaggtggtgaacctgcagatcaagttccccagcgtgtgcgagaagatcaagctgaccatctacgactgggacagactgaccaagaacgacgtggtgggcaccacctacctgcacctgagcaagatcgccgccagcggcggcgaggtggaggacttcagcagcagcggcaccggcgccgccagctacaccgtgaacaccggcgagaccgaggtgggcttcgtgcccaccttcggcccctgctacctgaacctgtacggcagccccagagagtacaccggcttccccgacccctacgacgagctgaacaccggcaagggcgagggcgtggcctacagaggcagaatcctggtggagctggccaccttcctggagaagaccccccccgacaagaagctggagcccatcagcaacgacgacctgctggtggtggagaagtaccagagaagaagaaagtacagcctgagcgccgtgttccacagcgccaccatgctgcaggacgtgggcgaggccatccagttcgaggtgagcatcggcaactacggcaacaagttcgacaccacctgcaagcccctggccagcaccacccagtacagcagagccgtgttcgacggcaactactactactacctgccctgggcccacaccaagcccgtggtgaccctgaccagctactgggaggacatcagccacagactggacgccgtgaacaccctgctggccatggccgagagactgcagaccaacatcgaggccctgaagagcggcatccagggcaagatccccgccaaccagctggccgagctgtggctgaagctgatcgacgaggtgatcgaggacaccagatacaccctgcccctgaccgagggcaaggccaacgtgaccgtgctggacacccagatcagaaagctgagaagcagaagcctgagccagatccacgaggccgccgtgagaatgagaagcgaggccaccgacgtgaagagcaccctggccgagatcgaggactggctggacaagctgatgcagctgaccgaggagccccagaacagcatgcccgacatcatcatctggatgatcagaggcgagaagagactggcctacgccagaatccccgcccaccaggtgctgtacagcaccagcggcgagaacgccagcggcaagtactgcggcaagacccagaccatcttcctgaagtacccccaggagaagaacaacggccccaaggtgcccgtggagctgagagtgaacatctggctgggcctgagcgccgtggagaagaagttcaacagcttcgccgagggcaccttcaccgtgttcgccgagatgtacgagaaccaggccctgatgttcggcaagtggggcaccagcggcctggtgggcagacacaagttcagcgacgtgaccggcaagatcaagctgaagagagagttcttcctgccccccaagggctgggagtgggagggcgagtggatcgtggaccccgagagaagcctgctgaccgaggccgacgccggccacaccgagttcaccgacgaggtgtaccagaacgagagcagataccccggcggcgactggaagcccgccgaggacacctacaccgacgccaacggcgacaaggccgccagccccagcgagctgacctgcccccccggctgggagtgggaggacgacgcctggagctacgacatcaacagagccgtggacgagaagggctgggagtacggcatcaccatcccccccgaccacaagcccaagagctgggtggccgccgagaagatgtaccacacccacagaagaagaagactggtgagaaagagaaagaaggacctgacccagaccgccagcagcaccgccagagccatggaggagctgcaggaccaggagggctgggagtacgccagcctgatcggctggaagttccactggaagcagagaagcagcgacaccttcagaagaagaagatggagaagaaagatggcccccagcgagacccacggcgccgccgccatcttcaagctggagggcgccctgggcgccgacaccaccgaggacggcgacgagaagagcctggagaagcagaagcacagcgccaccaccgtgttcggcgccaacacccccatcgtgagctgcaacttcgacagagtgtacatctaccacctgagatgctacgtgtaccaggccagaaacctgctggccctggacaaggacagcttcagcgacccctacgcccacatctgcttcctgcacagaagcaagaccaccgagatcatccacagcaccctgaaccccacctgggaccagaccatcatcttcgacgaggtggagatctacggcgagccccagaccgtgctgcagaacccccccaaggtgatcatggagctgttcgacaacgaccaggtgggcaaggacgagttcctgggcagaagcatcttcagccccgtggtgaagctgaacagcgagatggacatcacccccaagctgctgtggcaccccgtgatgaacggcgacaaggcctgcggcgacgtgctggtgaccgccgagctgatcctgagaggcaaggacggcagcaacctgcccatcctgcccccccagagagcccccaacctgtacatggtgccccagggcatcagacccgtggtgcagctgaccgccatcgagatcctggcctggggcctgagaaacatgaagaacttccagatggccagcatcaccagccccagcctggtggtggagtgcggcggcgagagagtggagagcgtggtgatcaagaacctgaagaagacccccaacttccccagcagcgtgctgttcatgaaggtgttcctgcccaaggaggagctgtacatgccccccctggtgatcaaggtgatcgaccacagacagttcggcagaaagcccgtggtgggccagtgcaccatcgagagactggacagattcagatgcgacccctacgccggcaaggaggacatcgtgccccagctgaaggccagcctgctgagcgcccccccctgcagagacatcgtgatcgagatggaggacaccaagcccctgctggccagcaagctggtgagcatcgaggaggagatcgtggactggtggagcaagttctacgccagcagcggcgagcacgagaagtgcggccagtacatccagaagggctacagcaagctgaagatctacaactgcgagctggagaacgtggccgagttcgagggcctgaccgacttcagcgacaccttcaagctgtacagaggcaagagcgacgagaacgaggaccccagcgtggtgggcgagttcaagggcagcttcagaatctaccccctgcccgacgaccccagcgtgcccgccccccccagacagttcagagagctgcccgacagcgtgccccaggagtgcaccgtgagaatctacatcgtgagaggcctggagctgcagccccaggacaacaacggcctgtgcgacccctacatcaagatcaccctgggcaagaaggtgatcgaggacagagaccactacatccccaacaccctgaaccccgtgttcggcagaatgtacgagctgagctgctacctgccccaggagaaggacctgaagatcagcgtgtacgactacgacaccttcaccagagacgagaaggtgggcgagaccatcatcgacctggagaacagattcctgagcagattcggcagccactgcggcatccccgaggagtactgcgtgagcggcgtgaacacctggagagaccagctgagacccacccagctgctgcagaacgtggccagattcaagggcttcccccagcccatcctgagcgaggacggcagcagaatcagatacggcggcagagactacagcctggacgagttcgaggccaacaagatcctgcaccagcacctgggcgcccccgaggagagactggccctgcacatcctgagaacccagggcctggtgcccgagcacgtggagaccagaaccctgcacagcaccttccagcccaacatcagccagggcaagctgcagatgtgggtggacgtgttccccaagagcctgggcccccccggcccccccttcaacatcacccccagaaaggccaagaagtactacctgagagtgatcatctggaacaccaaggacgtgatcctggacgagaagagcatcaccggcgaggagatgagcgacatctacgtgaagggctggatccccggcaacgaggagaacaagcagaagaccgacgtgcactacagaagcctggacggcgagggcaacttcaactggagattcgtgttccccttcgactacctgcccgccgagcagctgtgcatcgtggccaagaaggagcacttctggagcatcgaccagaccgagttcagaatcccccccagactgatcatccagatctgggacaacgacaagttcagcctggacgactacctgggcttcctggagctggacctgagacacaccatcatccccgccaagagccccgagaagtgcagactggacatgatccccgacctgaaggccatgaaccccctgaaggccaagaccgccagcctgttcgagcagaagagcatgaagggctggtggccctgctacgccgagaaggacggcgccagagtgatggccggcaaggtggagatgaccctggagatcctgaacgagaaggaggccgacgagagacccgccggcaagggcagagacgagcccaacatgaaccccaagctggacctgcccaacagacccgagaccagcttcctgtggttcaccaacccctgcaagaccatgaagttcatcgtgtggagaagattcaagtgggtgatcatcggcctgctgttcctgctgatcctgctgctgttcgtggccgtgctgctgtacagcctgcccaactacctgagcatgaagatcgtgaagcccaacgtgtag

SEQ ID NO: 19966 - DNA, 6156 bp, Artificial Sequence
  Description of Artificial Sequence: Synthetic coding sequence
atgctgagagtgatcgtggagagcgccagcaacatccccaagaccaagttcggcaagcccgaccccatcgtgagcgtgatcttcaaggacgagaagaagaagaccaagaaggtggacaacgagctgaaccccgtgtggaacgagatcctggagttcgacctgagaggcatccccctggacttcagcagcagcctgggcatcatcgtgaaggacttcgagaccatcggccagaacaagctgatcggcaccgccaccgtggccctgaaggacctgaccggcgaccagagcagaagcctgccctacaagctgatcagcctgctgaacgagaagggccaggacaccggcgccaccatcgacctggtgatcggctacgacccccccagcgccccccaccccaacgacctgagcggccccagcgtgcccggcatgggcggcgacggcgaggaggacgagggcgacgaggacagactggacaacgccgtgagaggccccggccccaagggccccgtgggcaccgtgagcgaggcccagctggccagaagactgaccaaggtgaagaacagcagaagaatgctgagcaacaagccccaggacttccagatcagagtgagagtgatcgagggcagacagctgagcggcaacaacatcagacccgtggtgaaggtgcacgtgtgcggccagacccacagaaccagaatcaagagaggcaacaaccccttcttcgacgagctgttcttctacaacgtgaacatgacccccagcgagctgatggacgagatcatcagcatcagagtgtacaacagccacagcctgagagccgactgcctgatgggcgagttcaagatcgacgtgggcttcgtgtacgacgagcccggccacgccgtgatgagaaagtggctgctgctgaacgaccccgaggacaccagcagcggcagcaagggctacatgaaggtgagcatgttcgtgctgggcaccggcgacgagcccccccccgagagaagagacagagacaacgacagcgacgacgtggagagcaacctgctgctgcccgccggcatcgccctgagatgggtgaccttcctgctgaagatctacagagccgaggacatcccccagatggacgacgccttcagccagaccgtgaaggagatcttcggcggcaacgccgacaagaagaacctggtggaccccttcgtggaggtgagcttcgccggcaagaaggtgtgcaccaacatcatcgagaagaacgccaaccccgagtggaaccaggtggtgaacctgcagatcaagttccccagcgtgtgcgagaagatcaagctgaccatctacgactgggacagactgaccaagaacgacgtggtgggcaccacctacctgcacctgagcaagatcgccgccagcggcggcgaggtggaggacttcagcagcagcggcaccggcgccgccagctacaccgtgaacaccggcgagaccgaggtgggcttcgtgcccaccttcggcccctgctacctgaacctgtacggcagccccagagagtacaccggcttccccgacccctacgacgagctgaacaccggcaagggcgagggcgtggcctacagaggcagaatcctggtggagctggccaccttcctggagaagaccccccccgacaagaagctggagcccatcagcaacgacgacctgctggtggtggagaagtaccagagaagaagaaagtacagcctgagcgccgtgttccacagcgccaccatgctgcaggacgtgggcgaggccatccagttcgaggtgagcatcggcaactacggcaacaagttcgacaccacctgcaagcccctggccagcaccacccagtacagcagagccgtgttcgacggcaactactactactacctgccctgggcccacaccaagcccgtggtgaccctgaccagctactgggaggacatcagccacagactggacgccgtgaacaccctgctggccatggccgagagactgcagaccaacatcgaggccctgaagagcggcatccagggcaagatccccgccaaccagctggccgagctgtggctgaagctgatcgacgaggtgatcgaggacaccagatacaccctgcccctgaccgagggcaaggccaacgtgaccgtgctggacacccagatcagaaagctgagaagcagaagcctgagccagatccacgaggccgccgtgagaatgagaagcgaggccaccgacgtgaagagcaccctggccgagatcgaggactggctggacaagctgatgcagctgaccgaggagccccagaacagcatgcccgacatcatcatctggatgatcagaggcgagaagagactggcctacgccagaatccccgcccaccaggtgctgtacagcaccagcggcgagaacgccagcggcaagtactgcggcaagacccagaccatcttcctgaagtacccccaggagaagaacaacggccccaaggtgcccgtggagctgagagtgaacatctggctgggcctgagcgccgtggagaagaagttcaacagcttcgccgagggcaccttcaccgtgttcgccgagatgtacgagaaccaggccctgatgttcggcaagtggggcaccagcggcctggtgggcagacacaagttcagcgacgtgaccggcaagatcaagctgaagagagagttcttcctgccccccaagggctgggagtgggagggcgagtggatcgtggaccccgagagaagcctgctgaccgaggccgacgccggccacaccgagttcaccgacgaggtgtaccagaacgagagcagataccccggcggcgactggaagcccgccgaggacacctacaccgacgccaacggcgacaaggccgccagccccagcgagctgacctgcccccccggctgggagtgggaggacgacgcctggagctacgacatcaacagagccgtggacgagaagggctgggagtacggcatcaccatcccccccgaccacaagcccaagagctgggtggccgccgagaagatgtaccacacccacagaagaagaagactggtgagaaagagaaagaaggacctgacccagaccgccagcagcaccgccagagccatggaggagctgcaggaccaggagggctgggagtacgccagcctgatcggctggaagttccactggaagcagagaagcagcgacaccttcagaagaagaagatggagaagaaagatggcccccagcgagacccacggcgccgccgccatcttcaagctggagggcgccctgggcgccgacaccaccgaggacggcgacgagaagagcctggagaagcagaagcacagcgccaccaccgtgttcggcgccaacacccccatcgtgagctgcaacttcgacagagtgtacatctaccacctgagatgctacgtgtaccaggccagaaacctgctggccctggacaaggacagcttcagcgacccctacgcccacatctgcttcctgcacagaagcaagaccaccgagatcatccacagcaccctgaaccccacctgggaccagaccatcatcttcgacgaggtggagatctacggcgagccccagaccgtgctgcagaacccccccaaggtgatcatggagctgttcgacaacgaccaggtgggcaaggacgagttcctgggcagaagcatcttcagccccgtggtgaagctgaacagcgagatggacatcacccccaagctgctgtggcaccccgtgatgaacggcgacaaggcctgcggcgacgtgctggtgaccgccgagctgatcctgagaggcaaggacggcagcaacctgcccatcctgcccccccagagagcccccaacctgtacatggtgccccagggcatcagacccgtggtgcagctgaccgccatcgagatcctggcctggggcctgagaaacatgaagaacttccagatggccagcatcaccagccccagcctggtggtggagtgcggcggcgagagagtggagagcgtggtgatcaagaacctgaagaagacccccaacttccccagcagcgtgctgttcatgaaggtgttcctgcccaaggaggagctgtacatgccccccctggtgatcaaggtgatcgaccacagacagttcggcagaaagcccgtggtgggccagtgcaccatcgagagactggacagattcagatgcgacccctacgccggcaaggaggacatcgtgccccagctgaaggccagcctgctgagcgcccccccctgcagagacatcgtgatcgagatggaggacaccaagcccctgctggccagcaagtgcctgagcagcatgagcaccgccctgagcaagatggccagccccgccaccgtgcacgtgctggacgaggaggaggagatcgtggactggtggagcaagttctacgccagcagcggcgagcacgagaagtgcggccagtacatccagaagggctacagcaagctgaagatctacaactgcgagctggagaacgtggccgagttcgagggcctgaccgacttcagcgacaccttcaagctgtacagaggcaagagcgacgagaacgaggaccccagcgtggtgggcgagttcaagggcagcttcagaatctaccccctgcccgacgaccccagcgtgcccgccccccccagacagttcagagagctgcccgacagcgtgccccaggagtgcaccgtgagaatctacatcgtgagaggcctggagctgcagccccaggacaacaacggcctgtgcgacccctacatcaagatcaccctgggcaagaaggtgatcgaggacagagaccactacatccccaacaccctgaaccccgtgttcggcagaatgtacgagctgagctgctacctgccccaggagaaggacctgaagatcagcgtgtacgactacgacaccttcaccagagacgagaaggtgggcgagaccatcatcgacctggagaacagattcctgagcagattcggcagccactgcggcatccccgaggagtactgcgtgagcggcgtgaacacctggagagaccagctgagacccacccagctgctgcagaacgtggccagattcaagggcttcccccagcccatcctgagcgaggacggcagcagaatcagatacggcggcagagactacagcctggacgagttcgaggccaacaagatcctgcaccagcacctgggcgcccccgaggagagactggccctgcacatcctgagaacccagggcctggtgcccgagcacgtggagaccagaaccctgcacagcaccttccagcccaacatcagccagagatactacctgagagtgatcatctggaacaccaaggacgtgatcctggacgagaagagcatcaccggcgaggagatgagcgacatctacgtgaagggctggatccccggcaacgaggagaacaagcagaagaccgacgtgcactacagaagcctggacggcgagggcaacttcaactggagattcgtgttccccttcgactacctgcccgccgagcagctgtgcatcgtggccaagaaggagcacttctggagcatcgaccagaccgagttcagaatcccccccagactgatcatccagatctgggacaacgacaagttcagcctggacgactacctgggcttcctggagctggacctgagacacaccatcatccccgccaagagccccgagaagtgcagactggacatgatccccgacctgaaggccatgaaccccctgaaggccaagaccgccagcctgttcgagcagaagagcatgaagggctggtggccctgctacgccgagaaggacggcgccagagtgatggccggcaaggtggagatgaccctggagatcctgaacgagaaggaggccgacgagagacccgccggcaagggcagagacgagcccaacatgaaccccaagctggacctgcccaacagacccgagaccagcttcctgtggttcaccaacccctgcaagaccatgaagttcatcgtgtggagaagattcaagtgggtgatcatcggcctgctgttcctgctgatcctgctgctgttcgtggccgtgctgctgtacagcctgcccaactacctgagcatgaagatcgtgaagcccaacgtgtag

SEQ ID NO: 19967 - DNA, 873 bp, Artificial Sequence
  Description of Artificial Sequence: Synthetic coding sequence
atgcaccccatcaacgtgagaagagaccccagcatccccatctacggcctgagacagagcatcctgctgaacaccagactgcaggactgctacgtggacagccccgccctgaccaacatctggatggccagaacctgcgccaagcagaacatcaacgcccccgcccccgccaccaccagcagctgggaggtggtgagaaaccccctgatcgccagcagcttcagcctggtgaagctggtgctgagaagacagctgaagaacaagtgctgcccccccccctgcaagttcggcgagggcaagctgagcaagagactgaagcacaaggacgacagcgtgatgaaggccacccagcaggccagaaagagaaacttcatcagcagcaagagcaagcagcccgccggccacagaagacccgccggcggcatcagagagagcaaggagagcagcaaggagaagaagctgaccgtgagacaggacctggaggacagatacgccgagcacgtggccgccacccaggccctgccccaggacagcggcaccgccgcctggaagggcagagtgctgctgcccgagacccagaagagacagcagctgagcgaggacaccctgaccatccacggcctgcccaccgagggctaccaggccctgtaccacgccgtggtggagcccatgctgtggaaccccagcggcacccccaagagatacagcctggagctgggcaaggccatcaagcagaagctgtgggaggccctgtgcagccagggcgccatcagcgagggcgcccagagagacagattccccggcagaaagcagcccggcgtgcacgaggagcccgtgctgaagaagtggcccaagctgaagagcaagaagtag

SEQ ID NO: 19968 - DNA, 813 bp, Artificial Sequence
  Description of Artificial Sequence: Synthetic coding sequence
atgaaggtgaccgtgggccccgaccccagcctggtgtacagacccgacgtggaccccgaggtggccaaggacaaggccagcttcagaaactacaccagcggccccctgctggacagagtgttcaccacctacaagctgatgcacacccaccagaccgtggacttcgtgagaagcaagcacgcccagttcggcggcttcagctacaagaagatgaccgtgatggaggccgtggacctgctggacggcctggtggacgagagcgaccccgacgtggacttccccaacagcttccacgccttccagaccgccgagggcatcagaaaggcccaccccgacaaggactggttccacctggtgggcctgctgcacgacctgggcaaggtgctggccctgttcggcgagccccagtgggccgtggtgggcgacaccttccccgtgggctgcagaccccaggccagcgtggtgttctgcgacagcaccttccaggacaaccccgacctgcaggaccccagatacagcaccgagctgggcatgtaccagccccactgcggcctggacagagtgctgatgagctggggccacgacgagtacatgtaccaggtgatgaagttcaacaagttcagcctgccccccgaggccttctacatgatcagattccacagcttctacccctggcacaccggcagagactaccagcagctgtgcagccagcaggacctggccatgctgccctggcaggtgagacccctgcaccaggtgcccggccccgccggcagaggccaggccgccgccctgctgcccggcgcccactag

SEQ ID NO: 19969 - DNA, 696 bp, Artificial Sequence
  Description of Artificial Sequence: Synthetic coding sequence
atgaaggtgaccgtgggccccgaccccagcctggtgtacagacccgacgtggaccccgaggtggccaaggacaaggccagcttcagaaactacaccagcggccccctgctggacagagtgttcaccacctacaagctgatgcacacccaccagaccgtggacttcgtgagaagcaagcacgcccagttcggcggcttcagctacaagaagatgaccgtgatggaggccgtggacctgctggacggcctggtggacgagagcgaccccgacgtggacttccccaacagcttccacgccttccagaccgccgagggcatcagaaaggcccaccccgacaaggtgcccaacctgccctgccccagccccagccagaccggcagcaccagcagcggcagctgcaccacctggggcagaagctggccctgcagcggcagccccagcggcctgagcagcgccacccccagccccagcgacgccgtgagaagacccccctggttcagcgccaccccccccagcagaaccaccctgaccagcagaatcctggacaccgcccagagcagcggctgcatcagccccaccgtgggcagcaccggcagcagctgccccggcgccatgatgcaggtgagacccctgcaccaggtgcccggccccgccggcagaggccaggccgccgccctgctgcccggcgcccactag

SEQ ID NO: 19970 - DNA, 798 bp, Artificial Sequence
  Description of Artificial Sequence: Synthetic coding sequence
ggccccgaccccagcctggtgtacagacccgacgtggaccccgaggtggccaaggacaaggccagcttcagaaactacaccagcggccccctgctggacagagtgttcaccacctacaagctgatgcacacccaccagaccgtggacttcgtgagaagcaagcacgcccagttcggcggcttcagctacaagaagatgaccgtgatggaggccgtggacctgctggacggcctggtggacgagagcgaccccgacgtggacttccccaacagcttccacgccttccagaccgccgagggcatcagaaaggcccaccccgacaaggactggttccacctggtgggcctgctgcacgacctgggcaaggtgctggccctgttcggcgagccccaggccagcgtggtgttctgcgacagcaccttccaggacaaccccgacctgcaggaccccagatacagcaccgagctgggcatgtaccagccccactgcggcctggacagagtgctgatgagctggggccacgacgagtacatgtaccaggtgatgaagttcaacaagttcagcctgccccccgaggccttctacatgatcagattccacagcttctacccctggcacaccggcagagactaccagcagctgtgcagccagcaggacctggccatgctgccctgggtgagagagttcaacaagttcgacctgtacaccaagtgccccgacctgcccgacgtggacaagctgagaccctactaccagggcctgatcgacaagtactgccccggcatcctgagctggtag

SEQ ID NO: 19971 - DNA, 2823 bp, Artificial Sequence
  Description of Artificial Sequence: Synthetic coding sequence
atggagatcgaccagtgcctgctggagagcctgcccctgggccagagacagagactggtgaagagaatgagatgcgagcagatcaaggcctactacgagagagagaaggccttccagaagcaggagggcttcctgaagagactgaagcacgccaagaaccccaaggtgcacttcaacctgaccgacatgctgcaggacgccatcatccaccacaacgacaaggaggtgctgagactgctgaaggagggcgccgacccccacaccctggtgagcagcggcggcagcctgctgcacctgtgcgccagatacgacaacgccttcatcgccgagatcctgatcgacagaggcgtgaacgtgaaccaccaggacgaggacttctggacccccatgcacatcgcctgcgcctgcgacaaccccgacatcgtgctgctgctggtgctggccggcgccaacgtgctgctgcaggacgtgaacggcaacatccccctggactacgccgtggagggcaccgagagcagcagcatcctgctgacctacctggacgagaacggcgtggacctgaccagcctgagacagatgaagctgcagagacccatgagcatgctgaccgacgtgaagcacttcctgagcagcggcggcaacgtgaacgagaagaacgacgagggcgtgaccctgctgcacatggcctgcgccagcggctacaaggaggtggtgagcctgatcctggagcacggcggcgacctgaacatcgtggacgaccagtactggacccccctgcacctggccgccaagtacggccagaccaacctggtgaagctgctgctgatgcaccaggccaacccccacctggtgaactgcaacgaggagaaggccagcgacatcgccgccagcgagttcatcgaggagatgctgctgaaggccgagatcgcctgggaggagaagatgaaggagcccctgagcgccagcaccctggcccaggaggagccctacgaggagatcatccacgacctgcccgtgctgagcagcaagctgagccccctggtgctgcccatcgccaagcaggacagcctgctggagaaggacatcatgttcaaggacgccaccaagggcctgtgcaagcagcagagccaggacagcatccccgagaaccccatgatgagcggcagcaccaagcccgagcaggtgaagctgatgccccccgcccccaacgacgacctggccaccctgagcgagctgaacgacggcagcctgctgtacgagatccagaagagattcggcaacaaccagatctacaccttcatcggcgacatcctgctgctggtgaacccctacaaggagctgcccatctacagcagcatggtgagccagctgtacttcagcagcagcggcaagctgtgcagcagcctgcccccccacctgttcagctgcgtggagagagccttccaccagctgttcagagagcagagaccccagtgcttcatcctgagcggcgagagaggcagcggcaagagcgaggccagcaagcagatcatcagacacctgacctgcagagccggcgccagcagagccaccctggacagcagattcaagcacgtggtgtgcatcctggaggccttcggccacgccaagaccaccctgaacgacctgagcagctgcttcatcaagtacttcgagctgcagttctgcgagagaaagcagcagctgaccggcgccagaatctacacctacctgctggagaagagcagactggtgagccagcccctgggccagagcaacttcctgatcttctacctgctgatggacggcctgagcgccgaggagaagtacggcctgcacctgaacaacctgtgcgcccacagatacctgaaccagaccatccaggacgacgccagcaccggcgagagaagcctgaacagagagaagctggccgtgctgaagagagccctgaacgtggtgggcttcagcagcctggaggtggagaacctgttcgtgatcctggccgccatcctgcacctgggcgacatcagattcaccgccctgaacgagggcaacagcgccttcgtgagcgacctgcagctgctggagcaggtggccggcatgctgcaggtgagcaccgacgagctggccagcgccctgaccaccgacatccagtacttcaagggcgacatgatcatcagaagacacaccatccagatcgccgagttcttcagagacctgctggccaagagcctgtacagcagactgttcagcttcctggtgaacaccatgaacagctgcctgcacagccaggacgagcagaagagcatgcagaccctggacatcggcatcctggacatcttcggcttcgaggagttccagaagaacgagttcgagcagctgtgcgtgaacatgaccaacgagaagatgcaccactacatcaacgaggtgctgttcctgcacgagcaggtggagtgcgtgcaggagggcgtgaccatggagaccgcctacagccccggcaaccagaacggcgtgctggacttcttcttccagaagcccagcggcttcctgaccctgctggacgaggagagccagatgatctggagcgtggagagcaacttccccaagaagctgcagagcctgctggagagcagcaacaccaacgccgtgtacagccccatgaaggacggcaacggcaacgtggccctgaaggaccacggcaccgccttcaccatcatgcactacgccggcagagtgatgtacgacgtggtgggcgccatcgagaagaacaaggacagcctgagccagaacctgctgttcgtgatgaagagaggcagatgcttctag

SEQ ID NO: 19972 - DNA, 5577 bp, Artificial Sequence
  Description of Artificial Sequence: Synthetic coding sequence
atggagatcgaccagtgcctgctggagagcctgcccctgggccagagacagagactggtgaagagaatgagatgcgagcagatcaaggcctactacgagagagagaaggccttccagaagcaggagggcttcctgaagagactgaagcacgccaagaaccccaaggtgcacttcaacctgaccgacatgctgcaggacgccatcatccaccacaacgacaaggaggtgctgagactgctgaaggagggcgccgacccccacaccctggtgagcagcggcggcagcctgctgcacctgtgcgccagatacgacaacgccttcatcgccgagatcctgatcgacagaggcgtgaacgtgaaccaccaggacgaggacttctggacccccatgcacatcgcctgcgcctgcgacaaccccgacatcgtgctgctgctggtgctggccggcgccaacgtgctgctgcaggacgtgaacggcaacatccccctggactacgccgtggagggcaccgagagcagcagcatcctgctgacctacctggacgagaacggcgtggacctgaccagcctgagacagatgaagctgcagagacccatgagcatgctgaccgacgtgaagcacttcctgagcagcggcggcaacgtgaacgagaagaacgacgagggcgtgaccctgctgcacatggcctgcgccagcggctacaaggaggtggtgagcctgatcctggagcacggcggcgacctgaacatcgtggacgaccagtactggacccccctgcacctggccgccaagtacggccagaccaacctggtgaagctgctgctgatgcaccaggccaacccccacctggtgaactgcaacgaggagaaggccagcgacatcgccgccagcgagttcatcgaggagatgctgctgaaggccgagatcgcctgggaggagaagatgaaggagcccctgagcgccagcaccctggcccaggaggagccctacgaggagatcatccacgacctgcccgtgctgagcagcaagctgagccccctggtgctgcccatcgccaagcaggacagcctgctggagaaggacatcatgttcaaggacgccaccaagggcctgtgcaagcagcagagccaggacagcatccccgagaaccccatgatgagcggcagcaccaagcccgagcaggtgaagctgatgccccccgcccccaacgacgacctggccaccctgagcgagctgaacgacggcagcctgctgtacgagatccagaagagattcggcaacaaccagatctacaccttcatcggcgacatcctgctgctggtgaacccctacaaggagctgcccatctacagcagcatggtgagccagctgtacttcagcagcagcggcaagctgtgcagcagcctgcccccccacctgttcagctgcgtggagagagccttccaccagctgttcagagagcagagaccccagtgcttcatcctgagcggcgagagaggcagcggcaagagcgaggccagcaagcagatcatcagacacctgacctgcagagccggcgccagcagagccaccctggacagcagattcaagcacgtggtgtgcatcctggaggccttcggccacgccaagaccaccctgaacgacctgagcagctgcttcatcaagtacttcgagctgcagttctgcgagagaaagcagcagctgaccggcgccagaatctacacctacctgctggagaagagcagactggtgagccagcccctgggccagagcaacttcctgatcttctacctgctgatggacggcctgagcgccgaggagaagtacggcctgcacctgaacaacctgtgcgcccacagatacctgaaccagaccatccaggacgacgccagcaccggcgagagaagcctgaacagagagaagctggccgtgctgaagagagccctgaacgtggtgggcttcagcagcctggaggtggagaacctgttcgtgatcctggccgccatcctgcacctgggcgacatcagattcaccgccctgaacgagggcaacagcgccttcgtgagcgacctgcagctgctggagcaggtggccggcatgctgcaggtgagcaccgacgagctggccagcgccctgaccaccgacatccagtacttcaagggcgacatgatcatcagaagacacaccatccagatcgccgagttcttcagagacctgctggccaagagcctgtacagcagactgttcagcttcctggtgaacaccatgaacagctgcctgcacagccaggacgagcagaagagcatgcagaccctggacatcggcatcctggacatcttcggcttcgaggagttccagaagaacgagttcgagcagctgtgcgtgaacatgaccaacgagaagatgcaccactacatcaacgaggtgctgttcctgcacgagcaggtggagtgcgtgcaggagggcgtgaccatggagaccgcctacagccccggcaaccagaacggcgtgctggacttcttcttccagaagcccagcggcttcctgaccctgctggacgaggagagccagatgatctggagcgtggagagcaacttccccaagaagctgcagagcctgctggagagcagcaacaccaacgccgtgtacagccccatgaaggacggcaacggcaacgtggccctgaaggaccacggcaccgccttcaccatcatgcactacgccggcagagtgatgtacgacgtggtgggcgccatcgagaagaacaaggacagcctgagccagaacctgctgttcgtgatgaagaccagcgagaacgtggtgatcaaccacctgttccagagcaagctgagccagaccggcagcctggtgagcgcctaccccagcttcaagttcagaggccacaagagcgccctgctgagcaagaagatgaccgccagcagcatcatcggcgagaacaagaactacctggagctgagcaagctgctgaagaagaagggcaccagcaccttcctgcagagactggagagaggcgaccccgtgaccatcgccagccagctgagaaagagcctgatggacatcatcggcaagctgcagaagtgcaccccccacttcatccactgcatcagacccaacaacagcaagctgcccgacaccttcgacaacttctacgtgagcgcccagctgcagtacatcggcgtgctggagatggtgaagatcttcagatacggctaccccgtgagactgagcttcagcgacttcctgagcagatacaagcccctggccgacaccttcctgagagagaagaaggagcagagcgccgccgagagatgcagactggtgctgcagcagtgcaagctgcagggctggcagatgggcgtgagaaaggtgttcctgaagtactggcacgccgaccagctgaacgacctgtgcctgcagctgcagagaaagatcatcacctgccagaaggtgatcagaggcttcctggccagacagcacctgctgcagagaatcagcatcagacagcaggaggtgaccagcatcaacagcttcctgcagaacaccgaggacatgggcctgaagacctacgacgccctggtgatccagaacgccagcgacatcgccagagagaacgacagactgagaagcgagatgaacgccccctaccacaaggagaagctggaggtgagaaacatgcaggaggagggcagcaagagaaccgacgacaagagcggccccagacacttccaccccagcagcatgagcgtgtgcgccgccgtggacggcctgggccagtgcctggtgggccccagcatctggagccccagcctgcacagcgtgttcagcatggacgacagcagcagcctgcccagccccagaaagcagcccccccccaagcccaagagagaccccaacaccagactgagcgccagctacgaggccgtgagcgcctgcctgagcgccgccagagaggccgccaacgaggccctggccagacccagaccccacagcgacgactacagcaccatgaagaagatcccccccagaaagcccaagagaagccccaacaccaagctgagcggcagctacgaggagatcagcggcagcagacccggcgacgccagacccgccggcgcccccggcgccgccgccagagtgctgacccccggcaccccccagtgcgccctgccccccgccgccccccccggcgacgaggacgacagcgagcccgtgtacatcgagatgctgggccacgccgccagacccgacagccccgaccccggcgagagcgtgtacgaggagatgaagtgctgcctgcccgacgacggcggccccggcgccggcagcttcctgctgcacggcgccagcccccccctgctgcacagagcccccgaggacgaggccgccggcccccccggcgacgcctgcgacatccccccccccttccccaacctgctgccccacagaccccccctgctggtgttcccccccacccccgtgacctgcagccccgccagcgacgagagccccctgacccccctggaggtgaagaagctgcccgtgctggagaccaacctgaagtaccccgtgcagcccgagggcagcagccccctgagcccccagtacagcaagagccagaagggcgacggcgacagacccgccagccccggcctggccctgttcaacggcagcggcagagccagcccccccagcaccccccccccccccccccccccccccggccccccccccgccccctacagaccctgcgcccacctggccttcccccccgagcccgcccccgtgaacgccggcaaggccggccccagcgccgaggcccccaaggtgcaccccaagcccaacagcgcccccgtggccggcccctgcagcagcttccccaagatcccctacagccccgtgaaggccaccagagccgacgccagaaaggccggcagcagcgccagcccccccgccccctacagcccccccagcagcagacccctgagcagccccctggacgagctggccagcctgttcaacagcggcagaagcgtgctgagaaagagcgccgccggcagaaagatcagagaggccgagggcttcgagaccaacatgaacatcagcagcagagacgaccccagcaccagcgagatcaccagcgagacccaggacagaaacgccaacaaccacggcatccagctgagcaacagcctgagcagcgccatcaccgccgagaacggcaacagcatcagcaacggcctgcccgaggaggacggctacagcagactgagcatcagcggcaccggcaccagcaccttccagagacacagagacagccacaccacccaggtgatccaccagctgagactgagcgagaacgagagcgtggccctgcaggagctgctggactggagaagaaagctgtgcgaggagggccaggactggcagcagatcctgcaccacgccgagcccagagtgccccccccccccccctgcaagaagcccagcctgctgaagaagcccgagggcgccagctgcaacagactgcccagcgagctgtgggacaccaccatctag

SEQ ID NO: 19973 - DNA, 5577 bp, Artificial Sequence; identical to SEQ ID NO: 19972
  Description of Artificial Sequence: Synthetic coding sequence

SEQ ID NO: 19974 - DNA, 2637 bp, Artificial Sequence
  Description of Artificial Sequence: Synthetic coding sequence
atgaagctgcagagacccatgagcatgctgaccgacgtgctgcacatggcctgcgccagcggctacaaggaggtggtgagcctgatcctggagcacggcggcgacctgaacatcgtggacgaccagtactggacccccctgcacctggccgccaagtacggccagaccaacctggtgaagctgctgctgatgcaccaggccaacccccacctggtgaactgcaacgaggagaaggccagcgacatcgccgccagcgagttcatcgaggagatgctgctgaaggccgagatcgcctgggaggagaagatgaaggagcccctgagcgccagcaccctggcccaggaggagccctacgaggagatcatccacgacctgcccgtgctgagcagcaagctgagccccctggtgctgcccatcgccaagcaggacagcctgctggagaaggacatcatgttcaaggacgccaccaagggcctgtgcaagcagcagagccaggacagcatccccgagaaccccatgatgagcggcagcaccaagcccgagcaggtgaagctgatgccccccgcccccaacgacgacctggccaccctgagcgagctgaacgacggcagcctgctgtacgagatccagaagagattcggcaacaaccagatctacaccttcatcggcgacatcctgctgctggtgaacccctacaaggagctgcccatctacagcagcatggtgagccagctgtacttcagcagcagcggcaagctgtgcagcagcctgcccccccacctgttcagctgcgtggagagagccttccaccagctgttcagagagcagagaccccagtgcttcatcctgagcggcgagagaggcagcggcaagagcgaggccagcaagcagatcatcagacacctgacctgcagagccggcgccagcagagccaccctggacagcagattcaagcacgtggtgtgcatcctggaggccttcggccacgccaagaccaccctgaacgacctgagcagctgcttcatcaagtacttcgagctgcagttctgcgagagaaagcagcagctgaccggcgccagaatctacacctacctgctggagaagagcagactggtgagccagcccctgggccagagcaacttcctgatcttctacctgctgatggacggcctgagcgccgaggagaagtacggcctgcacctgaacaacctgtgcgcccacagatacctgaaccagaccatccaggacgacgccagcaccggcgagagaagcctgaacagagagaagctggccgtgctgaagagagccctgaacgtggtgggcttcagcagcctggaggtggagaacctgttcgtgatcctggccgccatcctgcacctgggcgacatcagattcaccgccctgaacgagggcaacagcgccttcgtgagcgacctgcagctgctggagcaggtggccggcatgctgcaggtgagcaccgacgagctggccagcgccctgaccaccgacatccagtacttcaagggcgacatgatcatcagaagacacaccatccagatcgccgagttcttcagagacctgctggccaagagcctgtacagcagactgttcagcttcctggtgaacaccatgaacagctgcctgcacagccaggacgagcagaagagcatgcagaccctggacatcggcatcctggacatcttcggcttcgaggagttccagaagaacgagttcgagcagctgtgcgtgaacatgaccaacgagaagatgcaccactacatcaacgaggtgctgttcctgcacgagcaggtggagtgcgtgcaggagggcgtgaccatggagaccgcctacagccccggcaaccagaacggcgtgctggacttcttcttccagaagcccagcggcttcctgaccctgctggacgaggagagccagatgatctggagcgtggagagcaacttccccaagaagctgcagagcctgctggagagcagcaacaccaacgccgtgtacagccccatgaaggacggcaacggcaacgtggccctgaaggaccacggcaccgccttcaccatcatgcactacgccggcagagtgatgtacgacgtggtgggcgccatcgagaagaacaaggacagcctgagccagaacctgctgttcgtgatgaagaccagcgagaacgtggtgatcaaccacctgttccagagcaagctgagccagaccggcagcctggtgagcgcctaccccagcttcaagttcagaggccacaagagcgccctgctgagcaagaagatgaccgccagcagcatcatcggcgagaacaagaactacctggagctgagcaagctgctgaagaagaagggcaccagcaccttcctgcagagactggagagaggcgaccccgtgaccatcgccagccagctgagaaagagcctgatggacatcatcggcaagctgcagaagtgcaccccccacttcatccactgcatcagacccaacaacagcaagctgcccgacaccttcgacaacttctacgtgagcgcccagctgcagtacatcggcgtgctggagatggtgaagatcttcagatacggctaccccgtgagactgagcttcagcgacttcctgagcagatag

SEQ ID NO: 19975 - DNA, 2823 bp, Artificial Sequence
  Description of Artificial Sequence: Synthetic coding sequence
atggagatcgaccagtgcctgctggagagcctgcccctgggccagagacagagactggtgaagagaatgagatgcgagcagatcaaggcctactacgagagagagaaggccttccagaagcaggagggcttcctgaagagactgaagcacgccaagaaccccaaggtgcacttcaacctgaccgacatgctgcaggacgccatcatccaccacaacgacaaggaggtgctgagactgctgaaggagggcgccgacccccacaccctggtgagcagcggcggcagcctgctgcacctgtgcgccagatacgacaacgccttcatcgccgagatcctgatcgacagaggcgtgaacgtgaaccaccaggacgaggacttctggacccccatgcacatcgcctgcgcctgcgacaaccccgacatcgtgctgctgctggtgctggccggcgccaacgtgctgctgcaggacgtgaacggcaacatccccctggactacgccgtggagggcaccgagagcagcagcatcctgctgacctacctggacgagaacggcgtggacctgaccagcctgagacagatgaagctgcagagacccatgagcatgctgaccgacgtgaagcacttcctgagcagcggcggcaacgtgaacgagaagaacgacgagggcgtgaccctgctgcacatggcctgcgccagcggctacaaggaggtggtgagcctgatcctggagcacggcggcgacctgaacatcgtggacgaccagtactggacccccctgcacctggccgccaagtacggccagaccaacctggtgaagctgctgctgatgcaccaggccaacccccacctggtgaactgcaacgaggagaaggccagcgacatcgccgccagcgagttcatcgaggagatgctgctgaaggccgagatcgcctgggaggagaagatgaaggagcccctgagcgccagcaccctggcccaggaggagccctacgaggagatcatccacgacctgcccgtgctgagcagcaagctgagccccctggtgctgcccatcgccaagcaggacagcctgctggagaaggacatcatgttcaaggacgccaccaagggcctgtgcaagcagcagagccaggacagcatccccgagaaccccatgatgagcggcagcaccaagcccgagcaggtgaagctgatgccccccgcccccaacgacgacctggccaccctgagcgagctgaacgacggcagcctgctgtacgagatccagaagagattcggcaacaaccagatctacaccttcatcggcgacatcctgctgctggtgaacccctacaaggagctgcccatctacagcagcatggtgagccagctgtacttcagcagcagcggcaagctgtgcagcagcctgcccccccacctgttcagctgcgtggagagagccttccaccagctgttcagagagcagagaccccagtgcttcatcctgagcggcgagagaggcagcggcaagagcgaggccagcaagcagatcatcagacacctgacctgcagagccggcgccagcagagccaccctggacagcagattcaagcacgtggtgtgcatcctggaggccttcggccacgccaagaccaccctgaacgacctgagcagctgcttcatcaagtacttcgagctgcagttctgcgagagaaagcagcagctgaccggcgccagaatctacacctacctgctggagaagagcagactggtgagccagcccctgggccagagcaacttcctgatcttctacctgctgatggacggcctgagcgccgaggagaagtacggcctgcacctgaacaacctgtgcgcccacagatacctgaaccagaccatccaggacgacgccagcaccggcgagagaagcctgaacagagagaagctggccgtgctgaagagagccctgaacgtggtgggcttcagcagcctggaggtggagaacctgttcgtgatcctggccgccatcctgcacctgggcgacatcagattcaccgccctgaacgagggcaacagcgccttcgtgagcgacctgcagctgctggagcaggtggccggcatgctgcaggtgagcaccgacgagctggccagcgccctgaccaccgacatccagtacttcaagggcgacatgatcatcagaagacacaccatccagatcgccgagttcttcagagacctgctggccaagagcctgtacagcagactgttcagcttcctggtgaacaccatgaacagctgcctgcacagccaggacgagcagaagagcatgcagaccctggacatcggcatcctggacatcttcggcttcgaggagttccagaagaacgagttcgagcagctgtgcgtgaacatgaccaacgagaagatgcaccactacatcaacgaggtgctgttcctgcacgagcaggtggagtgcgtgcaggagggcgtgaccatggagaccgcctacagccccggcaaccagaacggcgtgctggacttcttcttccagaagcccagcggcttcctgaccctgctggacgaggagagccagatgatctggagcgtggagagcaacttccccaagaagctgcagagcctgctggagagcagcaacaccaacgccgtgtacagccccatgaaggacggcaacggcaacgtggccctgaaggaccacggcaccgccttcaccatcatgcactacgccggcagagtgatgtacgacgtggtgggcgccatcgagaagaacaaggacagcctgagccagaacctgctgttcgtgatgaagaacagaagatgcttctag

SEQ ID NO: 19976 - DNA, 2574 bp, Artificial Sequence
  Description of Artificial Sequence: Synthetic coding sequence
atgagaagagccgacaccagagacggcgagagaggcagcggcaagagcgaggccagcaagcagatcatcagacacctgacctgcagagccggcgccagcagagccaccctggacagcagattcaagcacgtggtgtgcatcctggaggccttcggccacgccaagaccaccctgaacgacctgagcagctgcttcatcaagtacttcgagctgcagttctgcgagagaaagcagcagctgaccggcgccagaatctacacctacctgctggagaagagcagactggtgagccagcccctgggccagagcaacttcctgatcttctacctgctgatggacggcctgagcgccgaggagaagtacggcctgcacctgaacaacctgtgcgcccacagatacctgaaccagaccatccaggacgacgccagcaccggcgagagaagcctgaacagagagaagctggccgtgctgaagagagccctgaacgtggtgggcttcagcagcctggaggtggagaacctgttcgtgatcctggccgccatcctgcacctgggcgacatcagattcaccgccctgaacgagggcaacagcgccttcgtgagcgacctgcagctgctggagcaggtggccggcatgctgcaggtgagcaccgacgagctggccagcgccctgaccaccgacatccagtacttcaagggcgacatgatcatcagaagacacaccatccagatcgccgagttcttcagagacctgctggccaagagcctgtacagcagactgttcagcttcctggtgaacaccatgaacagctgcctgcacagccaggacgagcagaagagcatgcagaccctggacatcggcatcctggacatcttcggcttcgaggagttccagaagaacgagttcgagcagctgtgcgtgaacatgaccaacgagaagatgcaccactacatcaacgaggtgctgttcctgcacgagcaggtggagtgcgtgcaggagggcgtgaccatggagaccgcctacagccccggcaaccagaacggcgtgctggacttcttcttccagaagcccagcggcttcctgaccctgctggacgaggagagccagatgatctggagcgtggagagcaacttccccaagaagctgcagagcctgctggagagcagcaacaccaacgccgtgtacagccccatgaaggacggcaacggcaacgtggccctgaaggaccacggcaccgccttcaccatcatgcactacgccggcagagtgatgtacgacgtggtgggcgccatcgagaagaacaaggacagcctgagccagaacctgctgttcgtgatgaagaccagcgagaacgtggtgatcaaccacctgttccagagcaagctgagccagaccggcagcctggtgagcgcctaccccagcttcaagttcagaggccacaagagcgccctgctgagcaagaagatgaccgccagcagcatcatcggcgagaacaagaactacctggagctgagcaagctgctgaagaagaagggcaccagcaccttcctgcagagactggagagaggcgaccccgtgaccatcgccagccagctgagaaagagcctgatggacatcatcggcaagctgcagaagtgcaccccccacttcatccactgcatcagacccaacaacagcaagctgcccgacaccttcgacaacttctacgtgagcgcccagctgcagtacatcggcgtgctggagatggtgaagatcttcagatacggctaccccgtgagactgagcttcagcgacttcctgagcagatacaagcccctggccgacaccttcctgagagagaagaaggagcagagcgccgccgagagatgcagactggtgctgcagcagtgcaagctgcagggctggcagatgggcgtgagaaaggtgttcctgaagtactggcacgccgaccagctgaacgacctgtgcctgcagctgcagagaaagatcatcacctgccagaaggtgatcagaggcttcctggccagacagcacctgctgcagagaatcagcatcagacagcaggaggtgaccagcatcaacagcttcctgcagaacaccgaggacatgggcctgaagacctacgacgccctggtgatccagaacgccagcgacatcgccagagagaacgacagactgagaagcgagatgaacgccccctaccacaaggagaagctggaggtgagaaacatgcaggaggagggcagcaagagaaccgacgacaagagcggccccagacacttccaccccagcagcatgagcgtgtgcgccgccgtggacggcctgggccagtgcctggtgggccccagcatctggagccccagcctgcacagcgtgttcagcatggacgacagcagcagcctgcccagccccagaaagcagcccccccccaagcccaagagagaccccaacaccagactgagcgccagctacgaggccgtgagcgcctgcctgagcgccgccagagaggccgccaacgagggccagccctggggcggcacccagcccagagtgcccggcagcagaatgctgtag

SEQ ID NO: 19977 - DNA, 1644 bp, Artificial Sequence
  Description of Artificial Sequence: Synthetic coding sequence
atgagcaccgccagcagcagcagcagcagcagcagcagccagaccccccacccccccagccagagaatgagaagaagcgccgccggcagcccccccgccgtggccgccgccggcagcggcaacggcgccggcggcggcggcggcgtgggctgcgcccccgccgccggcgccggcagactgctgcagcccatcagagccaccgtgccctaccagctgctgagaggcagccagcacagccccaccagaccccccgtggccgccgccgccgccagcctgggcagcctgcccggccccggcgccgccagaggccccagccccagcagccccaccccccccgccgccgccgcccccgccgagcaggcccccagagccaagggcagacccagaagaagccccgagagccacagaagaagcagcagccccgagagaagaagccccggcagccccgtgtgcagagccgacaaggccaagagccagcaggtgagaaccagcagcaccatcagaagaaccagcagcctggacaccatcaccggcccctacctgaccggccagtggcccagagacccccacgtgcactaccccagctgcatgaaggacaaggccacccagacccccagctgctgggccgaggagggcgccgagaagagaagccaccagagaagcgccagctggggcagcgccgaccagctgaaggagcagatcgccaagctgagacagcagctgcagagaagcaagcagagcagcagacacagcaaggagaaggacagacagagccccctgcacggcaaccacatcaccatcagccacacccaggccaccggcagcagaagcgtgcccatgcccctgagcaacatcagcgtgcccaagagcagcgtgagcagagtgccctgcaacgtggagggcatcagccccgagctggagaaggtgttcatcaaggagaacaacggcaaggaggaggtgagcaagcccctggacatccccgacggcagaagagcccccctgcccgcccactacagaagcagcagcaccagaagcatcgacacccagacccccagcgtgcaggagagaagcagcagctgcagcagccacagcccctgcgtgagccccttctgcccccccgagagccaggacggcagcccctgcagcaccgaggacctgctgtacgacagagacaaggacagcggcagcagcagccccctgcccaagtacgccagcagccccaagcccaacaacagctacatgttcaagagagagccccccgagggctgcgagagagtgaaggtgttcgaggagatggccagcagacagcccatcagcgcccccctgttcagctgccccgacaagaacaaggtgaacttcatccccaccggcagcgccttctgccccgtgaagctgctgggccccctgctgcccgccagcgacctgatgctgaagaacagccccaacagcggccagagcagcgccctggccaccctgaccgtggagcagctgagcagcagagtgagcttcaccagcctgagcgacgacaccagcaccgccggcagcatggaggccagcgtgcagcagcccagccagcagcagcagctgctgcaggagctgcagggcgaggaccacatcagcgcccagaactacgtgatcatctag

SEQ ID NO: 19978 - DNA, 999 bp, Artificial Sequence
  Description of Artificial Sequence: Synthetic coding sequence
atgggcgcccagttcagcaagaccgccgccaagggcgaggccgccgccgagagacccggcgaggccgccgtggccagcagccccagcaaggccaacggccaggagaacggccacgtgaaggtgaacggcgacgccagccccgccgccgccgagagcggcgccaaggaggagctgcaggccaacggcagcgcccccgccgccgacaaggaggagcccgccgccgccggcagcggcgccgccagccccagcgccgccgagaagggcgagcccgccgccgccgccgcccccgaggccggcgccagccccgtggagaaggaggcccccgccgagggcgaggccgccgagcccggcagccccaccgccgccgagggcgaggccgccagcgccgccagcagcaccagcagccccaaggccgaggacggcgccacccccagccccagcaacgagacccccaagaagaagaagaagagattcagcttcaagaagagcttcaagctgagcggcttcagcttcaagaagaacaagaaggaggccggcgagggcggcgaggccgaggcccccgccgccgagggcggcaaggacgaggccgccggcggcgccgccgccgccgccgccgaggccggcgccgccagcggcgagcaggccgccgcccccggcgaggaggccgccgccggcgaggagggcgccgccggcggcgacccccaggaggccaagccccaggaggccgccgtggcccccgagaagccccccgccagcgacgagaccaaggccgccgaggagcccagcaaggtggaggagaagaaggccgaggaggccggcgccagcgccgccgcctgcgaggcccccagcgccgccggccccggcgccccccccgagcaggaggccgcccccgccgaggagcccgccgccgccgccgccagcagcgcctgcgccgcccccagccaggaggcccagcccgagtgcagccccgaggccccccccgccgaggccgccgagtag

SEQ ID NO: 19979 - DNA, 978 bp, Artificial Sequence
  Description of Artificial Sequence: Synthetic coding sequence
atggccgaggtgccccccggccccagcagcctgctgcccccccccgccccccccgcccccgccgccgtggagcccagatgccccttccccgccggcgccgccctggcctgctgcagcgaggacgaggagcagcagcagctgaacggcctgatcagccccgagctgagacacctgagagccgccgccagcctgaagagcaaggtgctgagcgtggccgaggtggccgccaccaccgccacccccgacggcggccccagagccaccgccaccaagggcgccggcgtgcacagcggcgagagacccccccacagcctgagcagcaacgccagaaccgccgtgcccagccccgtggaggccgccgccgccagcgaccccgccgccgccagaaacggcctggccgagggcaccgagcaggaggaggaggaggaggacgagcaggtgagactgctgagcagcagcctgaccgccgactgcagcctgagaagccccagcggcagagaggtggagcccggcgaggacagaaccatcagatacgtgagatacgagagcgagctgcagatgcccgacatcatgagactgatcaccaaggacctgagcgagccctacagcatctacacctacagatacttcatccacaactggccccagctgtgcttcctggccatggtgggcgaggagtgcgtgggcgccatcgtgtgcaagctggacatgcacaagaagatgttcagaagaggctacatcgccatgctggccgtggacagcaagtacagaagaaacggcatcggcaccaacctggtgaagaaggccatctacgccatggtggagggcgactgcgacgaggtggtgctggagaccgagatcaccaacaagagcgccctgaagctgtacgagaacctgggcttcgtgagagacaagagactgttcagatactacctgaacggcgtggacgccctgagactgaagctgtggctgagatag

SEQ ID NO: 19980 - DNA, 1089 bp, Artificial Sequence
  Description of Artificial Sequence: Synthetic coding sequence
atggccgaggtgccccccggccccagcagcctgctgcccccccccgccccccccgcccccgccgccgtggagcccagatgccccttccccgccggcgccgccctggcctgctgcagcgaggacgaggaggacgacgaggagcacgagggcggcggcagcagaagccccgccggcggcgagagcgccaccgtggccgccaagggccacccctgcctgagatgcccccagcccccccaggagcagcagcagctgaacggcctgatcagccccgagctgagacacctgagagccgccgccagcctgaagagcaaggtgctgagcgtggccgaggtggccgccaccaccgccacccccgacggcggccccagagccaccgccaccaagggcgccggcgtgcacagcggcgagagacccccccacagcctgagcagcaacgccagaaccgccgtgcccagccccgtggaggccgccgccgccagcgaccccgccgccgccagaaacggcctggccgagggcaccgagcaggaggaggaggaggaggacgagcaggtgagactgctgagcagcagcctgaccgccgactgcagcctgagaagccccagcggcagagaggtggagcccggcgaggacagaaccatcagatacgtgagatacgagagcgagctgcagatgcccgacatcatgagactgatcaccaaggacctgagcgagccctacagcatctacacctacagatacttcatccacaactggccccagctgtgcttcctggccatggtgggcgaggagtgcgtgggcgccatcgtgtgcaagctggacatgcacaagaagatgttcagaagaggctacatcgccatgctggccgtggacagcaagtacagaagaaacggcatcggcaccaacctggtgaagaaggccatctacgccatggtggagggcgactgcgacgaggtggtgctggagaccgagatcaccaacaagagcgccctgaagctgtacgagaacctgggcttcgtgagagacaagagactgttcagatactacctgaacggcgtggacgccctgagactgaagctgtggctgagatag

SEQ ID NO: 19981 - DNA, 2178 bp, Artificial Sequence
  Description of Artificial Sequence: Synthetic coding sequence
atggtgatgaaggccagcgtggacgacgacgacagcggctgggagctgagcatgcccgagaagatggagaagagcaacaccaactgggtggacatcacccaggacttcgaggaggcctgcagagagctgaagctgggcgagctgctgcacgacaagctgttcggcctgttcgaggccatgagcgccatcgagatgatggaccccaagatggacgccggcatgatcggcaaccaggtgaacagaaaggtgctgaacttcgagcaggccatcaaggacggcaccatcaagatcaaggacctgaccctgcccgagctgatcggcatcatggacacctgcttctgctgcctgatcacctggctggagggccacagcctggcccagaccgtgttcacctgcctgtacatccacaaccccgacttcatcgaggaccccgccatgaaggccttcgccctgggcatcctgaagatctgcgacatcgccagagagaaggtgaacaaggccgccgtgttcgaggaggaggacttccagagcatgacctacggcttcaagatggccaacagcgtgaccgacctgagagtgaccggcatgctgaaggacgtggaggacgacatgcagagaagagtgaagagcaccagaagcagacagggcgaggagagagaccccgaggtggagctggagcaccagcagtgcctggccgtgttcagcagagtgaagttcaccagagtgctgctgaccgtgctgatcgccttcaccaagaaggagaccagcgccgtggccgaggcccagaagctgatggtgcaggccgccgacctgctgagcgccatccacaacagcctgcaccacggcatccaggcccagaacgacaccaccaagggcgaccaccccatcatgatgggcttcgagcccctggtgaaccagagactgctgccccccaccttccccagatacgccaagatcatcaagagagaggagatggtgaactacttcgccagactgatcgacagaatcaagaccgtgtgcgaggtggtgaacctgaccaacctgcactgcatcctggacttcttctgcgagttcagcgagcagagcccctgcgtgctgagcagaagcctgctgcagaccaccttcctggtggacaacaagaaggtgttcggcacccacctgatgcaggacatggtgaaggacgccctgagaagcttcgtgagcccccccgtgctgagccccaagtgctacctgtacaacaaccaccaggccaaggactgcatcgacagcttcgtgacccactgcgtgagacccttctgcagcctgatccagatccacggccacaacagagccagacagagagacaagctgggccacatcctggaggagttcgccaccctgcaggacgaggccgagaaggtggacgccgccctgcacaccatgctgctgaagcaggagccccagagacagcacctggcctgcctgggcacctgggtgctgtaccacaacctgagaatcatgatccagtacctgctgagcggcttcgagctggagctgtacagcatgcacgagtactactacatctactggtacctgagcgagttcctgtacgcctggctgatgagcaccctgagcagagccgacggcagccagatggccgaggagagaatcatggaggagcagcagaagggcagaagcagcaagaagaccaagaagaagaagaaggtgagacccctgagcagagagatcaccatgagccaggcctaccagaacatgtgcgccggcatgttcaagaccatggtggccttcgacatggacggcaaggtgagaaagcccaagttcgagctggacagcgagcaggtgagatacgagcacagattcgcccccttcaacagcgtgatgacccccccccccgtgcactacctgcagttcaaggagatgagcgacctgaacaagtacagcccccccccccagagccccgagctgtacgtggccgccagcaagcacttccagcaggccaagatgatcctggagaacatccccaaccccgaccacgaggtgaacagaatcctgaaggtggccaagcccaacttcgtggtgatgaagctgctggccggcggccacaagaaggagagcaaggtgccccccgagttcgacttcagcgcccacaagtacttccccgtggtgaagctggtgtag

SEQ ID NO: 19982 - DNA, 885 bp, Artificial Sequence
  Description of Artificial Sequence: Synthetic coding sequence
atggtgatgaaggccagcgtggacgacgacgacagcggctgggagctgagcatgcccgagaagatggagaagagcaacaccaactgggtggacatcacccaggacttcgaggaggcctgcagagagctgaagctgggcgagctgctgcacgacaagctgttcggcctgttcgaggccatgagcgccatcgagatgatggaccccaagatggacgccggcatgatcggcaaccaggtgaacagaaaggtgctgaacttcgagcaggccatcaaggacggcaccatcaagatcaaggacctgaccctgcccgagctgatcggcatcatggacacctgcttctgctgcctgatcacctggctggagggccacagcctggcccagaccgtgttcacctgcctgtacatccacaaccccgacttcatcgaggaccccgccatgaaggccttcgccctgggcatcctgaagatctgcgacatcgccagagagaaggtgaacaaggccgccgtgttcgaggaggaggacttccagagcatgacctacggcttcaagatggccaacagcgtgaccgacctgagagtgaccggcatgctgaaggacgtggaggacgacatgcagagaagagtgaagagcaccagaagcagacagggcgaggagagagaccccgaggtggagctggagcaccagcagtgcctggccgtgttcagcagagtgaagttcaccagagtgctgctgaccgtgctgatcgccttcaccaagaaggagaccagcgccgtggccgaggcccagaagctgatggtgcaggccgccgacctgctgagcgccatccacaacagcctgcaccacggcatccaggcccagaacgacaccaccaagggcggcctgtag

SEQ ID NO: 19983 - DNA, 594 bp, Artificial Sequence
  Description of Artificial Sequence: Synthetic coding sequence
atggtgatgaaggccagcgtggacgacgacgacagcggctgggagctgagcatgcccgagaagatggagaagagcaacaccaactgggtggacatcacccaggacttcgaggaggcctgcagagagctgaagctgggcgagctgctgcacgacaagctgttcggcctgttcgaggccatgagcgccatcgagatgatggaccccaagatggacgccggcatgatcggcaaccaggtgaacagaaaggtgctgaacttcgagcaggccatcaaggacggcaccatcaagatcaaggacctgaccctgcccgagctgatcggcatcatggacacctgcttctgctgcctgatcacctggctggagggccacagcctggcccagaccgtgttcacctgcctgtacatccacaaccccgacttcatcgaggaccccgccatgaaggccttcgccctgggcatcctgaagatctgcgacatcgccagagagaaggtgaacaaggccgccgtgttcgaggagatcagcagactgctggagctgatcgacttccacgagtacaacttcaagaacgagaacgtgcagtgctggaaggagtag

SEQ ID NO: 19984 - DNA, 1857 bp, Artificial Sequence
  Description of Artificial Sequence: Synthetic coding sequence
atggtgagccccagaatgagcggcctgctgagccagaccgtgatcctggccctgatcttcctgccccagaccagacccgccggcgtgttcgagctgcagatccacagcttcggccccggccccggccccggcgcccccagaagcccctgcagcgccagactgccctgcagactgttcttcagagtgtgcctgaagcccggcctgagcgaggaggccgccgagagcccctgcgccctgggcgccgccctgagcgccagaggccccgtgtacaccgagcagcccggcgcccccgcccccgacctgcccctgcccgacggcctgctgcaggtgcccttcagagacgcctggcccggcaccttcagcttcatcatcgagacctggagagaggagctgggcgaccagatcggcggccccgcctggagcctgctggccagagtggccggcagaagaagactggccgccggcggcccctgggccagagacatccagagagccggcgcctgggagctgagattcagctacagagccagatgcgagccccccgccgtgggcaccgcctgcaccagactgtgcagacccagaagcgcccccagcagatgcggccccggcctgagaccctgcgcccccctggaggacgagtgcgaggcccccctggtgtgcagagccggctgcagccccgagcacggcttctgcgagcagcccggcgagtgcagatgcctggagggctggaccggccccctgtgcaccgtgcccgtgagcaccagcagctgcctgagccccagaggccccagcagcgccaccaccggctgcctggtgcccggccccggcccctgcgacggcaacccctgcgccaacggcggcagctgcagcgagacccccagaagcttcgagtgcacctgccccagaggcttctacggcctgagatgcgaggtgagcggcgtgacctgcgccgacggcccctgcttcaacggcggcctgtgcgtgggcggcgccgaccccgacagcgcctacatctgccactgcccccccggcttccagggcagcaactgcgagaagagagtggacagatgcagcctgcagccctgcagaaacggcggcctgtgcctggacctgggccacgccctgagatgcagatgcagagccggcttcgccggccccagatgcgagcacgacctggacgactgcgccggcagagcctgcgccaacggcggcacctgcgtggagggcggcggcgcccacagatgcagctgcgccctgggcttcggcggcagagactgcagagagagagccgacccctgcgccgccagaccctgcgcccacggcggcagatgctacgcccacttcagcggcctggtgtgcgcctgcgcccccggctacatgggcgccagatgcgagttccccgtgcaccccgacggcgccagcgccctgcccgccgccccccccggcctgagacccggcgacccccagagatacctgctgccccccgccctgggcctgctggtggccgccggcgtggccggcgccgccctgctgctggtgcacgtgagaagaagaggccacagccaggacgccggcagcagactgctggccggcacccccgagcccagcgtgcacgccctgcccgacgccctgaacaacctgagaacccaggagggcagcggcgacggccccagcagcagcgtggactggaacagacccgaggacgtggacccccagggcatctacgtgatcagcgcccccagcatctacgccagagaggtggccacccccctgttcccccccctgcacaccggcagagccggccagagacagcacctgctgttcccctaccccagcagcatcctgagcgtgaagtag

SEQ ID NO: 19985 - DNA, 2181 bp, Artificial Sequence
  Description of Artificial Sequence: Synthetic coding sequence
atgagcgccatcaccgtggccctgctgagcctgctgttcatcaccagcggcaccatcgagaaccacaaggacctgggcggccacttcttcagcaccacccagagcccccccgccacccagggcagcaccgccgcccagagaagcaccgccacccagcacagcaccgccacccagagcagcaccgccacccagaccagccccgtgcccctgacccccgagagccccctgttccagaacttcagcggctaccacatcggcgtgggcagagccgactgcaccggccaggtggccgacatcaacctgatgggctacggcaagagcggccagaacgcccagggcatcctgaccagactgtacagcagagccttcatcatggccgagcccgacggcagcaacagaaccgtgttcgtgagcatcgacatcggcatggtgagccagagactgagactggaggtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcgccagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaagagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 19986 - DNA, 723 bp, Artificial Sequence
  Description of Artificial Sequence: Synthetic coding sequence
atgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtgcccaacagcggcctgcactag

SEQ ID NO: 19987 - DNA, 2343 bp, Artificial Sequence
  Description of Artificial Sequence: Synthetic coding sequence
atggccaagagaaccttcagcaacctggagaccttcctgatcttcctgctggtgatgatgagcgccatcaccgtggccctgctgagcctgctgttcatcaccagcggcaccatcgagaaccacaaggacctgggcggccacttcttcagcaccacccagagcccccccgccacccagggcagcaccgccgcccagagaagcaccgccacccagcacagcaccgccacccagagcagcaccgccacccagaccagccccgtgcccctgacccccgagagccccctgttccagaacttcagcggctaccacatcggcgtgggcagagccgactgcaccggccaggtggccgacatcaacctgatgggctacggcaagagcggccagaacgcccagggcatcctgaccagactgtacagcagagccttcatcatggccgagcccgacggcagcaacagaaccgtgttcgtgagcatcgacatcggcatggtgagccagagactgagactggaggtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcgccagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaaggagctgtacgccagcgccagccaggaggtgaccggccccctggccagcgcccaccagtgggtggacatgaccgacgtgaccgtgtggctgaacagcacccacgccagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 19988 - DNA, 1869 bp, Artificial Sequence
  Description of Artificial Sequence: Synthetic coding sequence
atggacagcgagaagagcagcgagtggagaagcgacgtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcgccagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaaggagctgtacgccagcgccagccaggaggtgaccggccccctggccagcgcccaccagtgggtggacatgaccgacgtgaccgtgtggctgaacagcacccacgccagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 19989 - DNA, 2238 bp, Artificial Sequence
  Description of Artificial Sequence: Synthetic coding sequence
atggccaagagaaccttcagcaacctggagaccttcctgatcttcctgctggtgatgatgagcgccatcaccgtggccctgctgagcctgctgttcatcaccagcggcaccatcgagaaccacaaggacctgggcggccacttcttcagcaccacccagagcccccccgccacccagggcagcaccgccgcccagagaagcaccgccacccagcacagcaccgccacccagagcagcaccgccacccagaccagccccgtgcccctgacccccgagagccccctgttccagaacttcagcggctaccacatcggcgtgggcagagccgactgcaccggccaggtggccgacatcaacctgatgggctacggcaagagcggccagaacgcccagggcatcctgaccagactgtacagcagagccttcatcatggccgagcccgacggcagcaacagaaccgtgttcgtgagcatcgacatcggcatggtgagccagagactgagactggaggtgctgaacagactgcagagcaagtacggcagcctgtacagaagagacaacgtgatcctgagcggcacccacacccacagcggccccgccggctacttccagtacaccgtgttcgtgatcgccagcgagggcttcagcaaccagaccttccagcacatggtgaccggcatcctgaagagcatcgacatcgcccacaccaacatgaagcccggcaagatcttcatcaacaagggcaacgtggacggcgtgcagatcaacagaagcccctacagctacctgcagaacccccagagcgagagagccagatacagcagcaacaccgacaaggagatgatcgtgctgaagatggtggacctgaacggcgacgacctgggcctgatcagctggttcgccatccaccccgtgagcatgaacaacagcaaccacctggtgaacagcgacaacgtgggctacgccagctacctgctggagcaggagaagaacaagggctacctgcccggccagggccccttcgtggccgccttcgccagcagcaacctgggcgacgtgagccccaacatcctgggccccagatgcatcaacaccggcgagagctgcgacaacgccaacagcacctgccccatcggcggccccagcatgtgcatcgccaagggccccggccaggacatgttcgacagcacccagatcatcggcagagccatgtaccagagagccaagagcaagacctgcaagcccgccctgggctacagcttcgccgccggcaccatcgacggcgtgggcggcctgaacttcacccagggcaagaccgagggcgaccccttctgggacaccatcagagaccagatcctgggcaagcccagcgaggagatcaaggagtgccacaagcccaagcccatcctgctgcacaccggcgagctgagcaagccccacccctggcaccccgacatcgtggacgtgcagatcatcaccctgggcagcctggccatcaccgccatccccggcgagttcaccaccatgagcggcagaagactgagagaggccgtgcaggccgagttcgccagccacggcatgcagaacatgaccgtggtgatcagcggcctgtgcaacgtgtacacccactacatcaccacctacgaggagtaccaggcccagagatacgaggccgccagcaccatctacggcccccacaccctgagcgcctacatccagctgttcagaaacctggccaaggccatcgccaccgacaccgtggccaacctgagcagaggccccgagccccccttcttcaagcagctgatcgtgcccctgatccccagcatcgtggacagagcccccaagggcagaaccttcggcgacgtgctgcagcccgccaagcccgagtacagagtgggcgaggtggccgaggtgatcttcgtgggcgccaaccccaagaacagcgtgcagaaccagacccaccagaccttcctgaccgtggagaagtacgaggccaccagcaccagctggcagatcgtgtgcaacgacgccagctgggagaccagattctactggcacaagggcctgctgggcctgagcaacgccaccgtggagtggcacatccccgacaccgcccagcccggcatctacagaatcagatacttcggccacaacagaaagcaggacatcctgaagcccgccgtgatcctgagcttcgagggcaccagccccgccttcgaggtggtgaccatctag

SEQ ID NO: 19990 - DNA, 840 bp, Artificial Sequence
  Description of Artificial Sequence: Synthetic coding sequence
atgctgctggccgccagcaaggtgctggacagactgaagcccgtgatcggcgtgaacaccgaccccgagagaagcgagggccacctgtgcctgcccgtgagatacacccacagcttccccgaggccctgcagaagttctacagaggcgagttcagatggctgtggagacagagaatcagactgtacctggagggcaccggcatcaaccccgtgcccgtggacctgcacgagcagcagctgagcctgaaccagcacaacagagccctgaacatcgagagagcccacgacgagagaagcgaggccagcggcccccagctgctgcccgtgagagccctgaacgaggtgttcatcggcgagagcctgagcagcagagccagctactacgagatcagcgtggacgacggcccctgggagaagcagaagagcagcggcctgaacctgtgcaccggcaccggcagcaaggcctggagcttcaacatcaacagagtggccacccaggccgtggaggacgtgctgaacatcgccaagagacagggcaacctgagcctgcccctgaacagagagctggtggagaaggtgaccaacgagtacaacgagagcctgctgtacagccccgaggagcccaagatcctgttcagcatcagagagcccatcgccaacagagtgttcagcagcagcagacagagatgcttcagcagcaaggtgtgcgtgagaagcagatgctgggacgcctgcatggtggtggacggcggcaccagcttcgagttcaacgacggcgccatcgccagcatgatgatcaacaaggaggacgagctgagaaccgtgctgctggagcagtag

SEQ ID NO: 19991 - DNA, 1329 bp, Artificial Sequence
  Description of Artificial Sequence: Synthetic coding sequence
atgacctgctacagaggcttcctgctgggcagctgctgcagagtggccggcggcagagccgccgccctgagaggccccggcgccggcggccccgccgccagacccagactgggcggcgacggcggcggcagaagacacctgggccagggccagcccagagagctggccggctgcggcagcagagccgacggcggcttcagacccagcagagtggtggtggtggccaagaccaccagatacgagttcgagcagcagagatacagatacgccgagctgagcgaggaggacctgaagcagctgctggccctgaagggcagcagctacagcggcctgctggagagacaccacatccacaccaagaacgtggagcacatcatcgacagcctgagaaacgagggcatcgaggtgagactggtgaagagaagagagtacgacgaggagaccgtgagatgggccgacgccgtgatcgccgccggcggcgacggcaccatgctgctggccgccagcaaggtgctggacagactgaagcccgtgatcggcgtgaacaccgaccccgagagaagcgagggccacctgtgcctgcccgtgagatacacccacagcttccccgaggccctgcagaagttctacagaggcgagttcagatggctgtggagacagagaatcagactgtacctggagggcaccggcatcaaccccgtgcccgtggacctgcacgagcagcagctgagcctgaaccagcacaacagagccctgaacatcgagagagcccacgacgagagaagcgaggccagcggcccccagctgctgcccgtgagagccctgaacgaggtgttcatcggcgagagcctgagcagcagagccagctactacgagatcagcgtggacgacggcccctgggagaagcagaagagcagcggcctgaacctgtgcaccggcaccggcagcaaggcctggagcttcaacatcaacagagtggccacccaggccgtggaggacgtgctgaacatcgccaagagacagggcaacctgagcctgcccctgaacagagagctggtggagaaggtgaccaacgagtacaacgagagcctgctgtacagccccgaggagcccaagatcctgttcagcatcagagagcccatcgccaacagagtgttcagcagcagcagacagagatgcttcagcagcaaggtgtgcgtgagaagcagatgctgggacgcctgcatggtggtggacggcggcaccagcttcgagttcaacgacggcgccatcgccagcatgatgatcaacaaggaggacgagctgagaaccgtgctgctggagcagtag

SEQ ID NO: 19992 - DNA, 840 bp, Artificial Sequence; identical to SEQ ID NO: 19990
  Description of Artificial Sequence: Synthetic coding sequence

SEQ ID NO: 19993 - DNA, 906 bp, Artificial Sequence
  Description of Artificial Sequence: Synthetic coding sequence
atgctgctggccgccagcaaggtgctggacagactgaagcccgtgatcggcgtgaacaccgaccccgagagaagcgagggccacctgtgcctgcccgtgagatacacccacagcttccccgaggccctgcagaagttctacagaggcgagttcagatggctgtggagacagagaatcagactgtacctggagggcaccggcatcaaccccgtgcccgtggacctgcacgagcagcagctgagcctgaaccagcacaacagagccctgaacatcgagagagcccacgacgagagaagcgaggccagcggcccccagctgctgcccgtgagagccctgaacgaggtgttcatcggcgagagcctgagcagcagaatgagctacagctgggccgtggccgtggacaacctgagaagaagcatccccaccctgaagggcctggccagctactacgagatcagcgtggacgacggcccctgggagaagcagaagagcagcggcctgaacctgtgcaccggcaccggcagcaaggcctggagcttcaacatcaacagagtggccacccaggccgtggaggacgtgctgaacatcgccaagagacagggcaacctgagcctgcccctgaacagagagctggtggagaaggtgaccaacgagtacaacgagagcctgctgtacagccccgaggagcccaagatcctgttcagcatcagagagcccatcgccaacagagtgttcagcagcagcagacagagatgcttcagcagcaaggtgtgcgtgagaagcagatgctgggacgcctgcatggtggtggacggcggcaccagcttcgagttcaacgacggcgccatcgccagcatgatgatcaacaaggaggacgagctgagaaccgtgctgctggagcagtag

SEQ ID NO: 19994 - DNA, 1233 bp, Artificial Sequence
  Description of Artificial Sequence: Synthetic coding sequence
atgacctgctacagaggcttcctgctgggcagctgctgcagagtggccggcggcagagccgccgccctgagaggccccggcgccggcggccccgccgccagacccagactgggcggcgacggcggcggcagaagacacctgggccagggccagcccagagagctggccggctgcggcagcagagccgacggcggcttcagacccagcagagtggtggtggtggccaagaccaccagatacgagttcgagcagcagagatacagatacgccgagctgagcgaggaggacctgaagcagctgctggccctgaagggcagcagctacagcggcctgctggagagacaccacatccacaccaagaacgtggagcacatcatcgacagcctgagaaacgagggcatcgaggtgagactggtgaagagaagagagtacgacgaggagaccgtgagatgggccgacgccgtgatcgccgccggcggcgacggcaccatgctgctggccgccagcaaggtgctggacagactgaagcccgtgatcggcgtgaacaccgaccccgagagaagcgagggccacctgtgcctgcccgtgagatacacccacagcttccccgaggccctgcagaagttctacagaggcgagttcagatggctgtggagacagagaatcagactgtacctggagggcaccggcatcaaccccgtgcccgtggacctgcacgagcagcagctgagcctgaaccagcacaacagagccctgaacatcgagagagcccacgacgagagaagcgaggccagcggcccccagctgctgcccgtgagagccctgaacgaggtgttcatcggcgagagcctgagcagcagaagcttcaacatcaacagagtggccacccaggccgtggaggacgtgctgaacatcgccaagagacagggcaacctgagcctgcccctgaacagagagctggtggagaaggtgaccaacgagtacaacgagagcctgctgtacagccccgaggagcccaagatcctgttcagcatcagagagcccatcgccaacagagtgttcagcagcagcagacagagatgcttcagcagcaaggtgtgcgtgagaagcagatgctgggacgcctgcatggtggtggacggcggcaccagcttcgagttcaacgacggcgccatcgccagcatgatgatcaacaaggaggacgagctgagaaccgtgctgctggagcagtag

SEQ ID NO: 19995 - DNA, 192 bp, Artificial Sequence
  Description of Artificial Sequence: Synthetic coding sequence
atggagctggtgcaggtgctgaagagaggcctgcagcagatcaccggccacggcggcctgagaggctacctgagagtgttcttcagaaccaacgacgccaaggtgggcaccctggtgggcgaggacaagtacggcaacaagtactacgaggacaacaagcagttcttcggcatcgtgggcttcaccgtgtag

SEQ ID NO: 19996 - DNA, 438 bp, Artificial Sequence
  Description of Artificial Sequence: Synthetic coding sequence
atggagctggtgcaggtgctgaagagaggcctgcagcagatcaccggccacggcggcctgagaggctacctgagagtgttcttcagaaccaacgacgccaaggtgggcaccctggtgggcgaggacaagtacggcaacaagtactacgaggacaacaagcagttcttcggcagacacagatgggtggtgtacaccaccgagatgaacggcaagaacaccttctgggacgtggacggcagcatggtgccccccgagtggcacagatggctgcacagcatgaccgacgacccccccaccaccaagcccctgaccgccagaaagttcatctggaccaaccacaagttcaacgtgaccggcacccccgagcagtacgtgccctacagcaccaccagaaagaagatccaggagtggatcccccccagcaccccctacaagtag

SEQ ID NO: 19997 - DNA, 255 bp, Artificial Sequence
  Description of Artificial Sequence: Synthetic coding sequence
atggccgccagagtgggcgccttcctgaagaacgcctgggacaaggagcccgtgctggtggtgagcttcgtggtgggcggcctggccgtgatcctgccccccctgagcccctacttcaagtacagcgtgatgatcaacaaggccaccccctacaactaccccgtgcccgtgagagacgacggcaacatgcccgacgtgcccagccacccccaggacccccagggccccagcctggagtggctgaagaagctgtag

SEQ ID NO: 19998 - DNA, 255 bp, Artificial Sequence; identical to SEQ ID NO: 19997
  Description of Artificial Sequence: Synthetic coding sequence

SEQ ID NO: 19999 - DNA, 255 bp, Artificial Sequence; identical to SEQ ID NO: 19997
  Description of Artificial Sequence: Synthetic coding sequence

SEQ ID NO: 20000 - DNA, 246 bp, Artificial Sequence
  Description of Artificial Sequence: Synthetic coding sequence
atgctgagacagatcatcggccaggccaagaagcaccccagcctgatccccctgttcgtgttcatcggcaccggcgccaccggcgccaccctgtacctgctgagactggccctgttcaaccccgacgtgtgctgggacagaaacaaccccgagccctggaacaagctgggccccaacgaccagtacaagttctacagcgtgaacgtggactacagcaagctgaagaaggagagacccgacttctag

SEQ ID NO: 20001 - DNA, 171 bp, Artificial Sequence
  Description of Artificial Sequence: Synthetic coding sequence
atccccgtggccatcttcatcaccctggtgaacgtgttcatcggccaggccgagctggccgagatccccgagggctacgtgcccgagcactgggagtactacaagggcaagggcgccggcagcgccaagatcgacgcctgcgagagaagatggaccctggtgctgctgtag

SEQ ID NO: 20002 - DNA, 318 bp, Artificial Sequence
  Description of Artificial Sequence: Synthetic coding sequence
atgatctgctggagacaccccagcgccccctgcggcagaggcgagtggcaggtgcccagaagccagctgcccctggccagagtggagttccccgtggccctgggcctgggcgtggccgtgggcgccgaggccgccgccatcatggtgaacctgctgcagatcgtgagagaccactgggtgcacgtgctggtgcccatgggcttcgtgatcggctgctacctggacagaaagagcgacgagagactgaccgccttcagaaacaagagcatgctgttcaagagagagctgcagcccagcgaggaggtgacctggaagtag

SEQ ID NO: 20003 - DNA, 177 bp, Artificial Sequence
  Description of Artificial Sequence: Synthetic coding sequence
atggtgaacctgctgcagatcgtgagagaccactgggtgcacgtgctggtgcccatgggcttcgtgatcggctgctacctggacagaaagagcgacgagagactgaccgccttcagaaacaagagcatgctgttcaagagagagctgcagcccagcgaggaggtgacctggaagtag

SEQ ID NO: 20004 - DNA, 177 bp, Artificial Sequence; identical to SEQ ID NO: 20003
  Description of Artificial Sequence: Synthetic coding sequence

SEQ ID NO: 20005 - DNA, 288 bp, Artificial Sequence
  Description of Artificial Sequence: Synthetic coding sequence
atggagagccacgagagacagcccctggtgctgcacgaggagatgggcgagtgcagaagcagcctgagcgccggcggcggcgtgcacatcgagcccagatacagacagttcccccagctgaccagaagccaggtgttccagagcgagttcttcagcggcctgatgtggttctggatcctgtggagattctggcacgacagcgaggaggtgctgggccacttcccctaccccgaccccagccagtggaccgacgaggagctgggcatcccccccgacgacgaggactag

SEQ ID NO: 20006 - DNA, 318 bp, Artificial Sequence
  Description of Artificial Sequence: Synthetic coding sequence
atgagcgccctgaccagactggccagcttcgccagagtgggcggcagactgttcagaagcggctgcgccagaaccgccggcgacggcggcgtgagacacgccggcggcggcgtgcacatcgagcccagatacagacagttcccccagctgaccagaagccaggtgttccagagcgagttcttcagcggcctgatgtggttctggatcctgtggagattctggcacgacagcgaggaggtgctgggccacttcccctaccccgaccccagccagtggaccgacgaggagctgggcatcccccccgacgacgaggactag

SEQ ID NO: 20007 - DNA, 315 bp, Artificial Sequence
  Description of Artificial Sequence: Synthetic coding sequence
agcgccctgaccagactggccagcttcgccagagtgggcggcagactgttcagaagcggctgcgccagaaccgccggcgacggcggcgtgagacacgccggcggcggcgtgcacatcgagcccagatacagacagttcccccagctgaccagaagccaggtgttccagagcgagttcttcagcggcctgatgtggttctggatcctgtggagattctggcacgacagcgaggaggtgctgggccacttcccctaccccgaccccagccagtggaccgacgaggagctgggcatcccccccgacgacgaggactag

SEQ ID NO: 20008 - DNA, 318 bp, Artificial Sequence; identical to SEQ ID NO: 20006
  Description of Artificial Sequence: Synthetic coding sequence

SEQ ID NO: 20009 - DNA, 318 bp, Artificial Sequence; identical to SEQ ID NO: 20006
  Description of Artificial Sequence: Synthetic coding sequence

SEQ ID NO: 20010 - DNA, 390 bp, Artificial Sequence
  Description of Artificial Sequence: Synthetic coding sequence
atgagcttccccaagtacaagcccagcagcctgagaaccctgcccgagaccctggaccccgccgagtacaacatcagccccgagaccagaagagcccaggccgagagactggccatcagagcccagctgaagagagagtacctgctgcagtacaacgaccccaacagaagaggcctgatcgagaaccccgccctgctgagatgggcctacgccagaaccatcaacgtgtaccccaacttcagacccacccccaagaacagcctgatgggcgccctgtgcggcttcggccccctgatcttcatctactacatcatcaagaccgagagagacagaaaggagaagctgatccaggagggcaagctggacagaaccttccacctgagctactag

SEQ ID NO: 20011 - DNA, 363 bp, Artificial Sequence
  Description of Artificial Sequence: Synthetic coding sequence
atgagcttccccaagtacaagcccagcagcctgagaaccctgcccgagaccctggaccccgccgagtacaacatcagccccgagaccagaagagcccaggccgagagactggccatcagagcccagctgaagagagagtacctgctgcagtacaacgaccccaacagaagaggcctgatcgagaaccccgccctgctgagatgggcctacgccagaaccatcaacgtgtaccccaacttcagacccacccccaagaacagcctgatgggcgccctgtgcggcttcggccccctgatcttcatctactacatcatcaagaccgagagagtgagcatccagaccagatgcctggtgttcgagtag

SEQ ID NO: 20012 - DNA, 570 bp, Artificial Sequence
  Description of Artificial Sequence: Synthetic coding sequence
atggccgccatgagcctgctgagaagagtgagcgtgaccgccgtggccgccctgagcggcagacccctgggcaccagactgggcttcggcggcttcctgaccagaggcttccccaaggccgccgcccccgtgagacacagcggcgaccacggcaagagactgttcgtgatcagacccagcagattctacgacagaagattcctgaagctgctgagattctacatcgccctgaccggcatccccgtggccatcttcatcaccctggtgaacgtgttcatcggccaggccgagctggccgagatccccgagggctacgtgcccgagcactgggagtactacaagcaccccatcagcagatggatcgccagaaacttctacgacagccccgagaagatctacgagagaaccatggccgtgctgcagatcgaggccgagaaggccgagctgagagtgaaggagctggaggtgagaaagctgatgcacgtgagaggcgacggcccctggtactactacgagaccatcgacaaggagctgatcgaccacagccccaaggccacccccgacaactag

SEQ ID NO: 20013 - DNA, 414 bp, Artificial Sequence
  Description of Artificial Sequence: Synthetic coding sequence
atggccgccatgagcctgctgagaagagtgagcgtgaccgccgtggccgccctgagcggcagacccctgggcaccagactgggcttcggcggcttcctgaccagaggcttccccaaggccgccggccaggccgagctggccgagatccccgagggctacgtgcccgagcactgggagtactacaagcaccccatcagcagatggatcgccagaaacttctacgacagccccgagaagatctacgagagaaccatggccgtgctgcagatcgaggccgagaaggccgagctgagagtgaaggagctggaggtgagaaagctgatgcacgtgagaggcgacggcccctggtactactacgagaccatcgacaaggagctgatcgaccacagccccaaggccacccccgacaactag

SEQ ID NO: 20014 - DNA, 342 bp, Artificial Sequence
  Description of Artificial Sequence: Synthetic coding sequence
atgaccggctacacccccgacgagaagctgagactgcagcagctgagagagctgagaagaagatggctgaaggaccaggagctgagccccagagagcccgtgctgcccccccagaagatgggccccatggagaagttctggaacaagttcctggagaacaagagcccctggagaaagatggtgcacggcgtgtacaagaagagcatcttcgtgttcacccacgtgctggtgcccgtgtggatcatccactactacatgaagtaccacgtgagcggcgacaccatcctggagaccggcgaggtgatcccccccatgaaggagttccccgaccagcaccactag

SEQ ID NO: 20015 - DNA, 291 bp, Artificial Sequence
  Description of Artificial Sequence: Synthetic coding sequence
atgatcgccagaagaaaccccgagcccctgagattcctgcccgacgaggccagaagcctgcccccccccaagctgaccgaccccagactgctgtacatcggcttcctgggctactgcagcggcctgatcgacaacctgatcagaagaagacccatcgccaccgccgactacctgtacgccgtgagagacagagagatgttcggctacatgaagctgcaccccgaggacttccccgaggaggacaagaagacctacggcgagatcttcgagaagttccaccccatcagatag

SEQ ID NO: 20016 - DNA, 267 bp, Artificial Sequence
  Description of Artificial Sequence: Synthetic coding sequence
atgatcgccagaagaaaccccgagcccctgagattcctgcccgacgaggccagaagcctgcccccccccaagctgaccgaccccagactgctgtacatcggcttcctgggctactgcagcggcctgatcgacaacctgatcagaagaagacccatcgccaccgccggcctgcacagacagctgctgtacatcaccgccttcttcttcgccggctactacctggtgaagctggaggcctacgccaacctgtacgtggacaccctgtag

SEQ ID NO: 20017 - DNA, 360 bp, Artificial Sequence
  Description of Artificial Sequence: Synthetic coding sequence
atgatcgccagaagaaaccccgagcccctgagattcctgcccgacgaggccagaagcctgcccccccccaagctgaccgaccccagactgctgtacatcggcttcctgggctactgcagcggcctgatcgacaacctgatcagaagaagacccatcgccaccgccggcctgcacagacagctgctgtacatcaccgccttcttcttcgccggctactacctggtgaagagagaggactacctgtacgccgtgagagacagagagatgttcggctacatgaagctgcaccccgaggacttccccgaggaggacaagaagacctacggcgagatcttcgagaagttccaccccatcagatag

SEQ ID NO: 20018 - DNA, 231 bp, Artificial Sequence
  Description of Artificial Sequence: Synthetic coding sequence
atgatcgccagaagaaaccccgagcccctgagattcctgcccgacgaggccagaagcctgcccccccccaagctgaccgaccccagactgctgtacatcggcttcctgggctactgcagcggcctgatcgacaacctgatcagaagaagacccatcgccaccgccggcctgcacagacagctgctgtacatcaccgccttcttctgctggatcctgagctgcaagacctag

SEQ ID NO: 20019 - DNA, 1032 bp, Artificial Sequence
  Description of Artificial Sequence: Synthetic coding sequence
atgagcgtgctgctgagaagcggcctgggccccctgtgcgccgtggccagagccgccatccccttcatctggagaggcaagtacttcagcagcggcaacgagcccgccgagaaccccgtgacccccatgctgagacacctgatgtacaagatcaagagcaccggccccatcaccgtggccgagtacatgaaggaggtgctgaccaaccccgccaagctgctgggcatctggttcatcagcgagtggatggccaccggcaagagcaccgccttccagctggtggagctgggccccggcagaggcaccctggtgggcgacatcctgagagtgttcacccagctgggcagcgtgctgaagaactgcgacatcagcgtgcacctggtggagaagaccccccagggctggagagaggtgttcgtggacatcgacccccaggtgagcgacaagctgagattcgtgctggcccccagcgccacccccgccgaggccttcatccagcacgacgagaccagagaccacgtggaggtgtgccccgacgccggcgtgatcatcgaggagctgagccagagaatcgccctgaccggcggcgccgccctggtggccgactacggccacgacggcaccaagaccgacaccttcagaggcttctgcgaccacaagctgcacgacgtgctgatcgcccccggcaccgccgacctgaccgccgacgtggacttcagctacctgagaagaatggcccagggcaaggtggccagcctgggccccatcaagcagcacaccttcctgaagaacatgggcatcgacgtgagactgaaggtgctgctggacaagagcaacgagcccagcgtgagacagcagctgctgcagggctacgacatgctgatgaaccccaagaagatgggcgagagattcaacttcttcgccctgctgccccaccagagactgcagggcggcagataccagagaaacgccagacagagcaagcccttcgccagcgtggtggccggcttcagcgagctggcctggcagtag

SEQ ID NO: 20020 - DNA, 1452 bp, Artificial Sequence
  Description of Artificial Sequence: Synthetic coding sequence
atggccagcctgggcgacctggtgagagcctggcacctgggcgcccaggccgtggacagaggcgactgggccagagccctgcacctgttcagcggcgtgcccgccccccccgccagactgtgcttcaacgccggctgcgtgcacctgctggccggcgaccccgaggccgccctgagagccttcgaccaggccgtgaccaaggacacctgcatggccgtgggcttcttccagagaggcgtggccaacttccagctggccagattccaggaggccctgagcgacttctggctggccctggagcagctgagaggccacgccgccatcgactacacccagctgggcctgagattcaagctgcaggcctgggaggtgctgcacaacgtggccagcgcccagtgccagctgggcctgtggaccgaggccgccagcagcctgagagaggccatgagcaagtggcccgagggcagcctgaacggcctggacagcgccctggaccaggtgcagagaagaggcagcctgccccccagacaggtgcccagaggcgaggtgttcagaccccacagatggcacctgaagcacctggagcccgtggacttcctgggcaaggccaaggtggtggccagcgccatccccgacgaccagggctggggcgtgagaccccagcagccccagggccccggcgccaaccacgacgccagaagcctgatcatggacagccccagagccggcacccaccagggccccctggacgccgagaccgaggtgggcgccgacagatgcaccagcaccgcctaccaggagcagagaccccaggtggagcaggtgggcaagcaggcccccctgagccccggcctgcccgccatgggcggccccggccccggcccctgcgaggaccccgccggcgccggcggcgccggcgccggcggcagcgagcccctggtgaccgtgaccgtgcagtgcgccttcaccgtggccctgagagccagaagaggcgccgacctgagcagcctgagagccctgctgggccaggccctgccccaccaggcccagctgggccagctgagctacctggcccccggcgaggacggccactgggtgcccatccccgaggaggagagcctgcagagagcctggcaggacgccgccgcctgccccagaggcctgcagctgcagtgcagaggcgccggcggcagacccgtgctgtaccaggtggtggcccagcacagctacagcgcccagggccccgaggacctgggcttcagacagggcgacaccgtggacgtgctgtgcgaggagcccgacgtgcccctggccgtggaccaggcctggctggagggccactgcgacggcagaatcggcatcttccccaagtgcttcgtggtgcccgccggccccagaatgagcggcgcccccggcagactgcccagaagccagcagggcgaccagccctag

SEQ ID NO: 20021 - DNA, 1284 bp, Artificial Sequence
  Description of Artificial Sequence: Synthetic coding sequence
atggccagcctgggcgacctggtgagagcctggcacctgggcgcccaggccgtggacagaggcgactgggccagagccctgcacctgttcagcggcgtgcccgccccccccgccagactgtgcttcaacgccggctgcgtgcacctgctggccggcgaccccgaggccgccctgagagccttcgaccaggccgtgaccaaggacacctgcatggccgtgggcttcttccagagaggcgtggccaacttccagctggccagattccaggaggccctgagcgacttctggctggccctggagcagctgagaggccacgccgccatcgactacacccagctgggcctgagattcaagctgcaggcctgggaggtgctgcacaacgtggccagcgcccagtgccagctgggcctgtggaccgaggccgccagcagcctgagagaggccatgagcaagtggcccgagggcagcctgaacggcctggacagcgccctggaccaggtgcagggccccggcgccaaccacgacgccagaagcctgatcatggacagccccagagccggcacccaccagggccccctggacgccgagaccgaggtgggcgccgacagatgcaccagcaccgcctaccaggagcagagaccccaggtggagcaggtgggcaagcaggcccccctgagccccggcctgcccgccatgggcggccccggccccggcccctgcgaggaccccgccggcgccggcggcgccggcgccggcggcagcgagcccctggtgaccgtgaccgtgcagtgcgccttcaccgtggccctgagagccagaagaggcgccgacctgagcagcctgagagccctgctgggccaggccctgccccaccaggcccagctgggccagctgagctacctggcccccggcgaggacggccactgggtgcccatccccgaggaggagagcctgcagagagcctggcaggacgccgccgcctgccccagaggcctgcagctgcagtgcagaggcgccggcggcagacccgtgctgtaccaggtggtggcccagcacagctacagcgcccagggccccgaggacctgggcttcagacagggcgacaccgtggacgtgctgtgcgaggagcccgacgtgcccctggccgtggaccaggcctggctggagggccactgcgacggcagaatcggcatcttccccaagtgcttcgtggtgcccgccggccccagaatgagcggcgcccccggcagactgcccagaagccagcagggcgaccagccctag

SEQ ID NO: 20022 - DNA, 1113 bp, Artificial Sequence
  Description of Artificial Sequence: Synthetic coding sequence
atggccggccccagataccccgtgagcgtgcagggcgccgccctggtgcagatcaagagactgcagaccttcgccttcagcgtgagatggagcgacggcagcgacaccttcgtgagaagaagctgggacgagttcagacagctgaagaccctgaaggagaccttccccgtggaggccggcctgctgagaagaagcgacagagtgctgcccaagctgctggacgcccccctgctgggcagagtgggcagaaccagcagaggcctggccagactgcagctgctggagacctacagcagaagactgctggccaccgccgagagagtggccagaagccccaccatcaccggcttcttcgccccccagcccctggacctggagcccgccctgccccccggcagcagagtgatcctgcccacccccgaggagcagcccctgagcagagccgccggcagactgagcatccacagcctggaggcccagagcctgagatgcctgcagcccttctgcacccaggacaccagagacagacccttccaggcccaggcccaggagagcctggacgtgctgctgagacaccccagcggctggtggctggtggagaacgaggacagacagaccgcctggttccccgccccctacctggaggaggccgcccccggccagggcagagagggcggccccagcctgggcagcagcggcccccagttctgcgccagcagagcctacgagagcagcagagccgacgagctgagcgtgcccgccggcgccagagtgagagtgctggagaccagcgacagaggctggtggctgtgcagatacggcgacagagccggcctgctgcccgccgtgctgctgagacccgagggcctgggcgccctgctgagcggcaccggcttcagaggcggcgacgaccccgccggcgaggccagaggcttccccgagcccagccaggccaccgcccccccccccaccgtgcccaccagacccagccccggcgccatccagagcagatgctgcaccgtgaccagaagagccctggagagaagacccagaagacagggcagacccagaggctgcgtggacagcgtgccccaccccaccaccgagcagtag

SEQ ID NO: 20023 - DNA, 1116 bp, Artificial Sequence
  Description of Artificial Sequence: Synthetic coding sequence
atggccggccccagataccccgtgagcgtgcagggcgccgccctggtgcagatcaagagactgcagaccttcgccttcagcgtgagatggagcgacggcagcgacaccttcgtgagaagaagctgggacgagttcagacagctgaagaagaccctgaaggagaccttccccgtggaggccggcctgctgagaagaagcgacagagtgctgcccaagctgctggacgcccccctgctgggcagagtgggcagaaccagcagaggcctggccagactgcagctgctggagacctacagcagaagactgctggccaccgccgagagagtggccagaagccccaccatcaccggcttcttcgccccccagcccctggacctggagcccgccctgccccccggcagcagagtgatcctgcccacccccgaggagcagcccctgagcagagccgccggcagactgagcatccacagcctggaggcccagagcctgagatgcctgcagcccttctgcacccaggacaccagagacagacccttccaggcccaggcccaggagagcctggacgtgctgctgagacaccccagcggctggtggctggtggagaacgaggacagacagaccgcctggttccccgccccctacctggaggaggccgcccccggccagggcagagagggcggccccagcctgggcagcagcggcccccagttctgcgccagcagagcctacgagagcagcagagccgacgagctgagcgtgcccgccggcgccagagtgagagtgctggagaccagcgacagaggctggtggctgtgcagatacggcgacagagccggcctgctgcccgccgtgctgctgagacccgagggcctgggcgccctgctgagcggcaccggcttcagaggcggcgacgaccccgccggcgaggccagaggcttccccgagcccagccaggccaccgcccccccccccaccgtgcccaccagacccagccccggcgccatccagagcagatgctgcaccgtgaccagaagagccctggagagaagacccagaagacagggcagacccagaggctgcgtggacagcgtgccccaccccaccaccgagcagtag

SEQ ID NO: 20024 - DNA, 1131 bp, Artificial Sequence
  Description of Artificial Sequence: Synthetic coding sequence
atggccggccccagataccccgtgagcgtgcagggcgccgccctggtgcagatcaagagactgcagaccttcgccttcagcgtgagatggagcgacggcagcgacaccttcgtgagaagaagctgggacgagttcagacagctgaagaagaccctgaaggagaccttccccgtggaggccggcctgctgagaagaagcgacagagtgctgcccaagctgctgggccaggccagcctggacgcccccctgctgggcagagtgggcagaaccagcagaggcctggccagactgcagctgctggagacctacagcagaagactgctggccaccgccgagagagtggccagaagccccaccatcaccggcttcttcgccccccagcccctggacctggagcccgccctgccccccggcagcagagtgatcctgcccacccccgaggagcagcccctgagcagagccgccggcagactgagcatccacagcctggaggcccagagcctgagatgcctgcagcccttctgcacccaggacaccagagacagacccttccaggcccaggcccaggagagcctggacgtgctgctgagacaccccagcggctggtggctggtggagaacgaggacagacagaccgcctggttccccgccccctacctggaggaggccgcccccggccagggcagagagggcggccccagcctgggcagcagcggcccccagttctgcgccagcagagcctacgagagcagcagagccgacgagctgagcgtgcccgccggcgccagagtgagagtgctggagaccagcgacagaggctggtggctgtgcagatacggcgacagagccggcctgctgcccgccgtgctgctgagacccgagggcctgggcgccctgctgagcggcaccggcttcagaggcggcgacgaccccgccggcgaggccagaggcttccccgagcccagccaggccaccgcccccccccccaccgtgcccaccagacccagccccggcgccatccagagcagatgctgcaccgtgaccagaagagccctggagagaagacccagaagacagggcagacccagaggctgcgtggacagcgtgccccaccccaccaccgagcagtag

SEQ ID NO: 20025 - DNA, 1413 bp, Artificial Sequence
  Description of Artificial Sequence: Synthetic coding sequence
atgggcaagctgcacagcaagcccgccgccgtgtgcaagagaagagagagccccgagggcgacagcttcgccgtgagcgccgcctgggccagaaagggcatcgaggagtggatcggcagacagagatgccccggcggcgtgagcggccccagacagctgagactggccggcaccatcggcagaagcaccagagagctggtgggcgacgtgctgagagacaccctgagcgaggaggaggaggacgacttcagactggaggtggccctgccccccgagaagaccgacggcctgggcagcggcgacgagaagaagatggagagagtgagcgagccctgccccggcagcaagaagcagctgaagttcgaggagctgcagtgcgacgtgagcatggaggaggacagcagacaggagtggaccttcaccctgtacgacttcgacaacaacggcaaggtgaccagagaggacatcaccagcctgctgcacaccatctacgaggtggtggacagcagcgtgaaccacagccccaccagcagcaagatgctgagagtgaagctgaccgtggcccccgacggcagccagagcaagagaagcgtgctggtgaaccaggccgacctgcagagcgccagacccagagccgagaccaagcccaccgaggacctgagaagctgggagaagaagcagagagcccccctgagattccagggcgacagcagactggagcagagcggctgctaccaccactgcgtggacgagaacatcgagagaagaaaccactacctggacctggccggcatcgagaactacaccagccagttcggccccggcagccccagcgtggcccagaagagcgagctgccccccagaaccagcaaccccaccagaagcagaagccacgagcccgaggccatccacatcccccacagaaagccccagggcgtggaccccgccagcttccacttcctggacacccccatcgccaaggtgagcgagctgcagcagagactgagaggcacccaggacggcagcaagcacttcgtgagaagccccaaggcccagggcaagagcgtgggcgtgggccacgtggccagaggcgccagaaacaagccccccctgggccccgccatccccgccgtgagccccagcgcccacctggccgccagccccgccctgctgcccagcctggcccccctgggccacaagaagcacaagcacagagccaaggagagccagcagggctgcagaggcctgcaggcccccctggccagcggcggccccgtgctgggcagagagcacctgagagagctgcccgccctggtggtgtacgagagccaggccggccagcccgtgcagagacacgagcaccaccaccaccacgagcaccaccaccactaccaccacttctaccagacctag

SEQ ID NO: 20026 - DNA, 1356 bp, Artificial Sequence
  Description of Artificial Sequence: Synthetic coding sequence
atgggcaagctgcagagcaagcacgccgccgccgccagaaagagaagagagagccccgagggcgacagcttcgtggccagcgcctacgccagcggcagaaagggcgccgaggaggccgagagaagagccagagacaagcaggagctgcccaacggcgaccccaaggagggccccttcagagaggaccagtgccccctgcaggtggccctgcccgccgagaaggccgagggcagagagcaccccggccagctgctgagcgccgacgacggcgagagagccgccaacagagagggccccagaggccccggcggccagagactgaacatcgacgccctgcagtgcgacgtgagcgtggaggaggacgacagacaggagtggaccttcaccctgtacgacttcgacaactgcggcaaggtgaccagagaggacatgagcagcctgatgcacaccatctacgaggtggtggacgccagcgtgaaccacagcagcggcagcagcaagaccctgagagtgaagctgaccgtgagccccgagcccagcagcaagagaaaggagggcccccccgccggccaggacagagagcccaccagatgcagaatggagggcgagctggccgaggagcccagagtggccgacagaagactgagcgcccacgtgagaagacccagcaccgacccccagccctgcagcgagagaggcccctactgcgtggacgagaacaccgagagaagaaaccactacctggacctggccggcatcgagaactacaccagcagattcggccccggcagcccccccgtgcaggccaagcaggagccccagggcagagccagccacctgcaggccagaagcagaagccaggagcccgacacccacgccgtgcaccacagaagaagccaggtgctggtggagcacgtggtgcccgccagcgagcccgccgccagagccctggacacccagcccagacccaagggccccgagaagcagttcctgaagagccccaagggcagcggcaagccccccggcgtgcccgccagcagcaagagcggcaaggccttcagctactacctgcccgccgtgctgcccccccaggccccccaggacggccaccacctgccccagccccccccccccccctacggccacaagagatacagacagaagggcagagagggccacagccccctgaaggccccccacgcccagcccgccaccgtggagcacgaggtggtgagagacctgccccccacccccgccggcgagggctacgccgtgcccgtgatccagagacacgagcaccaccaccaccacgagcaccaccaccaccaccaccaccaccacttccaccccagctag

SEQ ID NO: 20027 - DNA, 507 bp, Artificial Sequence
  Description of Artificial Sequence: Synthetic coding sequence
atggccggcagcgtggacaacagacagtgcggcagacagggcagacagtgcggccagcagaccgtgagcaccgccggcagcgtggacggcagacaggccgtgtggatggccggcagcgtggacgcctgccacagcggcgccagaggcggcgccggccccgccgcccacgccagcagaagaggcctgagaggcgccagcgaccccgccgccagagccccccccccccccagagccccccccccccccccccccccccccctgccccccgtgctggcccccctgcccagcacccccagaagccagcacaccaccgccagagacctgagagccggcagcagagccgccgccggctgcgtgcccatgggcagccccgcccccaccccccacctgagacagcagaccgccaccgactgcagatgctggcacgacggcggcggcgccccctggaccagaggccagggccccggcgccctgtgcagcagcgccctggacgccacctggagatag

SEQ ID NO: 20028 - DNA, 936 bp, Artificial Sequence
  Description of Artificial Sequence: Synthetic coding sequence
atgggcaagctgcagagcaagcacgccgccgccgccagaaagagaagagagagccccgagggcgacagcttcgtggccagcgcctacgccagcggcagaaagggcgccgaggaggccgagagaagagccagagacaagcaggagctgcccaacggcgaccccaaggagggccccttcagagaggaccagtgccccctgcaggtggccctgcccgccgagaaggccgagggcagagagcaccccggccagctgctgagcgccgacgacggcgagagagccgccaacagagagggccccagaggccccggcggccagagactgaacatcgacgccctgcagtgcgacgtgagcgtggaggaggacgacagacaggagtggaccttcaccctgtacgacttcgacaactgcggcaaggtgaccagagaggacatgagcagcctgatgcacaccatctacgaggtggtggacgccagcgtgaaccacagcagcggcagcagcaagaccctgagagtgaagctgaccgtgagccccgagcccagcagcaagagaaaggagggcccccccgccggccaggacagagagcccaccagatgcagaatggagggcgagctggccgaggagcccagagtggccgacagaagactgagcgcccacgtgagaagacccagcaccgacccccagccctgcagcgagagaggcccctactgcgtggacgagaacaccgagagaagaaaccactacctggacctggccggcatcgagaactacaccagcagattcggccccggcagccagctgtgcgagaagagaagcagcgcccccagaacccacagcggcgacaaggccagaggcgtgggcctgtgcagagagctgtggagccaggccggccacccccagtggcccggccccttccccagcggcctggtggccgtgtag

SEQ ID NO: 20029 - DNA, 936 bp, Artificial Sequence; identical to SEQ ID NO: 20028
  Description of Artificial Sequence: Synthetic coding sequence

SEQ ID NO: 20030 - DNA, 438 bp, Artificial Sequence
  Description of Artificial Sequence: Synthetic coding sequence
atgcccggcgtgaccgtgaaggacgtgaaccagcaggagttcgtgagagccctggccgccttcctgaagaagagcggcaagctgaaggtgcccgagtgggtggacaccgtgaagctggccaagcacaaggagctggccccctacgacgagaactggttctacaccagagccgccagcaccgccagacacctgtacctgagaggcggcgccggcgtgggcagcatgaccaagatctacggcggcagacagagaaacggcgtgatgcccagccacttcagcagaggcagcaagagcgtggccagaagagtgctgcaggccctggagggcctgaagatggtggagaaggaccaggacggcggcagaaagctgaccccccagggccagagagacctggacagaatcgccggccaggtggccgccgccaacaagaagcactag

SEQ ID NO: 20031 - DNA, 1134 bp, Artificial Sequence
  Description of Artificial Sequence: Synthetic coding sequence
atggccgaggaggtggtggtggtggccaagttcgactacgtggcccagcaggagcaggagctggacatcaagaagaacgagagactgtggctgctggacgacagcaagagctggtggagagtgagaaacagcatgaacaagaccggcttcgtgcccagcaactacgtggagagaaagaacagcgccagaaaggccagcatcgtgaagaacctgaaggacaccctgggcatcggcaaggtgaagagaaagcccagcgtgcccgacagcgccagccccgccgacgacagcttcgtggaccccggcgagagactgtacgacctgaacatgcccgcctacgtgaagttcaactacatggccgagagagaggacgagctgagcctgatcaagggcaccaaggtgatcgtgatggagaagtgcagcgacggctggtggagaggcagctacaacggccaggtgggctggttccccagcaactacgtgaccgaggagggcgacagccccctgggcgaccacgtgggcagcctgagcgagaagctggccgccgtggtgaacaacctgaacaccggccaggtgctgcacgtggtgcaggccctgtaccccttcagcagcagcaacgacgaggagctgaacttcgagaagggcgacgtgatggacgtgatcgagaagcccgagaacgaccccgagtggtggaagtgcagaaagatcaacggcatggtgggcctggtgcccaagaactacgtgaccgtgatgcagaacaaccccctgaccagcggcctggagcccagccccccccagtgcgactacatcagacccagcctgaccggcaagttcgccggcaacccctggtactacggcaaggtgaccagacaccaggccgagatggccctgaacgagagaggccacgagggcgacttcctgatcagagacagcgagagcagccccaacgacttcagcgtgagcctgaaggcccagggcaagaacaagcacttcaaggtgcagctgaaggagaccgtgtactgcatcggccagagaaagttcagcaccatggaggagctggtggagcactacaagaaggcccccatcttcaccagcgagcagggcgagaagctgtacctggtgaagcacctgagctag

SEQ ID NO: 20032 - DNA, 228 bp, Artificial Sequence
  Description of Artificial Sequence: Synthetic coding sequence
atggccgaggaggtggtggtggtggccaagttcgactacgtggcccagcaggagcaggagctggacatcaagaagaacgagagactgtggctgctggacgacagcaagagctggtggagagtgagaaacagcatgaacaagaccggcttcgtgcccagcaactacgtggagagaaagaacagcgccagaaaggccagcatcgtgaagaacctgaaggacaccctgtag

SEQ ID NO: 20033 - DNA, 1134 bp, Artificial Sequence; identical to SEQ ID NO: 20031
  Description of Artificial Sequence: Synthetic coding sequence

SEQ ID NO: 20034 - DNA, 348 bp, Artificial Sequence
  Description of Artificial Sequence: Synthetic coding sequence
atggccgaggaggtggtggtggtggccaagttcgactacgtggcccagcaggagcaggagctggacatcaagaagaacgagagactgtggctgctggacgacagcaagagctggtggagagtgagaaacagcatgaacaagaccggcttcgtgcccagcaactacgtggagagaaagaacagcgccagaaaggccagcatcgtgaagaacctgaaggacaccctgggcatcggcaaggtgaagagaaagcccagcgtgcccgacagcgccagccccgccgacgacagcttcgtggaccccggcgagagactgtacgacctgaacatgcccgcctacgtgaagttctag

SEQ ID NO: 20035 - DNA, 390 bp, Artificial Sequence
  Description of Artificial Sequence: Synthetic coding sequence
atggccgaggaggtggtggtggtggccaagttcgactacgtggcccagcaggagcaggagctggacatcaagaagaacgagagactgtggctgctggacgacagcaagagctggtggagagtgagaaacagcatgaacaagaccggcttcgtgcccagcaactacgtggagagaaagaacagcgccagaaaggccagcatcgtgaagaacctgaaggacaccctgggcatcggcaaggtgaagagaaagcccagcgtgcccgacagcgccagccccgccgacgacagcttcgtggaccccggcgagagactgtacgacctgaacatgcccgcctacgtgaagttcaactacatggccgagagagaggacgagctgagcctgatcaagtag

SEQ ID NO: 20036 - DNA, 942 bp, Artificial Sequence
  Description of Artificial Sequence: Synthetic coding sequence
atggactggctgaacgtgttcaaggacttcttcagcatcggcaaggtgaagagaaagcccagcgtgcccgacagcgccagccccgccgacgacagcttcgtggaccccggcgagagactgtacgacctgaacatgcccgcctacgtgaagttcaactacatggccgagagagaggacgagctgagcctgatcaagggcaccaaggtgatcgtgatggagaagtgcagcgacggctggtggagaggcagctacaacggccaggtgggctggttccccagcaactacgtgaccgaggagggcgacagccccctgggcgaccacgtgggcagcctgagcgagaagctggccgccgtggtgaacaacctgaacaccggccaggtgctgcacgtggtgcaggccctgtaccccttcagcagcagcaacgacgaggagctgaacttcgagaagggcgacgtgatggacgtgatcgagaagcccgagaacgaccccgagtggtggaagtgcagaaagatcaacggcatggtgggcctggtgcccaagaactacgtgaccgtgatgcagaacaaccccctgaccagcggcctggagcccagccccccccagtgcgactacatcagacccagcctgaccggcaagttcgccggcaacccctggtactacggcaaggtgaccagacaccaggccgagatggccctgaacgagagaggccacgagggcgacttcctgatcagagacagcgagagcagccccaacgacttcagcgtgagcctgaaggcccagggcaagaacaagcacttcaaggtgcagctgaaggagaccgtgtactgcatcggccagagaaagttcagcaccatggaggagctggtggagcactacaagaaggcccccatcttcaccagcgagcagggcgagaagctgtacctggtgaagcacctgagctag

SEQ ID NO: 20037 - DNA, 3384 bp, Artificial Sequence
  Description of Artificial Sequence: Synthetic coding sequence
atgagcctgaccagcgcctaccagcacaagctggccgagaagctgaccatcctgaacgacagaggccagggcgtgctgatcagaatgtacaacatcaagaagacctgcagcgaccccaagagcaagccccccttcctgctggagaagagcatggagcccagcctgaagtacatcaacaagaagttccccaacatcgacgtgagaaacagcacccagcacctgggccccgtgcacagagagaaggccgagatcatcagattcctgaccaactactaccagagcttcgtggacgtgatggagttcagagaccacgtgtacgagctgctgaacaccatcgacgcctgccagtgccacttcgacatcaacctgaacttcgacttcaccagaagctacctggacctgatcgtgacctacaccagcgtgatcctgctgctgagcagaatcgaggacagaagaatcctgatcggcatgtacaactgcgcccacgagatgctgcacggccacggcgaccccagcttcgccagactgggccagatggtgctggagtacgaccaccccctgaagaagctgaccgaggagttcggcccccacaccaaggccgtgagcggcgccctgctgagcctgcacttcctgttcgtgagaagaaaccagggcgccgagcagtggagaagcgcccagctgctgagcctgatcagcaacccccccgccatgatcaaccccgccaacagcgacaccatggcctgcgagtacctgagcgtggaggtgatggagagatggatcatcatcggcttcctgctgtgccacggctgcctgaacagcaacagccagtgccagaagctgtggaagctgtgcctgcagggcagcctgtacatcaccctgatcagagaggacgtgctgcaggtgcacaaggtgaccgaggacctgttcagcagcctgaagggctacggcaagagagtggccgacatcaaggagagcaaggagcacgtgatcgccaacagcggccagttccactgccagagaagacagttcctgagaatggccgtgaaggagctggagaccgtgctggccgacgagcccggcctgctgggccccaaggccctgttcgccttcatggccctgagcttcatcagagacgaggtgacctggctggtgagacacaccgagaacgtgaccaagaccaagacccccgaggactacgccgacagcagcatcgccgagctgctgttcctgctggagggcatcagaagcctggtgagaagacacatcaaggtgatccagcagtaccacctgcagtacctggccagattcgacgccctggtgctgagcgacatcatccagaacctgagcgtgtgccccgaggaggagagcatcatcatgagcagcttcgtgagcatcctgagcagcctgaacctgaagcaggtggacaacggcgagaagttcgagttcagcggcctgagactggactggttcagactgcaggcctacaccagcgtggccaaggcccccctgcacctgcacgagaaccccgacctggccaaggtgatgaacctgatcgtgttccacagcagaatgctggacagcgtggagaagctgctggtggagaccagcgacctgagcaccttctgcttccacctgagaatcttcgagaagatgttcgccatgaccctggaggagagcgccatgctgagatacgccatcgccttccccctgatctgcgcccacttcgtgcactgcacccacgagatgtgccccgaggagtacccccacctgaagaaccacggcctgcaccactgcaacagcttcctggaggagctggccaagcagaccagcaactgcgtgctggagatctgcgccgagcagagaaacctgagcgagcagctgctgcccaagcactgcgccaccaccatcagcaaggccaagaacaagaagaccagaaagcagagacagacccccagaaagggcgagcccgagagagacaagcccggcgccgagagccacagaaagaacagaagcatcgtgaccaacatggacaagctgcacctgaacctgaccgagctggccctgaccatgaaccacgtgtacagcttcagcgtgttcgagcacaccatcttccccagcgagtacctgagcagccacctggaggccagactgaacagagccatcgtgtggctggccggctacaacgccaccacccaggagatcgtgagacccagcgagctgctggccggcgtgaaggcctacatcggcttcatccagagcctggcccagttcctgggcgccgacgccagcagagtgatcagaaacgccctgctgcagcagacccagcccctggacagctgcggcgagcagaccatcaccaccctgtacaccaactggtacctggagagcctgctgagacaggccagcagcggcaccatcatcctgagccccgccatgcaggccttcgtgagcctgcccagagagggcgagcagaacttcagcgccgaggagttcagcgacatcagcgagatgagagccctggccgagctgctgggcccctacggcatgaagttcctgagcgagaacctgatgtggcacgtgaccagccagatcgtggagctgaagaagctggtggtggagaacatggacatcctggtgcagatcagaagcaacttcagcaagcccgacctgatggccagcctgctgccccagctgaccggcgccgagaacgtgctgaagagaatgaccatcatcggcgtgatcctgagcttcagagccatggcccaggagggcctgagagaggtgttcagcagccactgccccttcctgatgggccccatcgagtgcctgaaggagttcgtgacccccgacaccgacatcaaggtgaccctgagcatcttcgagctggccagcgccgccggcgtgggctgcgacatcgaccccgccctggtggccgccatcgccaacctgaaggccgacaccagcagccccgaggaggagtacaaggtggcctgcctgctgctgatcttcctggccgtgagcctgcccctgctggccaccgaccccagcagcttctacagcatcgagaaggacggctacaacaacaacatccactgcctgaccaaggccatcatccaggtgagcgccgccctgttcaccctgtacaacaagaacatcgagacccacctgaaggagttcctggtggtggccagcgtgagcctgctgcagctgggccaggagaccgacaagctgaagaccagaaacagagagagcatcagcctgctgatgagactggtggtggaggagagcagcttcctgaccctggacatgctggagagctgcttcccctacgtgctgctgagaaacgcctacagagaggtgagcagagccttccacctgaactag

SEQ ID NO: 20038 - DNA, 3234 bp, Artificial Sequence
  Description of Artificial Sequence: Synthetic coding sequence
atggagcccagcctgaagtacatcaacaagaagttccccaacatcgacgtgagaaacagcacccagcacctgggccccgtgcacagagagaaggccgagatcatcagattcctgaccaactactaccagagcttcgtggacgtgatggagttcagagaccacgtgtacgagctgctgaacaccatcgacgcctgccagtgccacttcgacatcaacctgaacttcgacttcaccagaagctacctggacctgatcgtgacctacaccagcgtgatcctgctgctgagcagaatcgaggacagaagaatcctgatcggcatgtacaactgcgcccacgagatgctgcacggccacggcgaccccagcttcgccagactgggccagatggtgctggagtacgaccaccccctgaagaagctgaccgaggagttcggcccccacaccaaggccgtgagcggcgccctgctgagcctgcacttcctgttcgtgagaagaaaccagggcgccgagcagtggagaagcgcccagctgctgagcctgatcagcaacccccccgccatgatcaaccccgccaacagcgacaccatggcctgcgagtacctgagcgtggaggtgatggagagatggatcatcatcggcttcctgctgtgccacggctgcctgaacagcaacagccagtgccagaagctgtggaagctgtgcctgcagggcagcctgtacatcaccctgatcagagaggacgtgctgcaggtgcacaaggtgaccgaggacctgttcagcagcctgaagggctacggcaagagagtggccgacatcaaggagagcaaggagcacgtgatcgccaacagcggccagttccactgccagagaagacagttcctgagaatggccgtgaaggagctggagaccgtgctggccgacgagcccggcctgctgggccccaaggccctgttcgccttcatggccctgagcttcatcagagacgaggtgacctggctggtgagacacaccgagaacgtgaccaagaccaagacccccgaggactacgccgacagcagcatcgccgagctgctgttcctgctggagggcatcagaagcctggtgagaagacacatcaaggtgatccagcagtaccacctgcagtacctggccagattcgacgccctggtgctgagcgacatcatccagaacctgagcgtgtgccccgaggaggagagcatcatcatgagcagcttcgtgagcatcctgagcagcctgaacctgaagcaggtggacaacggcgagaagttcgagttcagcggcctgagactggactggttcagactgcaggcctacaccagcgtggccaaggcccccctgcacctgcacgagaaccccgacctggccaaggtgatgaacctgatcgtgttccacagcagaatgctggacagcgtggagaagctgctggtggagaccagcgacctgagcaccttctgcttccacctgagaatcttcgagaagatgttcgccatgaccctggaggagagcgccatgctgagatacgccatcgccttccccctgatctgcgcccacttcgtgcactgcacccacgagatgtgccccgaggagtacccccacctgaagaaccacggcctgcaccactgcaacagcttcctggaggagctggccaagcagaccagcaactgcgtgctggagatctgcgccgagcagagaaacctgagcgagcagctgctgcccaagcactgcgccaccaccatcagcaaggccaagaacaagaagaccagaaagcagagacagacccccagaaagggcgagcccgagagagacaagcccggcgccgagagccacagaaagaacagaagcatcgtgaccaacatggacaagctgcacctgaacctgaccgagctggccctgaccatgaaccacgtgtacagcttcagcgtgttcgagcacaccatcttccccagcgagtacctgagcagccacctggaggccagactgaacagagccatcgtgtggctggccggctacaacgccaccacccaggagatcgtgagacccagcgagctgctggccggcgtgaaggcctacatcggcttcatccagagcctggcccagttcctgggcgccgacgccagcagagtgatcagaaacgccctgctgcagcagacccagcccctggacagctgcggcgagcagaccatcaccaccctgtacaccaactggtacctggagagcctgctgagacaggccagcagcggcaccatcatcctgagccccgccatgcaggccttcgtgagcctgcccagagagggcgagcagaacttcagcgccgaggagttcagcgacatcagcgagatgagagccctggccgagctgctgggcccctacggcatgaagttcctgagcgagaacctgatgtggcacgtgaccagccagatcgtggagctgaagaagctggtggtggagaacatggacatcctggtgcagatcagaagcaacttcagcaagcccgacctgatggccagcctgctgccccagctgaccggcgccgagaacgtgctgaagagaatgaccatcatcggcgtgatcctgagcttcagagccatggcccaggagggcctgagagaggtgttcagcagccactgccccttcctgatgggccccatcgagtgcctgaaggagttcgtgacccccgacaccgacatcaaggtgaccctgagcatcttcgagctggccagcgccgccggcgtgggctgcgacatcgaccccgccctggtggccgccatcgccaacctgaaggccgacaccagcagccccgaggaggagtacaaggtggcctgcctgctgctgatcttcctggccgtgagcctgcccctgctggccaccgaccccagcagcttctacagcatcgagaaggacggctacaacaacaacatccactgcctgaccaaggccatcatccaggtgagcgccgccctgttcaccctgtacaacaagaacatcgagacccacctgaaggagttcctggtggtggccagcgtgagcctgctgcagctgggccaggagaccgacaagctgaagaccagaaacagagagagcatcagcctgctgatgagactggtggtggaggagagcagcttcctgaccctggacatgctggagagctgcttcccctacgtgctgctgagaaacgcctacagagaggtgagcagagccttccacctgaactag

SEQ ID NO: 20039 - DNA, 2622 bp, Artificial Sequence
  Description of Artificial Sequence: Synthetic coding sequence
atgagcttcatcatgaagctgcacagacacttccagagaaccgtgatcctgctggccaccttctgcatggtgagcatcatcatcagcgcctactacctgtacagcggctacaagcaggagaacgagctgagcgagaccgccagcgaggtggactgcggcgacctgcagcacctgccctaccagctgatggaggtgaaggccatgaagctgttcgacgccagcagaaccgaccccaccgtgctggtgttcgtggagagccagtacagcagcctgggccaggacatcatcatgatcctggagagcagcagattccagtaccacatcgagatcgcccccggcaagggcgacctgcccgtgctgatcgacaagatgaagggcaagtacatcctgatcatctacgagaacatcctgaagtacatcaacatggacagctggaacagaagcctgctggacaagtactgcgtggagtacggcgtgggcgtgatcggcttccacaagaccagcgagaagagcgtgcagagcttccagctgaagggcttccccttcagcatctacggcaacctggccgtgaaggactgctgcatcaacccccacagccccctgatcagagtgaccaagagcagcaagctggagaagggcagcctgcccggcaccgactggaccgtgttccagatcaaccacagcgcctaccagcccgtgatcttcgccaaggtgaagacccccgagaacctgagccccagcatcagcaagggcgccttctacgccaccatcatccacgacctgggcctgcacgacggcatccagagagtgctgttcggcaacaacctgaacttctggctgcacaagctgatcttcatcgacgccatcagcttcctgagcggcaagagactgaccctgagcctggacagatacatcctggtggacatcgacgacatcttcgtgggcaaggagggcaccagaatgaacaccaacgacgtgaaggccctgctggacacccagaacctgctgagagcccagatcaccaacttcaccttcaacctgggcttcagcggcaagttctaccacaccggcaccgaggaggaggacgagggcgacgactgcctgctgggcagcgtggacgagttctggtggttcccccacatgtggagccacatgcagccccacctgttccacaacgagagcagcctggtggagcagatgatcctgaacaagaagttcgccctggagcacggcatccccaccgacatgggctacgccgtggccccccaccacagcggcgtgtaccccgtgcacgtgcagctgtacgaggcctggaagaaggtgtggaacatcaagatcaccagcaccgaggagtacccccacctgaagcccgccagatacagaagaggcttcatccacaagaacatcatggtgctgcccagacagacctgcggcctgttcacccacaccatcttctacaaggagtaccccggcggccccaaggagctggacaagagcatccagggcggcgagctgttcttcaccgtggtgctgaaccccatcagcatcttcatgacccacctgagcaactacggcaacgacagactgggcctgtacaccttcgtgaacctggccaacttcgtgaagagctggaccaacctgagactgcagaccctgccccccgtgcagctggcccacaagtacttcgagctgttccccgaccagaaggaccccctgtggcagaacccctgcgacgacaagagacacagagacatctggagcaaggagaagacctgcgacagactgcccaagttcctggtgatcggcccccagaagaccggcaccaccgccctgtacctgttcctggtgatgcaccccagcatcctgagcaacagccccagccccaagaccttcgaggaggtgcagttcttcaacagaaacaactaccacagaggcatcgactggtacatggacttcttccccgtgcccagcaacgtgaccaccgacttcctgttcgagaagagcgccaactacttccacagcgaggaggcccccaagagagccgccagcctggtgcccaaggccaagatcatcaccatcctgatcgaccccagcgacagagcctacagctggtaccagcaccagagaagccacgaggaccccgccgccctgaagttcagcttctacgaggtgatcagcgccggccccagagcccccagcgagctgagagccctgcagaagagatgcctggtgcccggctggtacgccagccacatcgagagatggctggtgtacttcccccccttccagctgctgatcatcgacggccagcagctgagaaccgaccccgccaccgtgatggacgaggtgcagaagttcctgggcgtgctgccccactacaactacagcgaggccctgaccttcgacagccacaagggcttctggtgccagctgctggaggagggcaagaccaagtgcctgggcaagagcaagggcagaaagtacccccccatggacagcgacagcagaaccttcctgagcagctactacagagaccacaacgtggagctgagcaagctgctgcacaagctgggccagcccctgcccagctggctgagacaggagctgcagaaggtgagatag

SEQ ID NO: 20040 - DNA, 1686 bp, Artificial Sequence
  Description of Artificial Sequence: Synthetic coding sequence
atgagcttcatcatgaagctgcacagacacttccagagaaccgtgatcctgctggccaccttctgcatggtgagcatcatcatcagcgcctactacctgtacagcggctacaagcaggagaacgagctgagcgagaccgccagcgaggtggactgcggcgacctgcagcacctgccctaccagctgatggaggtgaaggccatgaagctgttcgacgccagcagaaccgaccccaccgtgctggtgttcgtggagagccagtacagcagcctgggccaggacatcatcatgatcctggagagcagcagattccagtaccacatcgagatcgcccccggcaagggcgacctgcccgtgctgatcgacaagatgaagggcaagtacatcctgatcatctacgagaacatcctgaagtacatcaacatggacagctggaacagaagcctgctggacaagtactgcgtggagtacggcgtgggcgtgatcggcttccacaagaccagcgagaagagcgtgcagagcttccagctgaagggcttccccttcagcatctacggcaacctggccgtgaaggactgctgcatcaacccccacagccccctgatcagagtgaccaagagcagcaagctggagaagggcagcctgcccggcaccgactggaccgtgttccagatcaaccacagcgcctaccagcccgtgatcttcgccaaggtgaagacccccgagaacctgagccccagcatcagcaagggcgccttctacgccaccatcatccacgacctgggcctgcacgacggcatccagagagtgctgttcggcaacaacctgaacttctggctgcacaagctgatcttcatcgacgccatcagcttcctgagcggcaagagactgaccctgagcctggacagatacatcctggtggacatcgacgacatcttcgtgggcaaggagggcaccagaatgaacaccaacgacgtgaaggagcacggcatccccaccgacatgggctacgccgtggccccccaccacagcggcgtgtaccccgtgcacgtgcagctgtacgaggcctggaagaaggtgtggaacatcaagatcaccagcaccgaggagtacccccacctgaagcccgccagatacagaagaggcttcatccacaagaacatcatggtgctgcccagacagacctgcggcctgttcacccacaccatcttctacaaggagtaccccggcggccccaaggagctggacaagagcatccagggcggcgagctgttcttcaccgtggtgctgaaccccatcagcatcttcatgacccacctgagcaactacggcaacgacagactgggcctgtacaccttcgtgaacctggccaacttcgtgaagagctggaccaacctgagactgcagaccctgccccccgtgcagctggcccacaagtacttcgagctgttccccgaccagaaggaccccctgtggcagaacccctgcgacgacaagagacacagagacatctggagcaaggagaagacctgcgacagactgcccaagttcctggtgatcggcccccagaagaccggcaccaccgccctgtacctgttcctggtgatgcaccccagcatcctgagcaacagccccagccccaagaccttcgaggaggtgtacggcttcctgcccagccccatctag

SEQ ID NO: 20041 - DNA, 2619 bp, Artificial Sequence
  Description of Artificial Sequence: Synthetic coding sequence
atgaacctgatcgtgaagctgagaagaagcttcagaaccctgatcgtgctgctggccaccttctgcctggtgagcatcgtgatcagcgcctacttcctgtacagcggctacaagcaggagatgaccctgatcgagaccaccgccgaggccgagtgcaccgacatcaagatcctgccctacagaagcatggagctgaagaccgtgaagcccatcgacaccagcaagaccgaccccaccgtgctgctgttcgtggagagccagtacagccagctgggccaggacatcatcgccatcctggagagcagcagattccagtaccacatggtgatcgcccccggcaagggcgacatcccccccctgaccgacaacggcaagggcaagtacaccctggtgatctacgagaacatcctgaagtacgtgagcatggacagctggaacagagagctgctggagaagtactgcgtggagtacagcgtgagcatcatcggcttccacaaggccaacgagaacagcctgcccagcacccagctgaagggcttccccctgaacctgttcaacaacctggccctgaaggactgcttcgtgaacccccagagccccctgctgcacatcaccaaggcccccaaggtggagaagggccccctgcccggcgaggactggaccatcttccagtacaaccacagcacctaccagcccgtgctgctgaccgagctgcagaccgagaagagcctgagcagcctgagcagcaagaccctgttcgccaccgtgatccaggacctgggcctgcacgacggcatccagagagtgctgttcggcaacaacctgaacttctggctgcacaagctgatcttcatcgacgccatcagcttcctgagcggcaagagactgaccctgagcctggacagatacatcctggtggacatcgacgacatcttcgtgggcaaggagggcaccagaatgaacgtgaaggacgtgaaggccctgctggagacccagaacctgctgagaacccaggtggccaacttcaccttcaacctgggcttcagcggcaagttctaccacaccggcaccgaggaggaggacgagggcgacgacctgctgctgagaagcgtggacgagttctggtggttcccccacatgtggagccacatgcagccccacctgttccacaacgagagcagcctggtggagcagatgatcctgaacaaggagttcgccctggagcacggcatccccatcaacatgggctacgccgtggccccccaccacagcggcgtgtaccccgtgcacatccagctgtacgccgcctggaagaaggtgtggggcatccaggtgaccagcaccgaggagtacccccacctgaagcccgccagatacagaaagggcttcatccacaacagcatcatggtgctgcccagacagacctgcggcctgttcacccacaccatcttctacaaggagtaccccggcggcccccaggagctggacaagagcatcagaggcggcgagctgttcctgaccatcctgctgaaccccatcagcatcttcatgacccacctgagcaactacggcaacgacagactgggcctgtacaccttcgtgaacctggtgaacttcgtgcagagctggaccaacctgaagctgcagaccctgccccccgtgcagctggcccaccagtacttcgagctgttccccgagcagaaggaccccctgtggcagaacccctgcgacgacaagagacacaaggacatctggagcagagagaagacctgcgaccacctgcccaagttcctggtgatcggcccccagaagaccggcaccaccgccctgtacctgttcctgctgatgcaccccagcatcatcagcaacctgcccagccccaagaccttcgaggaggtgcagttcttcaacggcaacaactaccacaagggcatcgactggtacatggacttcttccccacccccagcaacaccaccagcgacttcctgttcgagaagagcgccaactacttccacagcgaggaggcccccagaagagccgccagcctggtgcccaaggccaagatcatcaccatcctgatcgaccccagcgacagagcctacagctggtaccagcaccagagaagccacgaggaccccgccgccctgagattcaacttctacgaggtgatcagcaccggccactgggcccccagcgacctgaagaccctgcagagaagatgcctggtgcccggctggtacgccgtgcacatcgagagatggctgacctacttcgccaccagccagctgctgatcatcgacggccagcagctgagaagcgaccccgccaccgtgatggacgaggtgcagaagttcctgggcgtgacccccagatacaactacagcgaggccctgaccttcgacccccagaagggcttctggtgccagctgctggagggcggcaagaccaagtgcctgggcaagagcaagggcagaaagtacccccccatggaccccgagagcagaaccttcctgagcaactactacagagaccacaacgtggagctgagcaagctgctgcacagactgggccagcccctgcccagctggctgagacaggagctgcagaaggtgagatag

SEQ ID NO: 20042 - DNA, 1635 bp, Artificial Sequence
  Description of Artificial Sequence: Synthetic coding sequence
atggccaccgcccccggccccgccggcatcgccatgggcagcgtgggcagcctgctggagagacaggacttcagccccgaggagctgagagccgccctggccggcagcagaggcagcagacagcccgacggcctgctgagaaagggcctgggccagagagagttcctgagctacctgcacctgcccaagaaggacagcaagagcaccaagaacaccaagagagcccccagaaacgagcccgccgactacgccaccctgtactacagagagcacagcagagccggcgacttcagcaagaccagcctgcccgagagaggcagattcgacaagtgcagaatcagacccagcgtgttcaagcccaccgccggcaacggcaagggcttcctgagcatgcagagcctggccagccacaagggccagaagctgtggagaagcaacggcagcctgcacaccctggcctgccacccccccctgagccccggccccagagccagccaggccagagcccagctgctgcacgccctgagcctggacgagggcggccccgagcccgagcccagcctgagcgacagcagcagcggcggcagcttcggcagaagccccggcaccggccccagccccttcagcagcagcctgggccacctgaaccacctgggcggcagcctggacagagccagccagggccccaaggaggccggcccccccgccgtgctgagctgcctgcccgagcccccccccccctacgagttcagctgcagcagcgccgaggagatgggcgccgtgctgcccgagacctgcgaggagctgaagagaggcctgggcgacgaggacggcagcaaccccttcacccaggtgctggaggagagacagagactgtggctggccgagctgaagagactgtacgtggagagactgcacgaggtgacccagaaggccgagagaagcgagagaaacctgcagctgcagctgttcatggcccagcaggagcagagaagactgagaaaggagctgagagcccagcagggcctggcccccgagcccagagcccccggcaccctgcccgaggccgaccccagcgccagacccgaggaggaggccagatgggaggtgtgccagaagaccgccgagatcagcctgctgaagcagcagctgagagaggcccaggccgagctggcccagaagctggccgagatcttcagcctgaagacccagctgagaggcagcagagcccaggcccaggcccaggacgccgagctggtgagactgagagaggccgtgagaagcctgcaggagcaggcccccagagaggaggcccccggcagctgcgagaccgacgactgcaagagcagaggcctgctgggcgaggccggcggcagcgaggccagagacagcgccgagcagctgagagccgagctgctgcaggagagactgagaggccaggagcaggccctgagattcgagcaggagagaagaacctggcaggaggagaaggagagagtgctgagataccagagagagatccagggcggctacatggacatgtacagaagaaaccaggccctggagcaggagctgagagccctgagagagccccccaccccctggagccccagactggagagcagcaagatctag

SEQ ID NO: 20043 - DNA, 939 bp, Artificial Sequence
  Description of Artificial Sequence: Synthetic coding sequence
atggccgcccagaagatcaacgagggcctggagcacctggccaaggccgagaagtacctgaagaccggcttcctgaagtggaagcccgactacgacagcgccgccagcgagtacggcaaggccgccgtggccttcaagaacgccaagcagttcgagcaggccaaggacgcctgcctgagagaggccgtggcccacgagaacaacagagccctgttccacgccgccaaggcctacgagcaggccggcatgatgctgaaggagatgcagaagctgcccgaggccgtgcagctgatcgagaaggccagcatgatgtacctggagaacggcacccccgacaccgccgccatggccctggagagagccggcaagctgatcgagaacgtggaccccgagaaggccgtgcagctgtaccagcagaccgccaacgtgttcgagaacgaggagagactgagacaggccgtggagctgctgggcaaggccagcagactgctggtgagaggcagaagattcgacgaggccgccctgagcatccagaaggagaagaacatctacaaggagatcgagaactaccccacctgctacaagaagaccatcgcccaggtgctggtgcacctgcacagaaacgactacgtggccgccgagagatgcgtgagagagagctacagcatccccggcttcaacggcagcgaggactgcgccgccctggagcagctgctggagggctacgaccagcaggaccaggaccaggtgagcgacgtgtgcaacagccccctgttcaagtacatggacaacgactacgccaagctgggcctgagcctggtggtgcccggcggcggcatcaagaagaagagccccgccaccccccaggccaagcccgacggcgtgaccgccaccgccgccgacgaggaggaggacgagtacagcggcggcctgtgctag

SEQ ID NO: 20044 - DNA, 693 bp, Artificial Sequence
  Description of Artificial Sequence: Synthetic coding sequence
atgatgctgaaggagatgcagaagctgcccgaggccgtgcagctgatcgagaaggccagcatgatgtacctggagaacggcacccccgacaccgccgccatggccctggagagagccggcaagctgatcgagaacgtggaccccgagaaggccgtgcagctgtaccagcagaccgccaacgtgttcgagaacgaggagagactgagacaggccgtggagctgctgggcaaggccagcagactgctggtgagaggcagaagattcgacgaggccgccctgagcatccagaaggagaagaacatctacaaggagatcgagaactaccccacctgctacaagaagaccatcgcccaggtgctggtgcacctgcacagaaacgactacgtggccgccgagagatgcgtgagagagagctacagcatccccggcttcaacggcagcgaggactgcgccgccctggagcagctgctggagggctacgaccagcaggaccaggaccaggtgagcgacgtgtgcaacagccccctgttcaagtacatggacaacgactacgccaagctgggcctgagcctggtggtgcccggcggcggcatcaagaagaagagccccgccaccccccaggccaagcccgacggcgtgaccgccaccgccgccgacgaggaggaggacgagtacagcggcggcctgtgctag

SEQ ID NO: 20045 - DNA, 1611 bp, Artificial Sequence
  Description of Artificial Sequence: Synthetic coding sequence
atgctgcacctgctggccctgttcctgcactgcctgcccctggccagcggcgactacgacatctgcaagagctgggtgaccaccgacgagggccccacctgggagttctacgcctgccagcccaaggtgatgagactgaaggactacgtgaaggtgaaggtggagcccagcggcatcacctgcggcgacccccccgagagattctgcagccacgagaacccctacctgtgcagcaacgagtgcgacgccagcaaccccgacctggcccacccccccagactgatgttcgacaaggaggaggagggcctggccacctactggcagagcatcacctggagcagataccccagccccctggaggccaacatcaccctgagctggaacaagaccgtggagctgaccgacgacgtggtgatgaccttcgagtacggcagacccaccgtgatggtgctggagaagagcctggacaacggcagaacctggcagccctaccagttctacgccgaggactgcatggaggccttcggcatgagcgccagaagagccagagacatgagcagcagcagcgcccacagagtgctgtgcaccgaggagtacagcagatgggccggcagcaagaaggagaagcacgtgagattcgaggtgagagacagattcgccatcttcgccggccccgacctgagaaacatggacaacctgtacaccagactggagagcgccaagggcctgaaggagttcttcaccctgaccgacctgagaatgagactgctgagacccgccctgggcggcacctacgtgcagagagagaacctgtacaagtacttctacgccatcagcaacatcgaggtgatcggcagatgcaagtgcaacctgcacgccaacctgtgcagcatgagagagggcagcctgcagtgcgagtgcgagcacaacaccaccggccccgactgcggcaagtgcaagaagaacttcagaaccagaagctggagagccggcagctacctgcccctgccccacggcagccccaacgcctgcaccgcccccagcggcaccttcagcaaggacgccttcctgcactgcgagtgctacggccacagcaacagatgcagctacatcgacttcctgaacgtggtgacctgcgtgagctgcaagcacaacaccagaggccagcactgccagcactgcagactgggctactacagaaacggcagcgccgagctggacgacgagaacgtgtgcatcgagtgcaactgcaaccagatcggcagcgtgcacgacagatgcaacgagaccggcttctgcgagtgcagagagggcgccgccggccccaagtgcgacgactgcctgcccacccactactggagacagggctgctaccccaacgtgtgcgacgacgaccagctgctgtgccagaacggcggcacctgcctgcagaaccagagatgcgcctgccccagaggctacaccggcgtgagatgcgagcagcccagatgcgaccccgccgacgacgacggcggcctggactgcgacagagcccccggcgccgcccccagacccgccaccctgctgggctgcctgctgctgctgggcctggccgccagactgggcagatag

SEQ ID NO: 20046 - DNA, 1269 bp, Artificial Sequence
  Description of Artificial Sequence: Synthetic coding sequence
atgctgcacctgctggccctgttcctgcactgcctgcccctggccagcggcgactacgacatctgcaagagctgggtgaccaccgacgagggccccacctgggagttctacgcctgccagcccaaggtgatgagactgaaggactacgtgaaggtgaaggtggagcccagcggcatcacctgcggcgacccccccgagagattctgcagccacgagaacccctacctgtgcagcaacgagtgcgacgccagcaaccccgacctggcccacccccccagactgatgttcgacaaggaggaggagggcctggccacctactggcagagcatcacctggagcagataccccagccccctggaggccaacatcaccctgagctggaacaagaccgtggagctgaccgacgacgtggtgatgaccttcgagtacggcagacccaccgtgatggtgctggagaagagcctggacaacggcagaacctggcagccctaccagttctacgccgaggactgcatggaggccttcggcatgagcgccagaagagccagagacatgagcagcagcagcgcccacagagtgctgtgcaccgaggagtacagcagatgggccggcagcaagaaggagaagcacgtgagattcgaggtgagagacagattcgccatcttcgccggccccgacctgagaaacatggacaacctgtacaccagactggagagcgccaagggcctgaaggagttcttcaccctgaccgacctgagaatgagactgctgagacccgccctgggcggcacctacgtgcagagagagaacctgtacaagtacttctacgccatcagcaacatcgaggtgatcggcagatgcaagtgcaacctgcacgccaacctgtgcagcatgagagagggcagcctgcagtgcgagtgcgagcacaacaccaccggccccgactgcggcaagtgcaagaagaacttcagaaccagaagctggagagccggcagctacctgcccctgccccacggcagccccaacgcctgcgccaccgccggcagcttcggcaccctgcagacccccccccccggcagaagccccagcgccctgagaggcagcagaagaggcctggccaacgtgaaggagcccgccggcagcagaccccagatcagcgagatgctgctgggctgcaccgtgaccctgcaccagggcagcgtgggcccccacatcccccccaagctgagcctgcccgaccccggcggcccctggctgggcagccagtag

SEQ ID NO: 20047 - DNA, 1569 bp, Artificial Sequence
  Description of Artificial Sequence: Synthetic coding sequence
atgctgcacctgctggccctgttcctgcactgcctgcccctggccagcggcgactacgacatctgcaagagctgggtgaccaccgacgagggccccacctgggagttctacgcctgccagcccaaggtgatgagactgaaggactacgtgaaggtgaaggtggagcccagcggcatcacctgcggcgacccccccgagagattctgcagccacgagaacccctacctgtgcagcaacgagtgcgacgccagcaaccccgacctggcccacccccccagactgatgttcgacaaggaggaggagggcctggccacctactggcagagcatcacctggagcagataccccagccccctggaggccaacatcaccctgagctggaacaagaccgtggagctgaccgacgacgtggtgatgaccttcgagtacggcagacccaccgtgatggtgctggagaagagcctggacaacggcagaacctggcagccctaccagttctacgccgaggactgcatggaggccttcggcatgagcgccagaagagccagagacatgagcagcagcagcgcccacagagtgctgtgcaccgaggagtacagcagatgggccggcagcaagaaggagaagcacgtgagattcgaggtgagagacagattcgccatcttcgccggccccgacctgagaaacatggacaacctgtacaccagactggagagcgccaagggcctgaaggagttcttcaccctgaccgacctgagaatgagactgctgagacccgccctgggcggcacctacgtgcagagagagaacctgtacaagtacttctacgccatcagcaacatcgaggtgatcggcagatgcaagtgcaacctgcacgccaacctgtgcagcatgagagagggcagcctgcagtgcgagtgcgagcacaacaccaccggccccgactgcggcaagtgcaagaagaacttcagaaccagaagctggagagccggcagctacctgcccctgccccacggcagccccaacgcctactgcgagtgctacggccacagcaacagatgcagctacatcgacttcctgaacgtggtgacctgcgtgagctgcaagcacaacaccagaggccagcactgccagcactgcagactgggctactacagaaacggcagcgccgagctggacgacgagaacgtgtgcatcgagtgcaactgcaaccagatcggcagcgtgcacgacagatgcaacgagaccggcttctgcgagtgcagagagggcgccgccggccccaagtgcgacgactgcctgcccacccactactggagacagggctgctaccccaacgtgtgcgacgacgaccagctgctgtgccagaacggcggcacctgcctgcagaaccagagatgcgcctgccccagaggctacaccggcgtgagatgcgagcagcccagatgcgaccccgccgacgacgacggcggcctggactgcgacagagcccccggcgccgcccccagacccgccaccctgctgggctgcctgctgctgctgggcctggccgccagactgggcagatag

SEQ ID NO: 20048 - DNA, 1593 bp, Artificial Sequence
  Description of Artificial Sequence: Synthetic coding sequence
atgctgcacctgctggccctgttcctgcactgcctgcccctggccagcggcgactacgacatctgcaagagctgggtgaccaccgacgagggccccacctgggagttctacgcctgccagcccaaggtgatgagactgaaggactacgtgaaggtgaaggtggagcccagcggcatcacctgcggcgacccccccgagagattctgcagccacgagaacccctacctgtgcagcaacgagtgcgacgccagcaaccccgacctggcccacccccccagactgatgttcgacaaggaggaggagggcctggccacctactggcagagcatcacctggagcagataccccagccccctggaggccaacatcaccctgagctggaacaagaccgtggagctgaccgacgacgtggtgatgaccttcgagtacggcagacccaccgtgatggtgctggagaagagcctggacaacggcagaacctggcagccctaccagttctacgccgaggactgcatggaggccttcggcatgagcgccagaagagccagagacatgagcagcagcagcgcccacagagtgctgtgcaccgaggagtacagcagatgggccggcagcaagaaggagaagcacgtgagattcgaggtgagagacagattcgccatcttcgccggccccgacctgagaaacatggacaacctgtacaccagactggagagcgccaagggcctgaaggagttcttcaccctgaccgacctgagaatgagactgctgagacccgccctgggcggcacctacgtgcagagagagaacctgtacaagtacttctacgccatcagcaacatcgaggtgatcggcagatgcaagtgcaacctgcacgccaacctgtgcagcatgagagagggcagcctgcagtgcgagtgcgagcacaacaccaccggccccgactgcggcaagtgcaagaagaacttcagaaccagaagctggagagccggcagctacctgcccctgccccacggcagccccaacgcctgcgccaccgccggcagcttcggcaactgcgagtgctacggccacagcaacagatgcagctacatcgacttcctgaacgtggtgacctgcgtgagctgcaagcacaacaccagaggccagcactgccagcactgcagactgggctactacagaaacggcagcgccgagctggacgacgagaacgtgtgcatcgagtgcaactgcaaccagatcggcagcgtgcacgacagatgcaacgagaccggcttctgcgagtgcagagagggcgccgccggccccaagtgcgacgactgcctgcccacccactactggagacagggctgctaccccaacgtgtgcgacgacgaccagctgctgtgccagaacggcggcacctgcctgcagaaccagagatgcgcctgccccagaggctacaccggcgtgagatgcgagcagcccagatgcgaccccgccgacgacgacggcggcctggactgcgacagagcccccggcgccgcccccagacccgccaccctgctgggctgcctgctgctgctgggcctggccgccagactgggcagatag

SEQ ID NO: 20049 - DNA, 858 bp, Artificial Sequence
  Description of Artificial Sequence: Synthetic coding sequence
atggccgccgccagcgagcccgtggacagcggcgccctgtggggcctggagagacccgagcccccccccaccagattccacagagtgcacggcgccaacatcagagtggaccccagcggcaccagagccaccagagtggagagcttcgcccacggcgtgtgcttcagcagagagcccctggcccccggccaggtgttcctggtggagatcgaggagaaggagctgggctggtgcggccacctgagactgggcctgaccgccctggaccccgccagcctggcccccgtgcccgagttcagcctgcccgacctggtgaacctgggccacacctgggtgttcgccatcaccagacaccacaacagagtgcccagagagggcagacccgaggccgaggccgccgcccccagcagaccccccaccctgctggtggagccctacctgagaatcgagcagttcagaatccccagagacagactggtgggcagaagcagacccggcctgtacagccacctgctggaccagctgtacgagctgaacgtgctgccccccaccgccagaagaagcagactgggcgtgctgttctgccccagacccgacggcaccgccgacatgcacatcatcatcaacggcgaggacatgggccccagcgccagaggcctgcccgccgcccagcccctgtacgccgtggtggacgtgttcgccagcaccaagagcgtgagactggtgcagctggagtacggcctgcccagcctgcagaccctgtgcagactggtgatccagagaagcatggtgcacagactggccatcgacggcctgcacctgcccaaggagctgaaggacttctgcaagtacgagtag

SEQ ID NO: 20050 - DNA, 441 bp, Artificial Sequence
  Description of Artificial Sequence: Synthetic coding sequence
atgagcagctgcagcaacgtgtgcggcagcagacaggcccaggccgccgccgagggcggctaccagagatacggcgtgagaagctacctgcaccagttctacgaggactgcaccgccagcatctgggagtacgaggacgacttccagatccagagaagccccaacagatggagcagcgtgttctggaagcaggagctgggcttccacaccagcagccacagccaggagtggaacagaaagctgcagcacaagaactgccccagatgctgcttcggcagcctgagcccccccggcgaggccctgctgtgcagacactgggactggccctaccaccccaaggcccccggctgcagcgccgagcccggcggcggccccttccagagcatccccaccctgctgtgcggccccaagagaggctgcttcgccagcagcgagctgtag

SEQ ID NO: 20051 - DNA, 534 bp, Artificial Sequence
  Description of Artificial Sequence: Synthetic coding sequence
atgagcagctgcagcaacgtgtgcggcagcagacaggcccaggccgccgccgagggcggctaccagagatacggcgtgagaagctacctgcaccagttctacgaggactgcaccgccagcatctgggagtacgaggacgacttccagatccagagaagccccaacagatggagcagcgtgttctggaaggtgggcctgatcagcggcaccgtgttcgtgatcctgggcctgaccgtgctggccgtgggcttcctggtgccccccaagatcgaggccttcggcgaggccgacttcgtggtggtggacacccacgccgtgcagttcaacagcgccctggacatgtacaagctggccggcgccgtgctgttctgcatcggcggcaccagcatggccggctgcctgctgatgagcgtgttcgtgaagagctacagcaaggaggagaagttcctgcagcagaagttcaaggagagaatcgccgacatcaaggcccacacccagcccgtgaccaaggcccccggcacccccctgagctag

SEQ ID NO: 20052 - DNA, 441 bp, Artificial Sequence; identical to SEQ ID NO: 20050
  Description of Artificial Sequence: Synthetic coding sequence

SEQ ID NO: 20053 - DNA, 588 bp, Artificial Sequence
  Description of Artificial Sequence: Synthetic coding sequence
atgagcagctgcagcaacgtgtgcggcagcagacaggcccaggccgccgccgagggcggctaccagagatacggcgtgagaagctacctgcaccagttctacgaggactgcaccgccagcatctgggagtacgaggacgacttccagatccagagaagccccaacagatggagcagcgtgttctggaaggtgggcctgatcagcggcaccgtgttcgtgatcctgggcctgaccgtgctggccgtgggcttcctggtgccccccaagatcgaggccttcggcgaggccgacttcgtggtggtggacacccacgccgtgcagttcaacagcgccctggacatgtacaagctggccggcgccgtgctgttctgcatcggcggcaccagcatggccggctgcctgctgatgagcgtgttcgtgaagagctacagcaaggaggagaagttcctgcagcagaagttcaaggagagaatcgccgacatcaaggcccacacccagcccgtgaccaaggcccccggccccggcgagaccaagatccccgtgaccctgagcagagtgcagaacgtgcagcccctgctggccacctag

SEQ ID NO: 20054 - DNA, 498 bp, Artificial Sequence
  Description of Artificial Sequence: Synthetic coding sequence
atgatgagatgctgcagaagaagatgctgctgcagacagcccccccacgccctgagacccctgctgctgctgcccctggtgctgctgccccccctggccgccgccgccgccggccccaacagatgcgacaccatctaccagggcttcgccgagtgcctgatcagactgggcgacagcatgggcagaggcggcgagctggagaccatctgcagaagctggaacgacttccacgcctgcgccagccaggtgctgagcggctgccccgaggaggccgccgccgtgtgggagagcctgcagcaggaggccagacaggcccccagacccaacaacctgcacaccctgtgcggcgcccccgtgcacgtgagagagagaggcaccggcagcgagaccaaccaggagaccctgagagccaccgcccccgccctgcccatggcccccgccccccccctgctggccgccgccctggccctggcctacctgctgagacccctggcctag

SEQ ID NO: 20055 - DNA, 2451 bp, Artificial Sequence
  Description of Artificial Sequence: Synthetic coding sequence
atgagcagaccccagggcctgctgtggctgcccctgctgttcacccccgtgtgcgtgatgctgaacagcaacgtgctgctgtggctgaccgccctggccatcaagttcaccctgatcgacagccaggcccagtaccccgtggtgaacaccaactacggcaagatcagaggcctgagaacccccctgcccaacgagatcctgggccccgtggagcagtacctgggcgtgccctacgccagcccccccaccggcgagagaagattccagccccccgagccccccagcagctggaccggcatcagaaacaccacccagttcgccgccgtgtgcccccagcacctggacgagagaagcctgctgcacgacatgctgcccatctggttcaccgccaacctggacaccctgatgacctacgtgcaggaccagaacgaggactgcctgtacctgaacatctacgtgcccaccgaggacgacatccacgaccagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgagaaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagaagacccagcccccagagaaacaccaccaacgacatcgcccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccctgatgacccccaacaccatcaccatgatccccaacaccctgaccggcatgcagcccctgcacaccttcaacaccttcagcggcggccagaacagcaccaacctgccccacggccacagcaccaccagagtgtag

SEQ ID NO: 20056 - DNA, 2451 bp, Artificial Sequence; identical to SEQ ID NO: 20055
  Description of Artificial Sequence: Synthetic coding sequence

SEQ ID NO: 20057 - DNA, 2511 bp, Artificial Sequence
  Description of Artificial Sequence: Synthetic coding sequence
atgagcagaccccagggcctgctgtggctgcccctgctgttcacccccgtgtgcgtgatgctgaacagcaacgtgctgctgtggctgaccgccctggccatcaagttcaccctgatcgacagccaggcccagtaccccgtggtgaacaccaactacggcaagatcagaggcctgagaacccccctgcccaacgagatcctgggccccgtggagcagtacctgggcgtgccctacgccagcccccccaccggcgagagaagattccagccccccgagccccccagcagctggaccggcatcagaaacaccacccagttcgccgccgtgtgcccccagcacctggacgagagaagcctgctgcacgacatgctgcccatctggttcaccgccaacctggacaccctgatgacctacgtgcaggaccagaacgaggactgcctgtacctgaacatctacgtgcccaccgaggacggcgccaacaccaagaagaacgccgacgacatcaccagcaacgacagaggcgaggacgaggacatccacgaccagaacagcaagaagcccgtgatggtgtacatccacggcggcagctacatggagggcaccggcaacatgatcgacggcagcatcctggccagctacggcaacgtgatcgtgatcaccatcaactacagactgggcatcctgggcttcctgagcaccggcgaccaggccgccaagggcaactacggcctgctggaccagatccaggccctgagatggatcgaggagaacgtgggcgccttcggcggcgaccccaagagagtgaccatcttcggcagcggcgccggcgccagctgcgtgagcctgctgaccctgagccactacagcgagggcctgttccagaaggccatcatccagagcggcaccgccctgagcagctgggccgtgaactaccagcccgccaagtacaccagaatcctggccgacaaggtgggctgcaacatgctggacaccaccgacatggtggagtgcctgagaaacaagaactacaaggagctgatccagcagaccatcacccccgccacctaccacatcgccttcggccccgtgatcgacggcgacgtgatccccgacgacccccagatcctgatggagcagggcgagttcctgaactacgacatcatgctgggcgtgaaccagggcgagggcctgaagttcgtggacggcatcgtggacaacgaggacggcgtgacccccaacgacttcgacttcagcgtgagcaacttcgtggacaacctgtacggctaccccgagggcaaggacaccctgagagagaccatcaagttcatgtacaccgactgggccgacaaggagaaccccgagaccagaagaaagaccctggtggccctgttcaccgaccaccagtgggtggcccccgccgtggccaccgccgacctgcacgcccagtacggcagccccacctacttctacgccttctaccaccactgccagagcgagatgaagcccagctgggccgacagcgcccacggcgacgaggtgccctacgtgttcggcatccccatgatcggccccaccgagctgttcagctgcaacttcagcaagaacgacgtgatgctgagcgccgtggtgatgacctactggaccaacttcgccaagaccggcgaccccaaccagcccgtgccccaggacaccaagttcatccacaccaagcccaacagattcgaggaggtggcctggagcaagtacaaccccaaggaccagctgtacctgcacatcggcctgaagcccagagtgagagaccactacagagccaccaaggtggccttctggctggagctggtgccccacctgcacaacctgaacgagatcttccagtacgtgagcaccaccaccaaggtgcccccccccgacatgaccagcttcccctacggcaccagaagaagccccgccaagatctggcccaccaccaagagacccgccatcacccccgccaacaaccccaagcacagcaaggacccccacaagaccggccccgaggacaccaccgtgctgatcgagaccaagagagactacagcaccgagctgagcgtgaccatcgccgtgggcgccagcctgctgttcctgaacatcctggccttcgccgccctgtactacaagaaggacaagagaagacacgagacccacagaagacccagcccccagagaaacaccaccaacgacatcgcccacatccagaacgaggagatcatgagcctgcagatgaagcagctggagcacgaccacgagtgcgagagcctgcaggcccacgacaccctgagactgacctgcccccccgactacaccctgaccctgagaagaagccccgacgacatccccctgatgacccccaacaccatcaccatgatccccaacaccctgaccggcatgcagcccctgcacaccttcaacaccttcagcggcggccagaacagcaccaacctgccccacggccacagcaccaccagagtgtag

SEQ ID NO: 20058 - DNA, 2451 bp, Artificial Sequence; identical to SEQ ID NO: 20055
  Description of Artificial Sequence: Synthetic coding sequence

SEQ ID NO: 20059 - DNA, 2451 bp, Artificial Sequence; identical to SEQ ID NO: 20055
  Description of Artificial Sequence: Synthetic coding sequence

SEQ ID NO: 20060 - DNA, 558 bp, Artificial Sequence
  Description of Artificial Sequence: Synthetic coding sequence
atggtgaagctgggcaacaacttcgccgagaagggcaccaagcagcccctgctggaggacggcttcgacaccatccccctgatgacccccctggacgtgaaccagctgcagttccccccccccgacaaggtggtggtgaagaccaagaccgagtacgagcccgacagaaagaagggcaaggccagacccccccagatcgccgagttcaccgtgagcatcaccgagggcgtgaccgagagattcaaggtgagcgtgctggtgctgttcgccctggccttcctgacctgcgtggtgttcctggtggtgtacaaggtgtacaagtacgacagagcctgccccgacggcttcgtgctgaagaacacccagtgcatccccgagggcctggagagctactacgccgagcaggacagcagcgccagagagaagttctacaccgtgatcaaccactacaacctggccaagcagagcatcaccagaagcgtgagcccctggatgagcgtgctgagcgaggagaagctgagcgagcaggagaccgaggccgccgagaagagcgcctag

SEQ ID NO: 20061 - DNA, 558 bp, Artificial Sequence; identical to SEQ ID NO: 20060
  Description of Artificial Sequence: Synthetic coding sequence

SEQ ID NO: 20062 - DNA, 558 bp, Artificial Sequence; identical to SEQ ID NO: 20060
  Description of Artificial Sequence: Synthetic coding sequence

SEQ ID NO: 20063 - DNA, 441 bp, Artificial Sequence
  Description of Artificial Sequence: Synthetic coding sequence
atggtgaagctgggcaacaacttcgccgagaagggcaccaagcagcccctgctggaggacggcttcgacaccatccccctgatgacccccctggacgtgaaccagctgcagttccccccccccgacaaggtgagcgtgctggtgctgttcgccctggccttcctgacctgcgtggtgttcctggtggtgtacaaggtgtacaagtacgacagagcctgccccgacggcttcgtgctgaagaacacccagtgcatccccgagggcctggagagctactacgccgagcaggacagcagcgccagagagaagttctacaccgtgatcaaccactacaacctggccaagcagagcatcaccagaagcgtgagcccctggatgagcgtgctgagcgaggagaagctgagcgagcaggagaccgaggccgccgagaagagcgcctag

SEQ ID NO: 20064 - DNA, 558 bp, Artificial Sequence; identical to SEQ ID NO: 20060
  Description of Artificial Sequence: Synthetic coding sequence

SEQ ID NO: 20065 - DNA, 558 bp, Artificial Sequence; identical to SEQ ID NO: 20060
  Description of Artificial Sequence: Synthetic coding sequence

SEQ ID NO: 20066 - DNA, 558 bp, Artificial Sequence; identical to SEQ ID NO: 20060
  Description of Artificial Sequence: Synthetic coding sequence

SEQ ID NO: 20067 - DNA, 558 bp, Artificial Sequence; identical to SEQ ID NO: 20060
  Description of Artificial Sequence: Synthetic coding sequence

SEQ ID NO: 20068 - DNA, 516 bp, Artificial Sequence
  Description of Artificial Sequence: Synthetic coding sequence
atggtgaagctgaacagcaaccccagcgagaagggcaccaagccccccagcgtggaggacggcttccagaccgtgcccctgatcacccccctggaggtgaaccacctgcagctgcccgcccccgagaaggtgatcgtgaagaccagaaccgagtaccagcccgagcagaagaacaagggcaagttcagagtgcccaagatcgccgagttcaccgtgaccatcctggtgagcctggccctggccttcctggcctgcatcgtgttcctggtggtgtacaaggccttcacctacgaccacagctgccccgagggcttcgtgtacaagcacaagagatgcatccccgccagcctggacgcctactacagcagccaggaccccaacagcagaagcagattctacaccgtgatcagccactacagcgtggccaagcagagcaccgccagagccatcggcccctggctgagcgccgccgccgtgatccacgagcccaagccccccaagacccagggccactag

SEQ ID NO: 20069 - DNA, 516 bp, Artificial Sequence; identical to SEQ ID NO: 20068
  Description of Artificial Sequence: Synthetic coding sequence

SEQ ID NO: 20070 - DNA, 441 bp, Artificial Sequence
  Description of Artificial Sequence: Synthetic coding sequence
atggtgaagctgaacagcaaccccagcgagaagggcaccaagccccccagcgtggaggacggcttccagaccgtgcccctgatcacccccctggaggtgaaccacctgcagctgcccgcccccgagaaggtgatcgtgaagaccagaaccgagtaccagcccgagcagaagaacaagggcaagttcagagtgcccaagatcgccgagttcaccgtgaccatcctggtgagcctggccctggccttcctggcctgcatcgtgttcctggtggtgtacaaggccttcacctacgaccacagctgccccgagggcttcgtgtacaagcacaagagatgcatccccgccagcctggacgcctactacagcagccaggaccccaacagcagaagcagattctacaccgtgatcagccactacagcgtggccaagcagagcacctag

SEQ ID NO: 20071 - DNA, 480 bp, Artificial Sequence
  Description of Artificial Sequence: Synthetic coding sequence
atggtgaagctgaacagcaaccccagcgagaagggcaccaagccccccagcgtggaggacggcttccagaccgtgcccctgatcacccccctggaggtgaaccacctgcagctgcccgcccccgagaaggtgatcgtgaagaccagaaccgagtaccagcccgagcagaagaacaagggcaagttcagagtgcccaagatcgccgagttcaccgtgaccatcctggtgagcctggccctggccttcctggcctgcatcgtgttcctggtggtgtacaaggccttcacctacgaccacagctgccccgagggcttcgtgtacaagcacaagagatgcatccccgccagcctggacgcctactacagcagccaggaccccaacagcagaagcagattctacaccgtgatcagccactacagcgtggccaagcagagcaccgccagagccatcggcccctggctgagcgccgccgccgtgtag

SEQ ID NO: 20072 - DNA, 1293 bp, Artificial Sequence
  Description of Artificial Sequence: Synthetic coding sequence
atggagggcgagcccagccagccccccaacagcagctggcccctgagccagaacggcaccaacaccgaggccacccccgccaccaacctgaccttcagcagctactaccagcacaccagccccgtggccgccatgttcatcgtggcctacgccctgatcttcctgctgtgcatggtgggcaacaccctggtgtgcttcatcgtgctgaagaacagacacatgcacaccgtgaccaacatgttcatcctgaacctggccgtgagcgacctgctggtgggcatcttctgcatgcccaccaccctggtggacaacctgatcaccggctggcccttcgacaacgccacctgcaagatgagcggcctggtgcagggcatgagcgtgagcgccagcgtgttcaccctggtggccatcgccgtggagagattcagatgcatcgtgcaccccttcagagagaagctgaccctgagaaaggccctggtgaccatcgccgtgatctgggccctggccctgctgatcatgtgccccagcgccgtgaccctgaccgtgaccagagaggagcaccacttcatggtggacgccagaaacagaagctaccccctgtacagctgctgggaggcctggcccgagaagggcatgagaagagtgtacaccaccgtgctgttcagccacatctacctggcccccctggccctgatcgtggtgatgtacgccagaatcgccagaaagctgtgccaggcccccggccccgcccccggcggcgaggaggccgccgaccccagagccagcagaagaagagccagagtggtgcacatgctggtgatggtggccctgttcttcaccctgagctggctgcccctgtgggccctgctgctgctgatcgactacggccagctgagcgccccccagctgcacctggtgaccgtgtacgccttccccttcgcccactggctggccttcttcaacagcagcgccaaccccatcatctacggctacttcaacgagaacttcagaagaggcttccaggccgccttcagagccagactgtgccccagacccagcggcagccacaaggaggcctacagcgagagacccggcggcctgctgcacagaagagtgttcgtggtggtgagacccagcgacagcggcctgcccagcgagagcggccccagcagcggcgcccccagacccggcagactgcccctgagaaacggcagagtggcccaccacggcctgcccagagagggccccggctgcagccacctgcccctgaccatccccgcctgggacatctag

SEQ ID NO: 20073 - DNA, 1287 bp, Artificial Sequence
  Description of Artificial Sequence: Synthetic coding sequence
ggcgagcccagccagccccccaacagcagctggcccctgagccagaacggcaccaacaccgaggccacccccgccaccaacctgaccttcagcagctactaccagcacaccagccccgtggccgccatgttcatcgtggcctacgccctgatcttcctgctgtgcatggtgggcaacaccctggtgtgcttcatcgtgctgaagaacagacacatgcacaccgtgaccaacatgttcatcctgaacctggccgtgagcgacctgctggtgggcatcttctgcatgcccaccaccctggtggacaacctgatcaccggctggcccttcgacaacgccacctgcaagatgagcggcctggtgcagggcatgagcgtgagcgccagcgtgttcaccctggtggccatcgccgtggagagattcagatgcatcgtgcaccccttcagagagaagctgaccctgagaaaggccctggtgaccatcgccgtgatctgggccctggccctgctgatcatgtgccccagcgccgtgaccctgaccgtgaccagagaggagcaccacttcatggtggacgccagaaacagaagctaccccctgtacagctgctgggaggcctggcccgagaagggcatgagaagagtgtacaccaccgtgctgttcagccacatctacctggcccccctggccctgatcgtggtgatgtacgccagaatcgccagaaagctgtgccaggcccccggccccgcccccggcggcgaggaggccgccgaccccagagccagcagaagaagagccagagtggtgcacatgctggtgatggtggccctgttcttcaccctgagctggctgcccctgtgggccctgctgctgctgatcgactacggccagctgagcgccccccagctgcacctggtgaccgtgtacgccttccccttcgcccactggctggccttcttcaacagcagcgccaaccccatcatctacggctacttcaacgagaacttcagaagaggcttccaggccgccttcagagccagactgtgccccagacccagcggcagccacaaggaggcctacagcgagagacccggcggcctgctgcacagaagagtgttcgtggtggtgagacccagcgacagcggcctgcccagcgagagcggccccagcagcggcgcccccagacccggcagactgcccctgagaaacggcagagtggcccaccacggcctgcccagagagggccccggctgcagccacctgcccctgaccatccccgcctgggacatctag

SEQ ID NO: 20074 - DNA, 1569 bp, Artificial Sequence
  Description of Artificial Sequence: Synthetic coding sequence
atgaacagcttcttcggcacccccgccgccagctggtgcctgctggagagcgacgtgagcagcgcccccgacaaggaggccggcagagagagaagagccctgagcgtgcagcagagaggcggccccgcctggagcggcagcctggagtggagcagacagagcgccggcgacagaagaagactgggcctgagcagacagaccgccaagagcagctggagcagaagcagagacagaacctgctgctgcagaagagcctggtggatcctggtgcccgccgccgacagagccagaagagagagattcatcatgaacgagaagtgggacaccaacagcagcgagaactggcaccccatctggaacgtgaacgacaccaagcaccacctgtacagcgacatcaacatcacctacgtgaactactacctgcaccagccccaggtggccgccatcttcatcatcagctacttcctgatcttcttcctgtgcatgatgggcaacaccgtggtgtgcttcatcgtgatgagaaacaagcacatgcacaccgtgaccaacctgttcatcctgaacctggccatcagcgacctgctggtgggcatcttctgcatgcccatcaccctgctggacaacatcatcgccggctggcccttcggcaacaccatgtgcaagatcagcggcctggtgcagggcatcagcgtggccgccagcgtgttcaccctggtggccatcgccgtggacagattccagtgcgtggtgtaccccttcaagcccaagctgaccatcaagaccgccttcgtgatcatcatgatcatctgggtgctggccatcaccatcatgagccccagcgccgtgatgctgcacgtgcaggaggagaagtactacagagtgagactgaacagccagaacaagaccagccccgtgtactggtgcagagaggactggcccaaccaggagatgagaaagatctacaccaccgtgctgttcgccaacatctacctggcccccctgagcctgatcgtgatcatgtacggcagaatcggcatcagcctgttcagagccgccgtgccccacaccggcagaaagaaccaggagcagtggcacgtggtgagcagaaagaagcagaagatcatcaagatgctgctgatcgtggccctgctgttcatcctgagctggctgcccctgtggaccctgatgatgctgagcgactacgccgacctgagccccaacgagctgcagatcatcaacatctacatctaccccttcgcccactggctggccttcggcaacagcagcgtgaaccccatcatctacggcttcttcaacgagaacttcagaagaggcttccaggaggccttccagctgcagctgtgccagaagagagccaagcccatggaggcctacgccctgaaggccaagagccacgtgctgatcaacaccagcaaccagctggtgcaggagagcaccttccagaacccccacggcgagaccctgctgtacagaaagagcgccgagaagccccagcaggagctggtgatggaggagctgaaggagaccaccaacagcagcgagatctag

SEQ ID NO: 20075 - DNA, 399 bp, Artificial Sequence
  Description of Artificial Sequence: Synthetic coding sequence
atgaacagcttcttcggcacccccgccgccagctggtgcctgctggagagcgacgtgagcagcgcccccgacaaggaggccggcagagagagaagagccctgagcgtgcagcagagaggcggccccgcctggagcggcagcctggagtggagcagacagagcgccggcgacagaagaagactgggcctgagcagacagaccgccaagagcagctggagcagaagcagagacagaacctgctgctgcagaagagcctggtggatcctggtgcccgccgccgacagagccagaagagagagaatggccatctggaagcacgacgtgcaggaccagtggatcggccccggcaacatctgcagaagcttcagcctgtacgtgagctgcaactgctgcagatag

SEQ ID NO: 20076 - DNA, 1263 bp, Artificial Sequence
  Description of Artificial Sequence: Synthetic coding sequence
atgaacgagaagtgggacaccaacagcagcgagaactggcaccccatctggaacgtgaacgacaccaagcaccacctgtacagcgacatcaacatcacctacgtgaactactacctgcaccagccccaggtggccgccatcttcatcatcagctacttcctgatcttcttcctgtgcatgatgggcaacaccgtggtgtgcttcatcgtgatgagaaacaagcacatgcacaccgtgaccaacctgttcatcctgaacctggccatcagcgacctgctggtgggcatcttctgcatgcccatcaccctgctggacaacatcatcgccggctggcccttcggcaacaccatgtgcaagatcagcggcctggtgcagggcatcagcgtggccgccagcgtgttcaccctggtggccatcgccgtggacagattccagtgcgtggtgtaccccttcaagcccaagctgaccatcaagaccgccttcgtgatcatcatgatcatctgggtgctggccatcaccatcatgagccccagcgccgtgatgctgcacgtgcaggaggagaagtactacagagtgagactgaacagccagaacaagaccagccccgtgtactggtgcagagaggactggcccaaccaggagatgagaaagatctacaccaccgtgctgttcgccaacatctacctggcccccctgagcctgatcgtgatcatgtacggcagaatcggcatcagcctgttcagagccgccgtgccccacaccggcagaaagaaccaggagcagtggcacgtggtgagcagaaagaagcagaagatcatcaagatgctgctgatcgtggccctgctgttcatcctgagctggctgcccctgtggaccctgatgatgctgagcgactacgccgacctgagccccaacgagctgcagatcatcaacatctacatctaccccttcgcccactggctggccttcggcaacagcagcgtgaaccccatcatctacggcttcttcaacgagaacttcagaagaggcttccaggaggccttccagctgcagctgtgccagaagagagccaagcccatggaggcctacgccctgaaggccaagagccacgtgctgatcaacaccagcaaccagctggtgcaggagagcaccttccagaacccccacggcgagaccctgctgtacagaaagagcgccgagaagccccagcaggagctggtgatggaggagctgaaggagaccaccaacagcagcgagatctag

SEQ ID NO: 20077 - DNA, 1272 bp, Artificial Sequence
  Description of Artificial Sequence: Synthetic coding sequence
atgttcatcatgaacgagaagtgggacaccaacagcagcgagaactggcaccccatctggaacgtgaacgacaccaagcaccacctgtacagcgacatcaacatcacctacgtgaactactacctgcaccagccccaggtggccgccatcttcatcatcagctacttcctgatcttcttcctgtgcatgatgggcaacaccgtggtgtgcttcatcgtgatgagaaacaagcacatgcacaccgtgaccaacctgttcatcctgaacctggccatcagcgacctgctggtgggcatcttctgcatgcccatcaccctgctggacaacatcatcgccggctggcccttcggcaacaccatgtgcaagatcagcggcctggtgcagggcatcagcgtggccgccagcgtgttcaccctggtggccatcgccgtggacagattccagtgcgtggtgtaccccttcaagcccaagctgaccatcaagaccgccttcgtgatcatcatgatcatctgggtgctggccatcaccatcatgagccccagcgccgtgatgctgcacgtgcaggaggagaagtactacagagtgagactgaacagccagaacaagaccagccccgtgtactggtgcagagaggactggcccaaccaggagatgagaaagatctacaccaccgtgctgttcgccaacatctacctggcccccctgagcctgatcgtgatcatgtacggcagaatcggcatcagcctgttcagagccgccgtgccccacaccggcagaaagaaccaggagcagtggcacgtggtgagcagaaagaagcagaagatcatcaagatgctgctgatcgtggccctgctgttcatcctgagctggctgcccctgtggaccctgatgatgctgagcgactacgccgacctgagccccaacgagctgcagatcatcaacatctacatctaccccttcgcccactggctggccttcggcaacagcagcgtgaaccccatcatctacggcttcttcaacgagaacttcagaagaggcttccaggaggccttccagctgcagctgtgccagaagagagccaagcccatggaggcctacgccctgaaggccaagagccacgtgctgatcaacaccagcaaccagctggtgcaggagagcaccttccagaacccccacggcgagaccctgctgtacagaaagagcgccgagaagccccagcaggagctggtgatggaggagctgaaggagaccaccaacagcagcgagatctag

SEQ ID NO: 20078 - DNA, 1002 bp, Artificial Sequence
  Description of Artificial Sequence: Synthetic coding sequence
atgcaggccgccggccaccccgagcccctggacagcagaggcagcttcagcctgcccaccatgggcgccaacgtgagccaggacaacggcaccggccacaacgccaccttcagcgagcccctgcccttcctgtacgtgctgctgcccgccgtgtacagcggcatctgcgccgtgggcctgaccggcaacaccgccgtgatcctggtgatcctgagagcccccaagatgaagaccgtgaccaacgtgttcatcctgaacctggccgtggccgacggcctgttcaccctggtgctgcccgtgaacatcgccgagcacctgctgcagtactggcccttcggcgagctgctgtgcaagctggtgctggccgtggaccactacaacatcttcagcagcatctacttcctggccgtgatgagcgtggacagatacctggtggtgctggccaccgtgagaagcagacacatgccctggagaacctacagaggcgccaaggtggccagcctgtgcgtgtggctgggcgtgaccgtgctggtgctgcccttcttcagcttcgccggcgtgtacagcaacgagctgcaggtgcccagctgcggcctgagcttcccctggcccgagcaggtgtggttcaaggccagcagagtgtacaccctggtgctgggcttcgtgctgcccgtgtgcaccatctgcgtgctgtacaccgacctgctgagaagactgagagccgtgagactgagaagcggcgccaaggccctgggcaaggccagaagaaaggtgaccgtgctggtgctggtggtgctggccgtgtgcctgctgtgctggacccccttccacctggccagcgtggtggccctgaccaccgacctgccccagacccccctggtgatcagcatgagctacgtgatcaccagcctgagctacgccaacagctgcctgaaccccttcctgtacgccttcctggacgacaacttcagaaagaacttcagaagcatcctgagatgctag

SEQ ID NO: 20079 - DNA, 1578 bp, Artificial Sequence
  Description of Artificial Sequence: Synthetic coding sequence
atggccctggagagactgtgcagcgtgctgaaggtgctgctgatcaccgtgctggtggtggagggcatcgccgtggcccagaagacccaggacggccagaacatcggcatcaagcacatccccgccacccagtgcggcatctgggtgagaaccagcaacggcggccacttcgccagccccaactaccccgacagctacccccccaacaaggagtgcatctacatcctggaggccgcccccagacagagaatcgagctgaccttcgacgagcactactacatcgagcccagcttcgagtgcagattcgaccacctggaggtgagagacggccccttcggcttcagccccctgatcgacagatactgcggcgtgaagagcccccccctgatcagaagcaccggcagattcatgtggatcaagttcagcagcgacgaggagctggagggcctgggcttcagagccaagtacagcttcatccccgaccccgacttcacctacctgggcggcatcctgaaccccatccccgactgccagttcgagctgagcggcgccgacggcatcgtgagaagcagccaggtggagcaggaggagaagaccaagcccggccaggccgtggactgcatctggaccatcaaggccacccccaaggccaagatctacctgagattcctggactaccagatggagcacagcaacgagtgcaagagaaacttcgtggccgtgtacgacggcagcagcagcatcgagaacctgaaggccaagttctgcagcaccgtggccaacgacgtgatgctgaagaccggcatcggcgtgatcagaatgtgggccgacgagggcagcagactgagcagattcagaatgctgttcaccagcttcgtggagcccccctgcaccagcagcaccttcttctgccacagcaacatgtgcatcaacaacagcctggtgtgcaacggcgtgcagaactgcgcctacccctgggacgagaaccactgcaaggagaagaagaaggccggcgtgttcgagcagatcaccaagacccacggcaccatcatcggcatcaccagcggcatcgtgctggtgctgctgatcatcagcatcctggtgcaggtgaagcagcccagaaagaaggtgatggcctgcaagaccgccttcaacaagaccggcttccaggaggtgttcgaccccccccactacgagctgttcagcctgagagacaaggagatcagcgccgacctggccgacctgagcgaggagctggacaactaccagaagatgagaagaagcagcaccgccagcagatgcatccacgaccaccactgcggcagccaggccagcagcgtgaagcagagcagaaccaacctgagcagcatggagctgcccttcagaaacgacttcgcccagccccagcccatgaagaccttcaacagcaccttcaagaagagcagctacaccttcaagcagggccacgagtgccccgagcaggccctggaggacagagtgatggaggagatcccctgcgagatctacgtgagaggcagagaggacagcgcccaggccagcatcagcatcgacttctag

SEQ ID NO: 20080 - DNA, 1578 bp, Artificial Sequence; identical to SEQ ID NO: 20079
  Description of Artificial Sequence: Synthetic coding sequence

SEQ ID NO: 20081 - DNA, 1233 bp, Artificial Sequence
  Description of Artificial Sequence: Synthetic coding sequence
atggagaccagcagccccagaccccccagacccagcagcaaccccggcctgagcctggacgccagactgggcgtggacaccagactgtgggccaaggtgctgttcaccgccctgtacgccctgatctgggccctgggcgccgccggcaacgccctgagcgcccacgtggtgctgaaggccagagccggcagagccggcagactgagacaccacgtgctgagcctggccctggccggcctgctgctgctgctggtgggcgtgcccgtggagctgtacagcttcgtgtggttccactacccctgggtgttcggcgacctgggctgcagaggctactacttcgtgcacgagctgtgcgcctacgccaccgtgctgagcgtggccggcctgagcgccgagagatgcctggccgtgtgccagcccctgagagccagaagcctgctgacccccagaagaaccagatggctggtggccctgagctgggccgccagcctgggcctggccctgcccatggccgtgatcatgggccagaagcacgagctggagaccgccgacggcgagcccgagcccgccagcagagtgtgcaccgtgctggtgagcagaaccgccctgcaggtgttcatccaggtgaacgtgctggtgagcttcgtgctgcccctggccctgaccgccttcctgaacggcgtgaccgtgagccacctgctggccctgtgcagccaggtgcccagcaccagcacccccggcagcagcacccccagcagactggagctgctgagcgaggagggcctgctgagcttcatcgtgtggaagaagaccttcatccagggcggccaggtgagcctggtgagacacaaggacgtgagaagaatcagaagcctgcagagaagcgtgcaggtgctgagagccatcgtggtgatgtacgtgatctgctggctgccctaccacgccagaagactgatgtactgctacgtgcccgacgacgcctggaccgaccccctgtacaacttctaccactacttctacatggtgaccaacaccctgttctacgtgagcagcgccgtgacccccctgctgtacaacgccgtgagcagcagcttcagaaagctgttcctggaggccgtgagcagcctgtgcggcgagcaccaccccatgaagagactgccccccaagccccagagccccaccctgatggacaccgccagcggcttcggcgacccccccgagaccagaacctag

SEQ ID NO: 20082 - DNA, 1692 bp, Artificial Sequence
  Description of Artificial Sequence: Synthetic coding sequence
atgctggaggaggccggcgaggtgctggagaacatgctgaaggccagctgcctgcccctgggcttcatcgtgttcctgcccgccgtgctgctgctggtggccccccccctgcccgccgccgacgccgcccacgagttcaccgtgtacagaatgcagcagtacgacctgcagggccagccctacggcaccagaaacgccgtgctgaacaccgaggccagaaccatggccgccgaggtgctgagcagaagatgcgtgctgatgagactgctggacttcagctacgagcagtaccagaaggccctgagacagagcgccggcgccgtggtgatcatcctgcccagagccatggccgccgtgccccaggacgtggtgagacagttcatggagatcgagcccgagatgctggccatggagaccgccgtgcccgtgtacttcgccgtggaggacgaggccctgctgagcatctacaagcagacccaggccgccagcgccagccagggcagcgccagcgccgccgaggtgctgctgagaaccgccaccgccaacggcttccagatggtgaccagcggcgtgcagagcaaggccgtgagcgactggctgatcgccagcgtggagggcagactgaccggcctgggcggcgaggacctgcccaccatcgtgatcgtggcccactacgacgccttcggcgtggccccctggctgagcctgggcgccgacagcaacggcagcggcgtgagcgtgctgctggagctggccagactgttcagcagactgtacacctacaagagaacccacgccgcctacaacctgctgttcttcgccagcggcggcggcaagttcaactaccagggcaccaagagatggctggaggacaacctggaccacaccgacagcagcctgctgcaggacaacgtggccttcgtgctgtgcctggacaccgtgggcagaggcagcagcctgcacctgcacgtgagcaagccccccagagagggcaccctgcagcacgccttcctgagagagctggagaccgtggccgcccaccagttccccgaggtgagattcagcatggtgcacaagagaatcaacctggccgaggacgtgctggcctgggagcacgagagattcgccatcagaagactgcccgccttcaccctgagccacctggagagccacagagacggccagagaagcagcatcatggacgtgagaagcagagtggacagcaagaccctgaccagaaacaccagaatcatcgccgaggccctgaccagagtgatctacaacctgaccgagaagggcaccccccccgacatgcccgtgttcaccgagcagatgcagatccagcaggagcagctggacagcgtgatggactggctgaccaaccagcccagagccgcccagctggtggacaaggacagcaccttcctgagcaccctggagcaccacctgagcagatacctgaaggacgtgaagcagcaccacgtgaaggccgacaagagagaccccgagttcgtgttctacgaccagctgaagcaggtgatgaacgcctacagagtgaagcccgccgtgttcgacctgctgctggccgtgggcatcgccgcctacctgggcatggcctacgtggccgtgcagcacttcagcctgctgtacaagaccgtgcagagactgctggtgaaggccaagacccagtag

SEQ ID NO: 20083 - DNA, 1233 bp, Artificial Sequence
  Description of Artificial Sequence: Synthetic coding sequence
atgggcgcccaggtgagactgccccccggcgagccctgcagagagggctacgtgctgagcctggtgtgccccaacagcagccaggcctggtgcgagatcaccaacgtgagccagctgctggccagccccgtgctgtacaccgacctgaactacagcatcaacaacctgagcatcagcgccaacgtggagaacaagtacagcctgtacgtgggcctggtgctggccgtgagcagcagcatcttcatcggcagcagcttcatcctgaagaagaagggcctgctgcagctggccagcaagggcttcaccagagccggccagggcggccacagctacctgaaggagtggctgtggtgggtgggcctgctgagcatgggcgccggcgaggccgccaacttcgccgcctacgccttcgcccccgccaccctggtgacccccctgggcgccctgagcgtgctgatcagcgccatcctgagcagctacttcctgaacgagcacctgaacatccacggcaagatcggctgcatcctgagcatcctgggcagcaccgtgatggtgatccacgccccccaggaggaggaggtgaccagcctgcacgagatggagatgaagctgagagaccccggcttcatcagcttcgccgtgatcatcaccgtgatcagcctggtgctgatcctgatcgtggcccccaagaagggccagaccaacatcctggtgtacatcagcatctgcagcctgatcggcgccttcagcgtgagcagcgtgaagggcctgggcatcgccatcaaggagctgatcgagtggaagcccgtgtacaagcaccccctggtgttcgtgctgctggccgtgctggtgctgagcgtgaccacccagatcaactacctgaacaaggccctggacaccttcaacaccagcctggtgacccccatctactacgtgttcttcaccagcatggtggtgacctgcagcgccatcctgttccaggagtggtacggcatgaccgccggcgacatcatcggcaccctgagcggcttcttcaccatcatcatcggcatcttcctgctgcacgccttcaagaacaccgacatcacctggagcgagctgaccagcaccgccaagaaggaggccgtgagcctgaacgtgaacgagaacaactacgtgctgctggagaacctggagtgcagcgcccccggctacaacgacgacgtgaccctgttcagcagaaccgacgactag

SEQ ID NO: 20084 - DNA, 1107 bp, Artificial Sequence
  Description of Artificial Sequence: Synthetic coding sequence
atggccgccgtggcccccgccggccccggcgacagcgccagcgccgccctggacgagctgagcctgaacttcacctacggcgcccccggcgccggcaacggcagcctgagcggcgactggtacagaagaaaccagatccacctgttcggcgtgctgctggccatcctgggcaacctggtgatcagcatcagcctgaacatccagaagtacagccacctgcagctggcccagcaggagcaccccagaccctacttcaagagcgtgctgtggtggggcggcgtgctgctgatggccgtgggcgagaccggcaacttcgccgcctacggcttcgcccccatcaccctgatcgcccccctgggctgcgtgagcgtgaccggcagcgccatcatcagcgtgaccttcctgaaggacaacctgagagccagcgacctgctgggcaccaccctggccttcgccggcacctacctgctggtgaacttcgcccccaacatcacccaggccatcagcgccagaaccgtgcagtactacctggtgggctggcagttcctgatctacgtgatcctggagatcctgatcttctgcatcctgctgtacttctacaagagaaagggcatgaagcacatggtgatcctgctgaccctggtggccatcctggccagcctgaccgtgatcagcgtgaaggccgtgagcggcatgatcaccttcagcgtgatggacaagatgcagctgacctaccccatcttctacatcatgttcatcatcatgatcgccagctgcgtgttccaggtgaagttcctgaaccaggccaccaagctgtacaacaccaccaccgtggtgcccgtgaaccacatcttcttcaccatcagcgccatcatcgccggcatcatcttctaccaggagttcctgggcgcccccttcctgaccgtgttcatctacctgttcggctgcttcctgagcttcctgggcgtgttcctggtgaccagaaacagagagaaggagcacctgcagcagagctacatcgacttcggcaacatccccgacaccacccccgagagaaaggcctggagagagaccaacgtgggccagaacaccaccagattcacctag

SEQ ID NO: 20085 - DNA, 975 bp, Artificial Sequence
  Description of Artificial Sequence: Synthetic coding sequence
atgctgctgggcgagctgggcgtgttcgccagctacgccttcgcccccctgagcctgatcgtgcccctgagcgccgtgagcgtgatcgccagcgccatcatcggcatcatcttcatcaaggagaagtggaagcccaaggacttcctgagaagatacgtgctgagcttcgtgggctgcggcctggccgtggtgggcacctacctgctggtgaccttcgcccccaacagccacgagaagatgaccggcgagaacgtgaccagacacctggtgagctggcccttcctgctgtacatgctggtggagatcatcctgttctgcctgctgctgtacttctacaaggagaagaacgccaacaacatcgtggtgatcctgctgctggtggccctgctgggcagcatgaccgtggtgaccgtgaaggccgtggccggcatgctggtgctgagcatccagggcaacctgcagctggactaccccatcttctacgtgatgttcgtgtgcatggtggccaccgccgtgtaccaggccgccttcctgagccaggccagccagatgtacgacagcagcctgatcgccagcgtgggctacatcctgagcaccaccatcgccatcaccgccggcgccatcttctacctggacttcatcggcgaggacgtgctgcacatctgcatgttcgccctgggctgcctgatcgccttcctgggcgtgttcctgatcaccagaaacagaaagaagcccatccccttcgagccctacatcagcatggacgccatgcccggcatgcagaacatgcacgacaagggcatgaccgtgcagcccgagctgaaggccagcttcagctacggcgccctggagaacaacgacaacatcagcgagatctacgcccccgccaccctgcccgtgatgcaggaggagcacggcagcagaagcgccagcggcgtgccctacagagtgctggagcacaccaagaaggagtag

SEQ ID NO: 20086 - DNA, 1107 bp, Artificial Sequence
  Description of Artificial Sequence: Synthetic coding sequence
atggacggcagccacagcgccgccctgaagctgcagcagctgccccccaccagcagcagcagcgccgtgagcgaggccagcttcagctacaaggagaacctgatcggcgccctgctggccatcttcggccacctggtggtgagcatcgccctgaacctgcagaagtactgccacatcagactggccggcagcaaggaccccagagcctacttcaagaccaagacctggtggctgggcctgttcctgatgctgctgggcgagctgggcgtgttcgccagctacgccttcgcccccctgagcctgatcgtgcccctgagcgccgtgagcgtgatcgccagcgccatcatcggcatcatcttcatcaaggagaagtggaagcccaaggacttcctgagaagatacgtgctgagcttcgtgggctgcggcctggccgtggtgggcacctacctgctggtgaccttcgcccccaacagccacgagaagatgaccggcgagaacgtgaccagacacctggtgagctggcccttcctgctgtacatgctggtggagatcatcctgttctgcctgctgctgtacttctacaaggagaagaacgccaacaacatcgtggtgatcctgctgctggtggccctgctgggcagcatgaccgtggtgaccgtgaaggccgtggccggcatgctggtgctgagcatccagggcaacctgcagctggactaccccatcttctacgtgatgttcgtgtgcatggtggccaccgccgtgtaccaggccgccttcctgagccaggccagccagatgtacgacagcagcctgatcgccagcgtgggctacatcctgagcaccaccatcgccatcaccgccggcgccatcttctacctggacttcatcggcgaggacgtgctgcacatctgcatgttcgccctgggctgcctgatcgccttcctgggcgtgttcctgatcaccagaaacagaaagaagcccatccccttcgagccctacatcagcatggacgccatgcccgacagctacctgcacaacagacagctgctgttcaagagatacagcaacagcagaaacctgccccaccacaacctggagagcctgtag

SEQ ID NO: 20087 - DNA, 681 bp, Artificial Sequence
  Description of Artificial Sequence: Synthetic coding sequence
atggacggcagccacagcgccgccctgaagctgcagcagctgccccccaccagcagcagcagcgccgtgagcgaggccagcttcagctacaaggagaacctgatcggcgccctgctggccatcttcggccacctggtggtgagcatcgccctgaacctgcagaagtactgccacatcagactggccggcagcaaggaccccagagcctacttcaagaccaagacctggtggctgggcctgttcctgatgctgctgggcgagctgggcgtgttcgccagctacgccttcgcccccctgagcctgatcgtgcccctgagcgccgtgagcgtgatcgccagcgccatcatcggcatcatcttcatcaaggagaagtggaagcccaaggacttcctgagaagatacgtgctgagcttcgtgggctgcggcctggccgtggtgggcacctacctgctggtgaccttcgcccccaacagccacgagaagatgaccggcgagaacgtgaccagacacctggtgagctggcccttcctgctgtacatgctggtggagatcatcctgttctgcctgctgctgtacttctacaaggagaagaacgccaacaacatcgtggtgatcctgctgctggtggccctgctggtgctgctgtgccaccccggctggagcgccgtggtgcagagctag

SEQ ID NO: 20088 - DNA, 1221 bp, Artificial Sequence
  Description of Artificial Sequence: Synthetic coding sequence
atggacggcagccacagcgccgccctgaagctgcagcagctgccccccaccagcagcagcagcgccgtgagcgaggccagcttcagctacaaggagaacctgatcggcgccctgctggccatcttcggccacctggtggtgagcatcgccctgaacctgcagaagtactgccacatcagactggccggcagcaaggaccccagagcctacttcaagaccaagacctggtggctgggcctgttcctgatgctgctgggcgagctgggcgtgttcgccagctacgccttcgcccccctgagcctgatcgtgcccctgagcgccgtgagcgtgatcgccagcgccatcatcggcatcatcttcatcaaggagaagtggaagcccaaggacttcctgagaagatacgtgctgagcttcgtgggctgcggcctggccgtggtgggcacctacctgctggtgaccttcgcccccaacagccacgagaagatgaccggcgagaacgtgaccagacacctggtgagctggcccttcctgctgtacatgctggtggagatcatcctgttctgcctgctgctgtacttctacaaggagaagaacgccaacaacatcgtggtgatcctgctgctggtggccctgctgggcagcatgaccgtggtgaccgtgaaggccgtggccggcatgctggtgctgagcatccagggcaacctgcagctggactaccccatcttctacgtgatgttcgtgtgcatggtggccaccgccgtgtaccaggccgccttcctgagccaggccagccagatgtacgacagcagcctgatcgccagcgtgggctacatcctgagcaccaccatcgccatcaccgccggcgccatcttctacctggacttcatcggcgaggacgtgctgcacatctgcatgttcgccctgggctgcctgatcgccttcctgggcgtgttcctgatcaccagaaacagaaagaagcccatccccttcgagccctacatcagcatggacgccatgcccggcatgcagaacatgcacgacaagggcatgaccgtgcagcccgagctgaaggccagcttcagctacggcgccctggagaacaacgacaacatcagcgagatctacgcccccgccaccctgcccgtgatgcaggaggagcacggcagcagaagcgccagcggcgtgccctacagagtgctggagcacaccaagaaggagtag

SEQ ID NO: 20089 - DNA, 681 bp, Artificial Sequence; identical to SEQ ID NO: 20087
  Description of Artificial Sequence: Synthetic coding sequence

SEQ ID NO: 20090 - DNA, 405 bp, Artificial Sequence
  Description of Artificial Sequence: Synthetic coding sequence
tgagtggccggcatgctggtgctgagcatccagggcaacctgcagctggactaccccatcttctacgtgatgttcgtgtgcatggtggccaccgccgtgtaccaggccgccttcagcaagaccgacagcagccccgccaacgagaacaacagcccctacctgagagagagccacgaggccctgatgagaatgagcctgggcaagtgccccgtgttcgagagcagcctgaccgacgtgagactgctgttcgactgccagtgcggcctgcacagcgtgcacaaccactgctaccacagcagatgcaacatcctgcccggcctgcacagaggcggcagagccgcccacctgcacgtgtgcaccggcgtgccccactgcatcctgggcagactgctgaaccacgcctag

SEQ ID NO: 20091 - DNA, 4515 bp, Artificial Sequence
  Description of Artificial Sequence: Synthetic coding sequence
atggccaccgccagaaccttcggccccgagagagaggccgagcccgccaaggaggccagagtggtgggcagcgagctggtggacacctacaccgtgtacatcatccaggtgaccgacggcagccacgagtggaccgtgaagcacagatacagcgacttccacgacctgcacgagaagctggtggccgagagaaagatcgacaagaacctgctgccccccaagaagatcatcggcaagaacagcagaagcctggtggagaagagagagaaggacctggaggtgtacctgcagaagctgctggccgccttccccggcgtgacccccagagtgctggcccacttcctgcacttccacttctacgagatcaacggcatcaccgccgccctggccgaggagctgttcgagaagggcgagcagctgctgggcgccggcgaggtgttcgccatcggccccctgcagctgtacgccgtgaccgagcagctgcagcagggcaagcccacctgcgccagcggcgacgccaagaccgacctgggccacatcctggacttcacctgcagactgaagtacctgaaggtgagcggcaccgagggccccttcggcaccagcaacatccaggagcagctgctgcccttcgacctgagcatcttcaagagcctgcaccaggtggagatcagccactgcgacgccaagcacatcagaggcctggtggccagcaagcccaccctggccaccctgagcgtgagattcagcgccaccagcatgaaggaggtgctggtgcccgaggccagcgagttcgacgagtgggagcccgagggcaccaccctggagggccccgtgaccgccgtgatccccacctggcaggccctgaccaccctggacctgagccacaacagcgtgagcgagatcgacgagagcgtgaagctgatccccaagatcgagttcctggacctgagccacaacggcctgctggtggtggacaacctgcagcacctgtacaacctggtgcacctggacctgagctacaacaagctgagcagcctggagggcctgcacaccaagctgggcaacatcaagaccctgaacctggccggcaacctgctggagagcctgagcggcctgcacaagctgtacagcctggtgaacctggacctgagagacaacagaatcgagcagatggaggaggtgagaagcatcggcagcctgccctgcctggagcacgtgagcctgctgaacaaccccctgagcatcatccccgactacagaaccaaggtgctggcccagttcggcgagagagccagcgaggtgtgcctggacgacaccgtgaccaccgagaaggagctggacaccgtggaggtgctgaaggccatccagaaggccaaggaggtgaagagcaagctgagcaaccccgagaagaagggcggcgaggacagcagactgagcgccgccccctgcatcagacccagcagcagcccccccaccgtggcccccgccagcgccagcctgccccagcccatcctgagcaaccagggcatcatgttcgtgcaggaggaggccctggccagcagcctgagcagcaccgacagcctgacccccgagcaccagcccatcgcccagggctgcagcgacagcctggagagcatccccgccggccaggccgccagcgacgacctgagagacgtgcccggcgccgtgggcggcgccagccccgagcacgccgagcccgaggtgcaggtggtgcccggcagcggccagatcatcttcctgcccttcacctgcatcggctacaccgccaccaaccaggacttcatccagagactgagcaccctgatcagacaggccatcgagagacagctgcccgcctggatcgaggccgccaaccagagagaggagggccagggcgagcagggcgaggaggaggacgaggaggaggaggaggaggaggacgtggccgagaacagatacttcgagatgggcccccccgacgtggaggaggaggagggcggcggccagggcgaggaggaggaggaggaggaggaggacgaggaggccgaggaggagagactggccctggagtgggccctgggcgccgacgaggacttcctgctggagcacatcagaatcctgaaggtgctgtggtgcttcctgatccacgtgcagggcagcatcagacagttcgccgcctgcctggtgctgaccgacttcggcatcgccgtgttcgagatcccccaccaggagagcagaggcagcagccagcacatcctgagcagcctgagattcgtgttctgcttcccccacggcgacctgaccgagttcggcttcctgatgcccgagctgtgcctggtgctgaaggtgagacacagcgagaacaccctgttcatcatcagcgacgccgccaacctgcacgagttccacgccgacctgagaagctgcttcgccccccagcacatggccatgctgtgcagccccatcctgtacggcagccacaccagcctgcaggagttcctgagacagctgctgaccttctacaaggtggccggcggctgccaggagagaagccagggctgcttccccgtgtacctggtgtacagcgacaagagaatggtgcagaccgccgccggcgactacagcggcaacatcgagtgggccagctgcaccctgtgcagcgccgtgagaagaagctgctgcgcccccagcgaggccgtgaagagcgccgccatcccctactggctgctgctgaccccccagcacctgaacgtgatcaaggccgacttcaaccccatgcccaacagaggcacccacaactgcagaaacagaaacagcttcaagctgagcagagtgcccctgagcaccgtgctgctggaccccaccagaagctgcacccagcccagaggcgccttcgccgacggccacgtgctggagctgctggtgggctacagattcgtgaccgccatcttcgtgctgccccacgagaagttccacttcctgagagtgtacaaccagctgagagccagcctgcaggacctgaagaccgtggtgatcgccaagacccccggcaccggcggcagcccccagggcagcttcgccgacggccagcccgccgagagaagagccagcaacgaccagagaccccaggaggtgcccgccgaggccctggcccccgcccccgccgaggtgcccgcccccgcccccgccgccgccagcgccagcggccccgccaagacccccgcccccgccgaggccagcaccagcgccctggtgcccgaggagacccccgtggaggcccccgcccccccccccgccgaggcccccgcccagtaccccagcgagcacctgatccaggccaccagcgaggagaaccagatccccagccacctgcccgcctgccccagcctgagacacgtggccagcctgagaggcagcgccatcatcgagctgttccacagcagcatcgccgaggtggagaacgaggagctgagacacctgatgtggagcagcgtggtgttctaccagacccccggcctggaggtgaccgcctgcgtgctgctgagcaccaaggccgtgtacttcgtgctgcacgacggcctgagaagatacttcagcgagcccctgcaggacttctggcaccagaagaacaccgactacaacaacagccccttccacatcagccagtgcttcgtgctgaagctgagcgacctgcagagcgtgaacgtgggcctgttcgaccagcacttcagactgaccggcagcacccccatgcaggtggtgacctgcctgaccagagacagctacctgacccactgcttcctgcagcacctgatggtggtgctgagcagcctggagagaacccccagccccgagcccgtggacaaggacttctacagcgagttcggcaacaagaccaccggcaagatggagaactacgagctgatccacagcagcagagtgaagttcacctaccccagcgaggaggagatcggcgacctgaccttcaccgtggcccagaagatggccgagcccgagaaggcccccgccctgagcatcctgctgtacgtgcaggccttccaggtgggcatgcccccccccggctgctgcagaggccccctgagacccaagaccctgctgctgaccagcagcgagatcttcctgctggacgaggactgcgtgcactaccccctgcccgagttcgccaaggagcccccccagagagacagatacagactggacgacggcagaagagtgagagacctggacagagtgctgatgggctaccagacctacccccaggccctgaccctggtgttcgacgacgtgcagggccacgacctgatgggcagcgtgaccctggaccacttcggcgaggtgcccggcggccccgccagagccagccagggcagagaggtgcagtggcaggtgttcgtgcccagcgccgagagcagagagaagctgatcagcctgctggccagacagtgggaggccctgtgcggcagagagctgcccgtggagctgaccggctag

SEQ ID NO: 20092 - DNA, 2457 bp, Artificial Sequence
  Description of Artificial Sequence: Synthetic coding sequence
atgggcccccccgacgtggaggaggaggagggcggcggccagggcgaggaggaggaggaggaggaggaggacgaggaggccgaggaggagagactggccctggagtgggccctgggcgccgacgaggacttcctgctggagcacatcagaatcctgaaggtgctgtggtgcttcctgatccacgtgcagggcagcatcagacagttcgccgcctgcctggtgctgaccgacttcggcatcgccgtgttcgagatcccccaccaggagagcagaggcagcagccagcacatcctgagcagcctgagattcgtgttctgcttcccccacggcgacctgaccgagttcggcttcctgatgcccgagctgtgcctggtgctgaaggtgagacacagcgagaacaccctgttcatcatcagcgacgccgccaacctgcacgagttccacgccgacctgagaagctgcttcgccccccagcacatggccatgctgtgcagccccatcctgtacggcagccacaccagcctgcaggagttcctgagacagctgctgaccttctacaaggtggccggcggctgccaggagagaagccagggctgcttccccgtgtacctggtgtacagcgacaagagaatggtgcagaccgccgccggcgactacagcggcaacatcgagtgggccagctgcaccctgtgcagcgccgtgagaagaagctgctgcgcccccagcgaggccgtgaagagcgccgccatcccctactggctgctgctgaccccccagcacctgaacgtgatcaaggccgacttcaaccccatgcccaacagaggcacccacaactgcagaaacagaaacagcttcaagctgagcagagtgcccctgagcaccgtgctgctggaccccaccagaagctgcacccagcccagaggcgccttcgccgacggccacgtgctggagctgctggtgggctacagattcgtgaccgccatcttcgtgctgccccacgagaagttccacttcctgagagtgtacaaccagctgagagccagcctgcaggacctgaagaccgtggtgatcgccaagacccccggcaccggcggcagcccccagggcagcttcgccgacggccagcccgccgagagaagagccagcaacgaccagagaccccaggaggtgcccgccgaggccctggcccccgcccccgccgaggtgcccgcccccgcccccgccgccgccagcgccagcggccccgccaagacccccgcccccgccgaggccagcaccagcgccctggtgcccgaggagacccccgtggaggcccccgcccccccccccgccgaggcccccgcccagtaccccagcgagcacctgatccaggccaccagcgaggagaaccagatccccagccacctgcccgcctgccccagcctgagacacgtggccagcctgagaggcagcgccatcatcgagctgttccacagcagcatcgccgaggtggagaacgaggagctgagacacctgatgtggagcagcgtggtgttctaccagacccccggcctggaggtgaccgcctgcgtgctgctgagcaccaaggccgtgtacttcgtgctgcacgacggcctgagaagatacttcagcgagcccctgcaggacttctggcaccagaagaacaccgactacaacaacagccccttccacatcagccagtgcttcgtgctgaagctgagcgacctgcagagcgtgaacgtgggcctgttcgaccagcacttcagactgaccggcagcacccccatgcaggtggtgacctgcctgaccagagacagctacctgacccactgcttcctgcagcacctgatggtggtgctgagcagcctggagagaacccccagccccgagcccgtggacaaggacttctacagcgagttcggcaacaagaccaccggcaagatggagaactacgagctgatccacagcagcagagtgaagttcacctaccccagcgaggaggagatcggcgacctgaccttcaccgtggcccagaagatggccgagcccgagaaggcccccgccctgagcatcctgctgtacgtgcaggccttccaggtgggcatgcccccccccggctgctgcagaggccccctgagacccaagaccctgctgctgaccagcagcgagatcttcctgctggacgaggactgcgtgcactaccccctgcccgagttcgccaaggagcccccccagagagacagatacagactggacgacggcagaagagtgagagacctggacagagtgctgatgggctaccagacctacccccaggccctgaccctggtgttcgacgacgtgcagggccacgacctgatgggcagcgccgagagcagagagaagctgatcagcctgctggccagacagtgggaggccctgtgcggcagagagctgcccgtggagctgaccggctag

SEQ ID NO: 20093 - DNA, 1287 bp, Artificial Sequence
  Description of Artificial Sequence: Synthetic coding sequence
atggccaccgccagaaccttcggccccgagagagaggccgagcccgccaaggaggccagagtggtgggcagcgagctggtggacacctacaccgtgtacatcatccaggtgaccgacggcagccacgagtggaccgtgaagcacagatacagcgacttccacgacctgcacgagaagctggtggccgagagaaagatcgacaagaacctgctgccccccaagaagatcatcggcaagaacagcagaagcctggtggagaagagagagaaggacctggaggtgtacctgcagaagctgctgaccgcctgcgtgctgctgagcaccaaggccgtgtacttcgtgctgcacgacggcctgagaagatacttcagcgagcccctgcaggacttctggcaccagaagaacaccgactacaacaacagccccttccacatcagccagtgcttcgtgctgaagctgagcgacctgcagagcgtgaacgtgggcctgttcgaccagcacttcagactgaccggcagcacccccatgcaggtggtgacctgcctgaccagagacagctacctgacccactgcttcctgcagcacctgatggtggtgctgagcagcctggagagaacccccagccccgagcccgtggacaaggacttctacagcgagttcggcaacaagaccaccggcaagatggagaactacgagctgatccacagcagcagagtgaagttcacctaccccagcgaggaggagatcggcgacctgaccttcaccgtggcccagaagatggccgagcccgagaaggcccccgccctgagcatcctgctgtacgtgcaggccttccaggtgggcatgcccccccccggctgctgcagaggccccctgagacccaagaccctgctgctgaccagcagcgagatcttcctgctggacgaggactgcgtgcactaccccctgcccgagttcgccaaggagcccccccagagagacagatacagactggacgacggcagaagagtgagagacctggacagagtgctgatgggctaccagacctacccccaggccctgaccctggtgttcgacgacgtgcagggccacgacctgatgggcagcgtgaccctggaccacttcggcgaggtgcccggcggccccgccagagccagccagggcagagaggtgcagtggcaggtgttcgtgcccagcgccgagagcagagagaagctgatcagcctgctggccagacagtgggaggccctgtgcggcagagagctgcccgtggagctgaccggctag

SEQ ID NO: 20094 - DNA, 4515 bp, Artificial Sequence; identical to SEQ ID NO: 20091
  Description of Artificial Sequence: Synthetic coding sequence

SEQ ID NO: 20095 - DNA, 1752 bp, Artificial Sequence
  Description of Artificial Sequence: Synthetic coding sequence
atggccaccgccagaaccttcggccccgagagagaggccgagcccgccaaggaggccagagtggtgggcagcgagctggtggacacctacaccgtgtacatcatccaggtgaccgacggcagccacgagtggaccgtgaagcacagatacagcgacttccacgacctgcacgagaagctggtggccgagagaaagatcgacaagaacctgctgccccccaagaagatcatcggcaagaacagcagaagcctggtggagaagagagagaaggacctggaggtgtacctgcagaagctgctggccgccttccccggcgtgacccccagagtgctggcccacttcctgcacttccacttctacgagatcaacggcatcaccgccgccctggccgaggagctgttcgagaagggcgagcagctgctgggcgccggcgaggtgttcgccatcggccccctgcagctgtacgccgtgaccgagcagctgcagcagggcaagcccacctgcgccagcggcgacgccaagaccgacctgggccacatcctggacttcacctgcagactgaagtacctgaaggtgagcggcaccgagggccccttcggcaccagcaacatccaggagcagctgctgcccttcgacctgagcatcttcaagagcctgcaccaggtggagatcagccactgcgacgccaagcacatcagaggcctggtggccagcaagcccaccctggccaccctgagcgtgagattcagcgccaccagcatgaaggaggtgctggtgcccgaggccagcgagttcgacgagtgggagcccgagggcaccaccctggagggccccgtgaccgccgtgatccccacctggcaggccctgaccaccctggacctgagccacaacagcgtgagcgagatcgacgagagcgtgaagctgatccccaagatcgagttcctggacctgagccacaacggcctgctggtggtggacaacctgcagcacctgtacaacctggtgcacctggacctgagctacaacaagctgagcagcctggagggcctgcacaccaagctgggcaacatcaagaccctgaacctggccggcaacctgctggagagcctgagcggcctgcacaagctgtacagcctggtgaacctggacctgagagacaacagaatcgagcagatggaggaggtgagaagcatcggcagcctgccctgcctggagcacgtgagcctgctgaacaaccccctgagcatcatccccgactacagaaccaaggtgctggcccagttcggcgagagagccagcgaggtgtgcctggacgacaccgtgaccaccgagaaggagctggacaccgtggaggtgctgaaggccatccagaaggccaaggaggtgaagagcaagctgagcaaccccgagaagaagggcggcgaggacagcagactgagcgccgccccctgcatcagacccagcagcagcccccccaccgtggcccccgccagcgccagcctgccccagcccatcctgagcaaccagggcaacagagtgtgcatcctgctgctggtggagccccacagccccgcctgggccccctggctgggctggggctggggcagaggcgccagcacctgcttccagcagggccagacccagggcggccagtgcctgctgcaggccggccccagaggcggcacccacggcagaggcgcctggcccgacgccagctgctgcctgctgggcgaggacagccagctgctgtag

SEQ ID NO: 20096 - DNA, 2097 bp, Artificial Sequence
  Description of Artificial Sequence: Synthetic coding sequence
atgctgcccgccagactgcccttcagactgctgagcctgttcctgagaggcagcgcccccaccgccgccagacacggcctgagagagcccctgctggagagaagatgcgccgccgccagcagcttccagcacagcagcagcctgggcagagagctgccctacgaccccgtggacaccgagggcttcggcgagggcggcgacatgcaggagagattcctgttccccgagtacatcctggaccccgagccccagcccaccagagagaagcagctgcaggagctgcagcagcagcaggaggaggaggagagacagagacagcagagaagagaggagagaagacagcagaacctgagagccagaagcagagagcaccccgtggtgggccaccccgaccccgccctgccccccagcggcgtgaactgcagcggctgcggcgccgagctgcactgccaggacgccggcgtgcccggctacctgcccagagagaagttcctgagaaccgccgaggccgacggcggcctggccagaaccgtgtgccagagatgctggctgctgagccaccacagaagagccctgagactgcaggtgagcagagagcagtacctggagctggtgagcgccgccctgagaagacccggccccagcctggtgctgtacatggtggacctgctggacctgcccgacgccctgctgcccgacctgcccgccctggtgggccccaagcagctgatcgtgctgggcaacaaggtggacctgctgccccaggacgcccccggctacagacagagactgagagagagactgtgggaggactgcgccagagccggcctgctgctggcccccggccaccagggcccccagagacccgtgaaggacgagccccaggacggcgagaaccccaacccccccaactggagcagaaccgtggtgagagacgtgagactgatcagcgccaagaccggctacggcgtggaggagctgatcagcgccctgcagagaagctggagatacagaggcgacgtgtacctggtgggcgccaccaacgccggcaagagcaccctgttcaacaccctgctggagagcgactactgcaccgccaagggcagcgaggccatcgacagagccaccatcagcccctggcccggcaccaccctgaacctgctgaagttccccatctgcaaccccaccccctacagaatgttcaagagacaccagagactgaagaaggacagcacccaggccgaggaggacctgagcgagcaggagcagaaccagctgaacgtgctgaagaagcacggctacgtggtgggcagagtgggcagaaccttcctgtacagcgaggagcagaaggacaacatccccttcgagttcgacgccgacagcctggccttcgacatggagaacgaccccgtgatgggcacccacaagagcaccaagcaggtggagctgaccgcccaggacgtgaaggacgcccactggttctacgacacccccggcatcaccaaggagaactgcatcctgaacctgctgaccgagaaggaggtgaacatcgtgctgcccacccagagcatcgtgcccagaaccttcgtgctgaagcccggcatggtgctgttcctgggcgccatcggcagaatcgacttcctgcagggcaaccagagcgcctggttcaccgtggtggccagcaacatcctgcccgtgcacatcaccagcctggacagagccgacgccctgtaccagaagcacgccggccacaccctgctgcagatccccatgggcggcaaggagagaatggccggcttcccccccctggtggccgaggacatcatgctgaaggagggcctgggcgccagcgaggccgtggccgacatcaagttcagcagcgccggctgggtgagcgtgacccccaacttcaaggacagactgcacctgagaggctacacccccgagggcaccgtgctgaccgtgagaccccccctgctgccctacatcgtgaacatcaagggccagagaatcaagaagagcgtggcctacaagaccaagaagccccccagcctgatgtacaacgtgagaaagaagaagggcaagatcaacgtgtag

SEQ ID NO: 20097 - DNA, 3669 bp, Artificial Sequence
  Description of Artificial Sequence: Synthetic coding sequence
atgctggtgggccagggcgccggccccctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcatcgccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccaacagacccatgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacatgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgagagccctgggccaggccgccagcgacaacagcggccccgaggacgccaagagacaggccaagaagcagaagaccagaagaacctag

SEQ ID NO: 20098 - DNA, 3804 bp, Artificial Sequence
  Description of Artificial Sequence: Synthetic coding sequence
atgctggtgggccagggcgccggccccctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcatcgccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccaacagacccatgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacatgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgagagccctgggccaggccgccagcgacaacagcggccccgaggacgccaagagacaggccaagaagcagaagaccagaagaaccctgagactgcagggcgagttccagctgacctggtgcctggtgccctggagaggcaccctgggcatccacctgttcagcagcctgcccttcgccagcgagatcctgctggagaccaccgccacctgcatccactactag

SEQ ID NO: 20099 - DNA, 3303 bp, Artificial Sequence
  Description of Artificial Sequence: Synthetic coding sequence
atggccagattcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcatcgccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccaacagacccatgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacatgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgagagccctgggccaggccgccagcgacaacagcggccccgaggacgccaagagacaggccaagaagcagaagaccagaagaaccctgagactgcagggcgagttccagctgacctggtgcctggtgccctggagaggcaccctgggcatccacctgttcagcagcctgcccttcgccagcgagatcctgctggagaccaccgccacctgcatccactactag

SEQ ID NO: 20100 - DNA, 3669 bp, Artificial Sequence
  Description of Artificial Sequence: Synthetic coding sequence
atgctggtgggccagggcgccggcctgctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggcagaatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaacctag

SEQ ID NO: 20101 - DNA, 3804 bp, Artificial Sequence
  Description of Artificial Sequence: Synthetic coding sequence
atgctggtgggccagggcgccggcctgctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggcagaatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaaccctgagactgcaggaggagttccagctgatgtggtgcctggtgccctggagaggcaccctgggcatccacctgttcagcagcctgcccttcgccagcgagatcctgctggagaccaccgccacctgcatccactactag

SEQ ID NO: 20102 - DNA, 3303 bp, Artificial Sequence
  Description of Artificial Sequence: Synthetic coding sequence
atggccagattcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggcagaatcagcatcatcagattccccgacaccgtgaagcagatgaacaagtacaaggtggtgctgagcagccaggacaaggacaagagcctggtgaccgtggagaccgacgcccacggcagcttctgcttcaaggccaagcccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaaccctgagactgcaggaggagttccagctgatgtggtgcctggtgccctggagaggcaccctgggcatccacctgttcagcagcctgcccttcgccagcgagatcctgctggagaccaccgccacctgcatccactactag

SEQ ID NO: 20103 - DNA, 3804 bp, Artificial Sequence
  Description of Artificial Sequence: Synthetic coding sequence
atgctggtgggccagggcgccggccccctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaaccccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaaccctgagactgcaggaggagttccagctgatgtggtgcctggtgccctggagaggcaccctgggcatccacctgttcagcagcctgcccttcgccagcgagatcctgctggagaccaccgccacctgcatccactactag

SEQ ID NO: 20104 - DNA, 3669 bp, Artificial Sequence
  Description of Artificial Sequence: Synthetic coding sequence
atgctggtgggccagggcgccggccccctgggccccgccgtggtgaccgccgccgtggtgctgctgctgagcggcgtgggccccgcccacggcagcgaggacatcgtggtgggctgcggcggcttcgtgaagagcgacgtggagatcaactacagcctgatcgagatcaagctgtacaccaagcacggcaccctgaagtaccagaccgactgcgcccccaacaacggctacttcatgatccccctgtacgacaagggcgacttcatcctgaagatcgagccccccctgggctggagcttcgagcccaccaccgtggagctgcacgtggacggcgtgagcgacatctgcaccaagggcggcgacatcaacttcgtgttcaccggcttcagcgtgaacggcaaggtgctgagcaagggccagcccctgggccccgccggcgtgcaggtgagcctgagaaacaccggcaccgaggccaagatccagagcaccgtgacccagcccggcggcaagttcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaaccccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaacctag

SEQ ID NO: 20105 - DNA, 3303 bp, Artificial Sequence
  Description of Artificial Sequence: Synthetic coding sequence
atggccagattcgccttcttcaaggtgctgcccggcgactacgagatcctggccacccaccccacctgggccctgaaggaggccagcaccaccgtgagagtgaccaacagcaacgccaacgccgccagccccctgatcgtggccggctacaacgtgagcggcagcgtgagaagcgacggcgagcccatgaagggcgtgaagttcctgctgttcagcagcctggtgaccaaggaggacgtgctgggctgcaacgtgagccccgtgcccggcttccagccccaggacgagagcctggtgtacctgtgctacaccgtgagcagagaggacggcagcttcagcttctacagcctgcccagcggcggctacaccgtgatccccttctacagaggcgagagaatcaccttcgacgtggcccccagcagactggacttcaccgtggagcacgacagcctgaagatcgagcccgtgttccacgtgatgggcttcagcgtgaccggcagagtgctgaacggccccgagggcgacggcgtgcccgaggccgtggtgaccctgaacaaccagatcaaggtgaagaccaaggccgacggcagcttcagactggagaacatcaccaccggcacctacaccatccacgcccagaaggagcacctgtacttcgagaccgtgaccatcaagatcgcccccaacaccccccagctggccgacatcgtggccaccggcttcagcgtgtgcggccagatcagcatcatcagattccccgacaccgtgaagcagatgaacaagtacaaggtggtgctgagcagccaggacaaggacaagagcctggtgaccgtggagaccgacgcccacggcagcttctgcttcaaggccaaccccggcacctacaaggtgcaggtgatggtgcccgaggccgagaccagagccggcctgaccctgaagccccagaccttccccctgaccgtgaccgacagacccgtgatggacgtggccttcgtgcagttcctggccagcgtgagcggcaaggtgagctgcctggacacctgcggcgacctgctggtgaccctgcagagcctgagcagacagggcgagaagagaagcctgcagctgagcggcaaggtgaacgccatgaccttcaccttcgacaacgtgctgcccggcaagtacaagatcagcatcatgcacgaggactggtgctggaagaacaagagcctggaggtggaggtgctggaggacgacgtgagcgccgtggagttcagacagaccggctacatgctgagatgcagcctgagccacgccatcaccctggagttctaccaggacggcaacggcagagagaacgtgggcatctacaacctgagcaagggcgtgaacagattctgcctgagcaagcccggcgtgtacaaggtgacccccagaagctgccacagattcgagcaggccttctacacctacgacaccagcagccccagcatcctgaccctgaccgccatcagacaccacgtgctgggcaccatcaccaccgacaagatgatggacgtgaccgtgaccatcaagagcagcatcgacagcgagcccgccctggtgctgggccccctgaagagcgtgcaggagctgagaagagagcagcagctggccgagatcgaggccagaagacaggagagagagaagaacggcaacgaggagggcgaggagagaatgaccaagccccccgtgcaggagatggtggacgagctgcagggccccttcagctacgacttcagctactgggccagaagcggcgagaagatcaccgtgacccccagcagcaaggagctgctgttctacccccccagcatggaggccgtggtgagcggcgagagctgccccggcaagctgatcgagatccacggcaaggccggcctgttcctggagggccagatccaccccgagctggagggcgtggagatcgtgatcagcgagaagggcgccagcagccccctgatcaccgtgttcaccgacgacaagggcgcctacagcgtgggccccctgcacagcgacctggagtacaccgtgaccagccagaaggagggctacgtgctgaccgccgtggagggcaccatcggcgacttcaaggcctacgccctggccggcgtgagcttcgagatcaaggccgaggacgaccagcccctgcccggcgtgctgctgagcctgagcggcggcctgttcagaagcaacctgctgacccaggacaacggcatcctgaccttcagcaacctgagccccggccagtactacttcaagcccatgatgaaggagttcagattcgagcccagcagccagatgatcgaggtgcaggagggccagaacctgaagatcaccatcaccggctacagaaccgcctacagctgctacggcaccgtgagcagcctgaacggcgagcccgagcagggcgtggccatggaggccgtgggccagaacgactgcagcatctacggcgaggacaccgtgaccgacgaggagggcaagttcagactgagaggcctgctgcccggctgcgtgtaccacgtgcagctgaaggccgagggcaacgaccacatcgagagagccctgccccaccacagagtgatcgaggtgggcaacaacgacatcgacgacgtgaacatcatcgtgttcagacagatcaaccagttcgacctgagcggcaacgtgatcaccagcagcgagtacctgcccaccctgtgggtgaagctgtacaagagcgagaacctggacaaccccatccagaccgtgagcctgggccagagcctgttcttccacttcccccccctgctgagagacggcgagaactacgtggtgctgctggacagcaccctgcccagaagccagtacgactacatcctgccccaggtgagcttcaccgccgtgggctaccacaagcacatcaccctgatcttcaaccccaccagaaagctgcccgagcaggacatcgcccagggcagctacatcgccctgcccctgaccctgctggtgctgctggccggctacaaccacgacaagctgatccccctgctgctgcagctgaccagcagactgcagggcgtgggcgccctgggccaggccgccagcgacaacagcggccccgaggacgccaagagacaggccaagaagcagaagaccagaagaaccctgagactgcaggaggagttccagctgatgtggtgcctggtgccctggagaggcaccctgggcatccacctgttcagcagcctgcccttcgccagcgagatcctgctggagaccaccgccacctgcatccactactag

SEQ ID NO: 20106 - DNA, 4206 bp, Artificial Sequence
  Description of Artificial Sequence: Synthetic coding sequence
atggccccccagatgtacgagttccacctgcccctgagccccgaggagctgctgaagagcggcggcgtgaaccagtacgtggtgcaggaggtgctgagcatcaagcacctgcccccccagctgagagccttccaggccgccttcagagcccagggccccctggccatgctgcagcacttcgacaccatctacagcatcctgcaccacttcagaagcatcgaccccggcctgaaggaggacaccctgcagttcctgatcaaggtggtgagcagacacagccaggagctgcccgccatcctggacgacaccaccctgagcggcagcgacagaaacgcccacctgaacgccctgaagatgaactgctacgccctgatcagactgctggagagcttcgagaccatggccagccagaccaacctggtggacctggacctgggcggcaagggcaagaaggccagaaccaaggccgcccacggcttcgactgggaggaggagagacagcccatcctgcagctgctgacccagctgctgcagctggacatcagacacctgtggaaccacagcatcatcgaggaggagttcgtgagcctggtgaccggctgctgctacagactgctggagaaccccaccatcaaccaccagaagaacagacccaccagagaggccatcacccacctgctgggcgtggccctgaccagatacaaccacatgctgagcgccaccgtgaagatcatccagatgctgcagcacttcgagcacctggcccccgtgctggtggccgccgtgagcctgtgggccaccgactacggcatgaagagcatcgtgggcgagatcgtgagagagatcggccagaagtgcccccaggagctgagcagagaccccagcggcaccaagggcttcgccgccttcctgaccgagctggccgagagagtgcccgccatcctgatgagcagcatgtgcatcctgctggaccacctggacggcgagaactacatgatgagaaacgccgtgctggccgccatggccgagatggtgctgcaggtgctgagcggcgaccagctggaggccgccgccagagacaccagagaccagttcctggacaccctgcaggcccacggccacgacgtgaacagcttcgtgagaagcagagtgctgcagctgttcaccagaatcgtgcagcagaaggccctgcccctgaccagattccaggccgtggtggccctggccgtgggcagactggccgacaagagcgtgctggtgtgcaagaacgccatccagctgctggccagcttcctggccaacaaccccttcagctgcaagctgagcgacgccgacctggccggccccctgcagaaggagacccagaagctgcaggagatgagagcccagagaagaaccgccgccgccagcgccgtgctggaccccgaggaggagtgggaggccatgctgcccgagctgaagagcaccctgcagcagctgctgcagctgccccagggcgaggaggagatccccgagcagatcgccaacaccgagaccaccgaggacgtgaagggcagaatctaccagctgctggccaaggccagctacaagaaggccatcatcctgaccagagaggccaccggccacttccaggagagcgagcccttcagccacatcgaccccgaggagagcgaggagaccagactgctgaacatcctgggcctgatcttcaagggccccgccgccagcacccaggagaagaaccccagagagagcaccggcaacatggtgaccggccagaccgtgtgcaagaacaagcccaacatgagcgaccccgaggagagcagaggcaacgacgagctggtgaagcaggagatgctggtgcagtacctgcaggacgcctacagcttcagcagaaagatcaccgaggccatcggcatcatcagcaagatgatgtacgagaacaccaccaccgtggtgcaggaggtgatcgagttcttcgtgatggtgttccagttcggcgtgccccaggccctgttcggcgtgagaagaatgctgcccctgatctggagcaaggagcccggcgtgagagaggccgtgctgaacgcctacagacagctgtacctgaaccccaagggcgacagcgccagagccaaggcccaggccctgatccagaacctgagcctgctgctggtggacgccagcgtgggcaccatccagtgcctggaggagatcctgtgcgagttcgtgcagaaggacgagctgaagcccgccgtgacccagctgctgtgggagagagccaccgagaaggtggcctgctgccccctggagagatgcagcagcgtgatgctgctgggcatgatggccagaggcaagcccgagatcgtgggcagcaacctggacaccctggtgagcatcggcctggacgagaagttcccccaggactacagactggcccagcaggtgtgccacgccatcgccaacatcagcgacagaagaaagcccagcctgggcaagagacacccccccttcagactgccccaggagcacagactgttcgagagactgagagagaccgtgaccaagggcttcgtgcaccccgaccccctgtggatccccttcaaggaggtggccgtgaccctgatctaccagctggccgagggccccgaggtgatctgcgcccagatcctgcagggctgcgccaagcaggccctggagaagctggaggagaagagaaccagccaggaggaccccaaggagagccccgccatgctgcccaccttcctgctgatgaacctgctgagcctggccggcgacgtggccctgcagcagctggtgcacctggagcaggccgtgagcggcgagctgtgcagaagaagagtgctgagagaggagcaggagcacaagaccaaggaccccaaggagaagaacaccagcagcgagaccaccatggaggaggagctgggcctggtgggcgccaccgccgacgacaccgaggccgagctgatcagaggcatctgcgagatggagctgctggacggcaagcagaccctggccgccttcgtgcccctgctgctgaaggtgtgcaacaaccccggcctgtacagcaaccccgacctgagcgccgccgccagcctggccctgggcaagttctgcatgatcagcgccaccttctgcgacagccagctgagactgctgttcaccatgctggagaagagccccctgcccatcgtgagaagcaacctgatggtggccaccggcgacctggccatcagattccccaacctggtggacccctggaccccccacctgtacgccagactgagagaccccgcccagcaggtgagaaagaccgccggcctggtgatgacccacctgatcctgaaggacatggtgaaggtgaagggccaggtgagcgagatggccgtgctgctgatcgaccccgagccccagatcgccgccctggccaagaacttcttcaacgagctgagccacaagggcaacgccatctacaacctgctgcccgacatcatcagcagactgagcgaccccgagctgggcgtggaggaggagcccttccacaccatcatgaagcagctgctgagctacatcaccaaggacaagcagaccgagagcctggtggagaagctgtgccagagattcagaaccagcagaaccgagagacagcagagagacctggcctactgcgtgagccagctgcccctgaccgagagaggcctgagaaagatgctggacaacttcgactgcttcggcgacaagctgagcgacgagagcatcttcagcgccttcctgagcgtggtgggcaagctgagaagaggcgccaagcccgagggcaaggccatcatcgacgagttcgagcagaagctgagagcctgccacaccagaggcctggacggcatcaaggagctggagatcggccaggccggcagccagagagcccccagcgccaagaagcccagcaccggcagcagataccagcccctggccagcaccgccagcgacaacgacttcgtgacccccgagcccagaagaaccaccagaagacaccccaacacccagcagagagccagcaagaagaagcccaaggtggtgttcagcagcgacgagagcagcgaggaggacctgagcgccgagatgaccgaggacgagacccccaagaagaccacccccatcctgagagccagcgccagaagacacagaagctag

SEQ ID NO: 20107 - DNA, 2820 bp, Artificial Sequence
  Description of Artificial Sequence: Synthetic coding sequence
atggccccccagatgtacgagttccacctgcccctgagccccgaggagctgctgaagagcggcggcgtgaaccagtacgtggtgcaggaggtgctgagcatcaagcacctgcccccccagctgagagccttccaggccgccttcagagcccagggccccctggccatgctgcagcacttcgacaccatctacagcatcctgcacctggtgaccggctgctgctacagactgctggagaaccccaccatcaaccaccagaagaacagacccaccagagaggccatcacccacctgctgggcgtggccctgaccagatacaaccacatgctgagcgccaccgtgaagatcatccagatgctgcagcacttcgagcacctggcccccgtgctggtggccgccgtgagcctgtgggccaccgactacggcatgaagagcatcgtgggcgagatcgtgagagagatcggccagaagtgcccccaggagctgagcagagaccccagcggcaccaagggcttcgccgccttcctgaccgagctggccgagagagtgcccgccatcctgatgagcagcatgtgcatcctgctggaccacctggacggcgagaactacatgatgagaaacgccgtgctggccgccatggccgagatggtgctgcaggtgctgagcggcgaccagctggaggccgccgccagagacaccagagaccagttcctggacaccctgcaggcccacggccacgacgtgaacagcttcgtgagaagcagagtgctgcagctgttcaccagaatcgtgcagcagaaggccctgcccctgaccagattccaggccgtggtggccctggccgtgggcagactggccgacaagagcgtgctggtgtgcaagaacgccatccagctgctggccagcttcctggccaacaaccccttcagctgcaagctgagcgacgccgacctggccggccccctgcagaaggagacccagaagctgcaggagatgagagcccagagaagaaccgccgccgccagcgccgtgctggaccccgaggaggagtgggaggccatgctgcccgagctgaagagcaccctgcagcagctgctgcagctgccccagggcgaggaggagatccccgagcagatcgccaacaccgagaccaccgaggacgtgaagggcagaatctaccagctgctggccaaggccagctacaagaaggccatcatcctgaccagagaggccaccggccacttccaggagagcgagcccttcagccacatcgaccccgaggagagcgaggagaccagactgctgaacatcctgggcctgatcttcaagggccccgccgccagcacccaggagaagaaccccagagagagcaccggcaacatggtgaccggccagaccgtgtgcaagaacaagcccaacatgagcgaccccgaggagagcagaggcaacgacgagctggtgaagcaggagatgctggtgcagtacctgcaggacgcctacagcttcagcagaaagatcaccgaggccatcggcatcatcagcaagatgatgtacgagaacaccaccaccgtggtgcaggaggtgatcgagttcttcgtgatggtgttccagttcggcgtgccccaggccctgttcggcgtgagaagaatgctgcccctgatctggagcaaggagcccggcgtgagagaggccgtgctgaacgcctacagacagctgtacctgaaccccaagggcgacagcgccagagccaaggcccaggccctgatccagaacctgagcctgctgctggtggacgccagcgtgggcaccatccagtgcctggaggagatcctgtgcgagttcgtgcagaaggacgagctgaagcccgccgtgacccagctgctgtgggagagagccaccgagaaggtggcctgctgccccctggagagatgcagcagcgtgatgctgctgggcatgatggccagaggcaagcccgagatcgtgggcagcaacctggacaccctggtgagcatcggcctggacgagaagttcccccaggactacagactggcccagcaggtgtgccacgccatcgccaacatcagcgacagaagaaagcccagcctgggcaagagacacccccccttcagactgccccaggagcacagactgttcgagagactgagagagaccgtgaccaagggcttcgtgcaccccgaccccctgtggatccccttcaaggaggtggccgtgaccctgatctaccagctggccgagggccccgaggtgatctgcgcccagatcctgcagggctgcgccaagcaggccctggagaagctggaggagaagagaaccagccaggaggaccccaaggagagccccgccatgctgcccaccttcctgctgatgaacctgctgagcctggccggcgacgtggccctgcagcagctggtgcacctggagcaggccgtgagcggcgagctgtgcagaagaagagtgctgagagaggagcaggagcacaagaccaaggaccccaaggagaagaacaccagcagcgagaccaccatggaggaggagctgggcctggtgggcgccaccgccgacgacaccgaggccgagctgatcagaggcatctgcgagatggagctgctggacggcaagcagaccctggccgccttcgtgcccctgctgctgaaggtgtgcaacaaccccggcctgtacagcaaccccgacctgagcgccgccgccagcctggccctgggcaagttctgcatgatcagcgccaccttctgcgacagccagcacttcgccatccccagaagagtggacaacctgagatag

SEQ ID NO: 20108 - DNA, 4071 bp, Artificial Sequence
  Description of Artificial Sequence: Synthetic coding sequence
atgctgtgcaagagatactgccccagcaacatcttccaccacagcctggagctgttcagactgcccttcgagctgagaggcccctggctgtgctgcagcaccctgatcctgagcaccgccttctgcatggtgagcagacacagccaggagctgcccgccatcctggacgacaccaccctgagcggcagcgacagaaacgcccacctgaacgccctgaagatgaactgctacgccctgatcagactgctggagagcttcgagaccatggccagccagaccaacctggtggacctggacctgggcggcaagggcaagaaggccagaaccaaggccgcccacggcttcgactgggaggaggagagacagcccatcctgcagctgctgacccagctgctgcagctggacatcagacacctgtggaaccacagcatcatcgaggaggagttcgtgagcctggtgaccggctgctgctacagactgctggagaaccccaccatcaaccaccagaagaacagacccaccagagaggccatcacccacctgctgggcgtggccctgaccagatacaaccacatgctgagcgccaccgtgaagatcatccagatgctgcagcacttcgagcacctggcccccgtgctggtggccgccgtgagcctgtgggccaccgactacggcatgaagagcatcgtgggcgagatcgtgagagagatcggccagaagtgcccccaggagctgagcagagaccccagcggcaccaagggcttcgccgccttcctgaccgagctggccgagagagtgcccgccatcctgatgagcagcatgtgcatcctgctggaccacctggacggcgagaactacatgatgagaaacgccgtgctggccgccatggccgagatggtgctgcaggtgctgagcggcgaccagctggaggccgccgccagagacaccagagaccagttcctggacaccctgcaggcccacggccacgacgtgaacagcttcgtgagaagcagagtgctgcagctgttcaccagaatcgtgcagcagaaggccctgcccctgaccagattccaggccgtggtggccctggccgtgggcagactggccgacaagagcgtgctggtgtgcaagaacgccatccagctgctggccagcttcctggccaacaaccccttcagctgcaagctgagcgacgccgacctggccggccccctgcagaaggagacccagaagctgcaggagatgagagcccagagaagaaccgccgccgccagcgccgtgctggaccccgaggaggagtgggaggccatgctgcccgagctgaagagcaccctgcagcagctgctgcagctgccccagggcgaggaggagatccccgagcagatcgccaacaccgagaccaccgaggacgtgaagggcagaatctaccagctgctggccaaggccagctacaagaaggccatcatcctgaccagagaggccaccggccacttccaggagagcgagcccttcagccacatcgaccccgaggagagcgaggagaccagactgctgaacatcctgggcctgatcttcaagggccccgccgccagcacccaggagaagaaccccagagagagcaccggcaacatggtgaccggccagaccgtgtgcaagaacaagcccaacatgagcgaccccgaggagagcagaggcaacgacgagctggtgaagcaggagatgctggtgcagtacctgcaggacgcctacagcttcagcagaaagatcaccgaggccatcggcatcatcagcaagatgatgtacgagaacaccaccaccgtggtgcaggaggtgatcgagttcttcgtgatggtgttccagttcggcgtgccccaggccctgttcggcgtgagaagaatgctgcccctgatctggagcaaggagcccggcgtgagagaggccgtgctgaacgcctacagacagctgtacctgaaccccaagggcgacagcgccagagccaaggcccaggccctgatccagaacctgagcctgctgctggtggacgccagcgtgggcaccatccagtgcctggaggagatcctgtgcgagttcgtgcagaaggacgagctgaagcccgccgtgacccagctgctgtgggagagagccaccgagaaggtggcctgctgccccctggagagatgcagcagcgtgatgctgctgggcatgatggccagaggcaagcccgagatcgtgggcagcaacctggacaccctggtgagcatcggcctggacgagaagttcccccaggactacagactggcccagcaggtgtgccacgccatcgccaacatcagcgacagaagaaagcccagcctgggcaagagacacccccccttcagactgccccaggagcacagactgttcgagagactgagagagaccgtgaccaagggcttcgtgcaccccgaccccctgtggatccccttcaaggaggtggccgtgaccctgatctaccagctggccgagggccccgaggtgatctgcgcccagatcctgcagggctgcgccaagcaggccctggagaagctggaggagaagagaaccagccaggaggaccccaaggagagccccgccatgctgcccaccttcctgctgatgaacctgctgagcctggccggcgacgtggccctgcagcagctggtgcacctggagcaggccgtgagcggcgagctgtgcagaagaagagtgctgagagaggagcaggagcacaagaccaaggaccccaaggagaagaacaccagcagcgagaccaccatggaggaggagctgggcctggtgggcgccaccgccgacgacaccgaggccgagctgatcagaggcatctgcgagatggagctgctggacggcaagcagaccctggccgccttcgtgcccctgctgctgaaggtgtgcaacaaccccggcctgtacagcaaccccgacctgagcgccgccgccagcctggccctgggcaagttctgcatgatcagcgccaccttctgcgacagccagctgagactgctgttcaccatgctggagaagagccccctgcccatcgtgagaagcaacctgatggtggccaccggcgacctggccatcagattccccaacctggtggacccctggaccccccacctgtacgccagactgagagaccccgcccagcaggtgagaaagaccgccggcctggtgatgacccacctgatcctgaaggacatggtgaaggtgaagggccaggtgagcgagatggccgtgctgctgatcgaccccgagccccagatcgccgccctggccaagaacttcttcaacgagctgagccacaagggcaacgccatctacaacctgctgcccgacatcatcagcagactgagcgaccccgagctgggcgtggaggaggagcccttccacaccatcatgaagcagctgctgagctacatcaccaaggacaagcagaccgagagcctggtggagaagctgtgccagagattcagaaccagcagaaccgagagacagcagagagacctggcctactgcgtgagccagctgcccctgaccgagagaggcctgagaaagatgctggacaacttcgactgcttcggcgacaagctgagcgacgagagcatcttcagcgccttcctgagcgtggtgggcaagctgagaagaggcgccaagcccgagggcaaggccatcatcgacgagttcgagcagaagctgagagcctgccacaccagaggcctggacggcatcaaggagctggagatcggccaggccggcagccagagagcccccagcgccaagaagcccagcaccggcagcagataccagcccctggccagcaccgccagcgacaacgacttcgtgacccccgagcccagaagaaccaccagaagacaccccaacacccagcagagagccagcaagaagaagcccaaggtggtgttcagcagcgacgagagcagcgaggaggacctgagcgccgagatgaccgaggacgagacccccaagaagaccacccccatcctgagagccagcgccagaagacacagaagctag

SEQ ID NO: 20109 - DNA, 2382 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcgacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaaggaggagaacaaggagaagaacagatacgtgaacatcctgccctacgaccacagcagagtgcacctgacccccgtggagggcgtgcccgacagcgactacatcaacgccagcttcatcaacggctaccaggagaagaacaagttcatcgccgcccagggccccaaggaggagaccgtgaacgacttctggagaatgatctgggagcagaacaccgccaccatcgtgatggtgaccaacctgaaggagagaaaggagtgcaagtgcgcccagtactggcccgaccagggctgctggacctacggcaacatcagagtgagcgtggaggacgtgaccgtgctggtggactacaccgtgagaaagttctgcatccagcaggtgggcgacatgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 20110 - DNA, 1119 bp, Artificial Sequence
  Description of Artificial Sequence: Synthetic coding sequence
atggccgccgagagacaggaggccctgagagagttcgtggccgtgaccggcgccgaggaggacagagccagattcttcctggagagcgccggctgggacctgcagatcgccctggccagcttctacgaggacggcggcgacgaggacatcgtgaccatcagccaggccacccccagcagcgtgagcagaggcaccgcccccagcgacaacagagtgaccagcttcagagacctgatccacgaccaggacgaggacgaggaggaggaggagggccagagagacagattctacgccggcggcagcgagagaagcggccagcagatcgtgggcccccccagaaagaagagccccaacgagctggtggacgacctgttcaagggcgccaaggagcacggcgccgtggccgtggagagagtgaccaagagccccggcgagaccagcaagcccagacccttcgccggcggcggctacagactgggcgccgcccccgaggaggagagcgcctacgtggccggcgagaagagacagcacagcagccaggacgtgcacgtggtgctgaagctgtggaagagcggcttcagcctggacaacggcgagctgagaagctaccaggaccccagcaacgcccagttcctggagagcatcagaagaggcgaggtgcccgccgagctgagaagactggcccacggcggccaggtgaacctggacatggaggaccacagagacgaggacttcgtgaagcccaagggcgccttcaaggccttcaccggcgagggccagaagctgggcagcaccgccccccaggtgctgagcaccagcagccccgcccagcaggccgagaacgaggccaaggccagcagcagcatcctgatcgacgagagcgagcccaccaccaacatccagatcagactggccgacggcggcagactggtgcagaagttcaaccacagccacagaatcagcgacatcagactgttcatcgtggacgccagacccgccatggccgccaccagcttcatcctgatgaccaccttccccaacaaggagctggccgacgagagccagaccctgaaggaggccaacctgctgaacgccgtgatcgtgcagagactgacctag

SEQ ID NO: 20111 - DNA, 1020 bp, Artificial Sequence
  Description of Artificial Sequence: Synthetic coding sequence
atggccgccgagagacaggaggccctgagagagttcgtggccgtgaccggcgccgaggaggacagagccagattcttcctggagagcgccggctgggacctgcagatcgccctggccagcttctacgaggacggcggcgacgaggacatcgtgaccatcagccaggccacccccagcagcgtgagcagaggcaccgcccccagcgacaacagagtgaccagcttcagagacctgatccacgaccaggacgaggacgaggaggaggaggagggccagagattctacgccggcggcagcgagagaagcggccagcagatcgtgggcccccccagaaagaagagccccaacgagctggtggacgacctgttcaagggcgccaaggagcacggcgccgtggccgtggagagagtgaccaagagccccggcgagaccagcaagcccagagtgcacgtggtgctgaagctgtggaagagcggcttcagcctggacaacggcgagctgagaagctaccaggaccccagcaacgcccagttcctggagagcatcagaagaggcgaggtgcccgccgagctgagaagactggcccacggcggccaggtgaacctggacatggaggaccacagagacgaggacttcgtgaagcccaagggcgccttcaaggccttcaccggcgagggccagaagctgggcagcaccgccccccaggtgctgagcaccagcagccccgcccagcaggccgagaacgaggccaaggccagcagcagcatcctgatcgacgagagcgagcccaccaccaacatccagatcagactggccgacggcggcagactggtgcagaagttcaaccacagccacagaatcagcgacatcagactgttcatcgtggacgccagacccgccatggccgccaccagcttcatcctgatgaccaccttccccaacaaggagctggccgacgagagccagaccctgaaggaggccaacctgctgaacgccgtgatcgtgcagagactgacctag

SEQ ID NO: 20112 - DNA, 780 bp, Artificial Sequence
  Description of Artificial Sequence: Synthetic coding sequence
atgaccaagatgaagatgagaagaaagagaaaggccagaggcgccaaggagcacggcgccgtggccgtggagagagtgaccaagagccccggcgagaccagcaagcccagacccttcgccggcggcggctacagactgggcgccgcccccgaggaggagagcgcctacgtggccggcgagaagagacagcacagcagccaggacgtgcacgtggtgctgaagctgtggaagagcggcttcagcctggacaacggcgagctgagaagctaccaggaccccagcaacgcccagttcctggagagcatcagaagaggcgaggtgcccgccgagctgagaagactggcccacggcggccaggtgaacctggacatggaggaccacagagacgaggacttcgtgaagcccaagggcgccttcaaggccttcaccggcgagggccagaagctgggcagcaccgccccccaggtgctgagcaccagcagccccgcccagcaggccgagaacgaggccaaggccagcagcagcatcctgatcgacgagagcgagcccaccaccaacatccagatcagactggccgacggcggcagactggtgcagaagttcaaccacagccacagaatcagcgacatcagactgttcatcgtggacgccagacccgccatggccgccaccagcttcatcctgatgaccaccttccccaacaaggagctggccgacgagagccagaccctgaaggaggccaacctgctgaacgccgtgatcgtgcagagactgacctag

SEQ ID NO: 20113 - DNA, 1119 bp, Artificial Sequence
  Description of Artificial Sequence: Synthetic coding sequence
atggccgccgagagacaggaggccctgagagagttcgtggccgtgaccggcgccgaggaggacagagccagattcttcctggagagcgccggctgggacctgcagatcgccctggccagcttctacgaggacggcggcgacgaggacatcgtgaccatcagccaggccacccccagcagcgtgagcagaggcaccgcccccagcgacaacagagtgaccagcttcagagacctgatccacgaccaggacgaggacgaggaggaggaggagggccagagaagcagattctacgccggcggcagcgagagaagcggccagcagatcgtgggcccccccagaaagaagagccccaacgagctggtggacgacctgttcaagggcgccaaggagcacggcgccgtggccgtggagagagtgaccaagagccccggcgagaccagcaagcccagacccttcgccggcggcggctacagactgggcgccgcccccgaggaggagagcgcctacgtggccggcgagaagagacagcacagcagccaggacgtgcacgtggtgctgaagctgtggaagagcggcttcagcctggacaacggcgagctgagaagctaccaggaccccagcaacgcccagttcctggagagcatcagaagaggcgaggtgcccgccgagctgagaagactggcccacggcggccaggtgaacctggacatggaggaccacagagacgaggacttcgtgaagcccaagggcgccttcaaggccttcaccggcgagggccagaagctgggcagcaccgccccccaggtgctgagcaccagcagccccgcccagcaggccgagaacgaggccaaggccagcagcagcatcctgatcgacgagagcgagcccaccaccaacatccagatcagactggccgacggcggcagactggtgcagaagttcaaccacagccacagaatcagcgacatcagactgttcatcgtggacgccagacccgccatggccgccaccagcttcatcctgatgaccaccttccccaacaaggagctggccgacgagagccagaccctgaaggaggccaacctgctgaacgccgtgatcgtgcagagactgacctag

SEQ ID NO: 20114 - DNA, 1056 bp, Artificial Sequence
  Description of Artificial Sequence: Synthetic coding sequence
atggaggacagccaggagaccagccccagcagcaacaacagcagcgaggagctgagcagcgccctgcacctgagcaagggcatgagcatcttcctggacatcctgagaagagccgacaagaacgacgacggcaagctgagcttcgaggagttcaaggcctacttcgccgacggcgtgctgagcggcgaggagctgcacgagctgttccacaccatcgacacccacaacaccaacaacctggacaccgaggagctgtgcgagtacttcagccagcacctgggcgagtacgagaacgtgctggccgccctggaggacctgaacctgagcatcctgaaggccatgggcaagaccaagaaggactaccaggaggccagcaacctggagcagttcgtgaccagattcctgctgaaggagaccctgaaccagctgcagagcctgcagaacagcctggagtgcgccatggagaccaccgaggagcagaccagacaggagagacagggccccgccaagcccgaggtgctgagcatccagtggcccggcaagagaagcagcagaagagtgcagagacacaacagcttcagccccaacagcccccagttcaacgtgagcggccccggcctgctggaggaggacaaccagtggatgacccagatcaacagactgcagaagctgatcgacagactggagaagaaggacctgaagctggagccccccgaggaggagatcatcgagggcaacaccaagagccacatcatgctggtgcagagacagatgagcgtgatcgaggaggacctggaggagttccagctggccctgaagcactacgtggagagcgccagcagccagagcggctgcctgagaatcagcatccagaagctgagcaacgagagcagatacatgatctacgagttctgggagaacagcagcgtgtggaacagccacctgcagaccaactacagcaagaccttccagagaagcaacgtggacttcctggagacccccgagctgaccagcaccatgctggtgcccgccagctggtggatcctgaacaactag

SEQ ID NO: 20115 - DNA, 303 bp, Artificial Sequence
  Description of Artificial Sequence: Synthetic coding sequence
atgctggtgcagagacagatgagcgtgatcgaggaggacctggaggagttccagctggccctgaagcactacgtggagagcgccagcagccagagcggctgcctgagaatcagcatccagaagctgagcaacgagagcagatacatgatctacgagttctgggagaacagcagcgtgtggaacagccacctgcagaccaactacagcaagaccttccagagaagcaacgtggacttcctggagacccccgagctgaccagcaccatgctggtgcccgccagctggtggatcctgaacaactag

SEQ ID NO: 20116 - DNA, 303 bp, Artificial Sequence; identical to SEQ ID NO: 20115
  Description of Artificial Sequence: Synthetic coding sequence

SEQ ID NO: 20117 - DNA, 2499 bp, Artificial Sequence
  Description of Artificial Sequence: Synthetic coding sequence
atgcacaagcactacaaggtgcacttcgccaaggacgcccagagccccaacggccactacttctgggaccccgagctgggccacagaaagggctgctgccaccagtggagacaggacagcgccgccctgagagcccacggcccctgcagacccagcccccagagccactggcagctggcctaccacagccaccaggtgggcggcagcggctggagaagaggcctgctgcccagcgtgctgcagcagcagagacagccccagagccagcccagcccccccagccccctgagacagagactgtgccccatccacgaggcccagaagggcctgcccgccaccagcaccgtgcccaaggagcccgccagcgccccccaggcccccaccctgcccaccaccgcccccgccatggccagaagcggccccgccctgcccagcgccgccggcgtgctgctgaagcccagcgagcccaccgacgccagacccctgcccgcccccgccgcctgcggcagcttcaccgcctacagcagcgacatcctgaccgaggacgacgtgtactgcagctgcctggccaagaccctgtgccacgtgcccgtgcccgtgaccgtgggcttctacgcccccttcggctgcagactgcacatgatgctggacaagatcaccgccctgatgcagcaggaggccgcccagagagagagcgaggagctgcagcacgtgcagtggagacccagagccgtgagcggctggggcgtgccccagctgctgtggtacctggtgttcctgcagcccatcatcaccgaggtgcacctgagaagaagaaacgtgcagttcctgttcatcagattcagcgcctggcagtacgccggcaccgacaagctgtgggccggcctggtgaccaccctgtgcgagggcatcagaagacactacggcgccctgcccttcagcgtgtacagcgtgctgggcaacaagcccgccaccagacaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgttcggcggcgccgccaccaccctgagcggcagcggcctgctgatggccgtgtacagcgtgggcaagcacctgttcgtgagccagagaaagaagatcgagagactggtgagcagagagaagttcggcagccagctgggcttcatgtgcgaggtgaagaaggaggtggagctgctgaccgacttcctgtgcttcctggagatctaccagagaagaagactgagagtggtgctggaggtgaccggcctggacacctgctaccccgagagagtggtgggcgtgctgaacgccatcaacaccctgctgagcgacagccacgcccccttcatcttcatcctggtggtggaccccagcatcctggccgcctgcctggagagcgccggcaacatgaagggcaccgccgacaacggctacctgttcctgaacagaaccgtgaccctgcccttcagcgtgcccatcatgggcagaagaaccaagctgcagttcctgcacgacgccgtgcagagcagagacgacctgctgtacagagagatgaccagaaagccctggctgcccggcgacgccggcggcgagagcgcccagctgctggccgtgcaggcccaggccggcaccgagagaggccagggcagaatcgacgacgaggccgccagaagaatccaggaggccctgttctgcctgcacgacgagagagactgcctgtacgagtacgtgcccgacaacgtggtgagcatgagaagaatcgtgaacaccgtgcccatcaccgtgagactgctgcagcagcagcagcagcagggcgacttcggcggccccacccccagacaggccgtggcctgggtggtgctggccaaccagtggccctgcagactgagctgggccctgcagtgcctggaggacagacagcagaccggcggcgcccccgagggcagagccagactgtgggacgtgttcagagacaacagcagagagctgcacaccatgaccaaggccctgcagaacgtgctggacctggacggcgaccccgagctgttcgagagattcctgggcgccgacttccccttcaccgtggccgaggcccagagcctgctgagatgcaccgtgaacctggaccacagcatcagaagaagaatgggcctgatcagagccgtgagcgccctgaagccccccagcccccccaagagccccaccagagacaccccccacgccgcccacagagccaacagcgccagcagagccccccccagcggcagagccagcggccaggccggcgagggccaccacaccggcgacctggcccacagaggcaagctgtggcccgtggcctgcgccctgttcagacccggccagagcagccccggcggcccctag

SEQ ID NO: 20118 - DNA, 1596 bp, Artificial Sequence
  Description of Artificial Sequence: Synthetic coding sequence
atgcagcaggaggccgcccagagagagagcgaggagctgcagcacgtgcagtggagacccagagccgtgagcggctggggcgtgccccagctgctgtggtacctggtgttcctgcagcccatcatcaccgaggtgcacctgagaagaagaaacgtgcagttcctgttcatcagattcagcgcctggcagtacgccggcaccgacaagctgtgggccggcctggtgaccaccctgtgcgagggcatcagaagacactacggcgccctgcccttcagcgtgtacagcgtgctgggcaacaagcccgccaccagacaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgttcggcggcgccgccaccaccctgagcggcagcggcctgctgatggccgtgtacagcgtgggcaagcacctgttcgtgagccagagaaagaagatcgagagactggtgagcagagagaagttcggcagccagctgggcttcatgtgcgaggtgaagaaggaggtggagctgctgaccgacttcctgtgcttcctggagatctaccagagaagaagactgagagtggtgctggaggtgaccggcctggacacctgctaccccgagagagtggtgggcgtgctgaacgccatcaacaccctgctgagcgacagccacgcccccttcatcttcatcctggtggtggaccccagcatcctggccgcctgcctggagagcgccggcaacatgaagggcaccgccgacaacggctacctgttcctgaacagaaccgtgaccctgcccttcagcgtgcccatcatgggcagaagaaccaagctgcagttcctgcacgacgccgtgcagagcagagacgacctgctgtacagagagatgaccagaaagccctggctgcccggcgacgccggcggcgagagcgcccagctgctggccgtgcaggcccaggccggcaccgagagaggccagggcagaatcgacgacgaggccgccagaagaatccaggaggccctgttctgcctgcacgacgagagagactgcctgtacgagtacgtgcccgacaacgtggtgagcatgagaagaatcgtgaacaccgtgcccatcaccgtgagactgctgcagcagcagcagcagcagggcgacttcggcggccccacccccagacaggccgtggcctgggtggtgctggccaaccagtggccctgcagactgagctgggccctgcagtgcctggaggacagacagcagaccggcggcgcccccgagggcagagccagactgtgggacgtgttcagagacaccccccacgccgcccacagagccaacagcgccagcagagccccccccagcggcagagccagcggccaggccggcgagggccaccacaccggcgacctggcccacagaggcaagctgtggcccgtggcctgcgccctgttcagacccggccagagcagccccggcggcccctag

SEQ ID NO: 20119 - DNA, 1833 bp, Artificial Sequence
  Description of Artificial Sequence: Synthetic coding sequence
atgcagcaggaggccgcccagagagagagcgaggagctgcagcacgtgcagtggagacccagagccgtgagcggctggggcgtgccccagctgctgtggtacctggtgttcctgcagcccatcatcaccgaggtgcacctgagaagaagaaacgtgcagttcctgttcatcagattcagcgcctggcagtacgccggcaccgacaagctgtgggccggcctggtgaccaccctgtgcgagggcatcagaagacactacggcgccctgcccttcagcgtgtacagcgtgctgggcaacaagcccgccaccagacaggactgctgccagagcgagtggcactgcagaagaagagtgtgcctgggcctgctggccctgctggccgccctgggcctgggcgtgggcctgctgtacctgagcctgggcggccacgccctgggccacggcagccccagcggcagcctgctgaaggtgttcggcggcgccgccaccaccctgagcggcagcggcctgctgatggccgtgtacagcgtgggcaagcacctgttcgtgagccagagaaagaagatcgagagactggtgagcagagagaagttcggcagccagctgggcttcatgtgcgaggtgaagaaggaggtggagctgctgaccgacttcctgtgcttcctggagatctaccagagaagaagactgagagtggtgctggaggtgaccggcctggacacctgctaccccgagagagtggtgggcgtgctgaacgccatcaacaccctgctgagcgacagccacgcccccttcatcttcatcctggtggtggaccccagcatcctggccgcctgcctggagagcgccggcaacatgaagggcaccgccgacaacggctacctgttcctgaacagaaccgtgaccctgcccttcagcgtgcccatcatgggcagaagaaccaagctgcagttcctgcacgacgccgtgcagagcagagacgacctgctgtacagagagatgaccagaaagccctggctgcccggcgacgccggcggcgagagcgcccagctgctggccgtgcaggcccaggccggcaccgagagaggccagggcagaatcgacgacgaggccgccagaagaatccaggaggccctgttctgcctgcacgacgagagagactgcctgtacgagtacgtgcccgacaacgtggtgagcatgagaagaatcgtgaacaccgtgcccatcaccgtgagactgctgcagcagcagcagcagcagggcgacttcggcggccccacccccagacaggccgtggcctgggtggtgctggccaaccagtggccctgcagactgagctgggccctgcagtgcctggaggacagacagcagaccggcggcgcccccgagggcagagccagactgtgggacgtgttcagagacaacagcagagagctgcacaccatgaccaaggccctgcagaacgtgctggacctggacggcgaccccgagctgttcgagagattcctgggcgccgacttccccttcaccgtggccgaggcccagagcctgctgagatgcaccgtgaacctggaccacagcatcagaagaagaatgggcctgatcagagccgtgagcgccctgaagccccccagcccccccaagagccccaccagagacaccccccacgccgcccacagagccaacagcgccagcagagccccccccagcggcagagccagcggccaggccggcgagggccaccacaccggcgacctggcccacagaggcaagctgtggcccgtggcctgcgccctgttcagacccggccagagcagccccggcggcccctag

SEQ ID NO: 20120 - DNA, 1062 bp, Artificial Sequence
  Description of Artificial Sequence: Synthetic coding sequence
atgagactgagattctggctgctgatctggctgctgctgggcttcatcagccaccagcccacccccgtgagcttcctgaagaccatcttctggagcagaaacggccacgacggcagcatggacgtgcagcagagagcctggagaagcaacagaagcagacagaagggcctgagaagcatctgcatgcacaccaagaagagagtgagcagcttcagaggcaacaagatcggcctgaaggacgtgatcaccctgagaagacacgtggagaccaaggtgagagccaagatcagaaagagaaaggtgaccaccaagatcaacagacacgacaagatcaacggcaagagaaagaccgccagaaagcagaagatgttccagagagcccaggagctgagaagaagagccgaggactaccacaagtgcaagatcccccccagcgccagaaagcccctgtgcaactgggtgagaatggccgccgccgagcacagacacagcagcggcctgccctactggctgtacctgaccgccgagaccctgaagaacagaatgggcagacagccccccccccccacccagcagcacagcatcaccgacaacagcctgagcctgaagaccccccccgagtgcctgctgacccccctgccccccagcgtggacgacaacatcaaggagtgccccctggcccccctgccccccagccccctgccccccagcgtggacgacaacctgaaggagtgcctgttcgtgcccctgccccccagccccctgccccccagcgtggacgacaacctgaaggagtgcctgttcgtgcccctgccccccagccccctgccccccagcgtggacgacaacctgaagaccccccccctggccacccaggaggccgaggtggagaagccccccaagcccaagagatggagagtggacgaggtggagcagagccccaagcccaagagacagagagaggccgaggcccagcagctgcccaagcccaagagaagaagactgagcaagctgagaaccagacactgcacccaggcctgggccatcagaatcaacccctag

SEQ ID NO: 20121 - DNA, 1827 bp, Artificial Sequence
  Description of Artificial Sequence: Synthetic coding sequence
atggccgagagcatcatcatcagagtgcagagccccgacggcgtgaagagaatcaccgccaccaagagagagaccgccgccaccttcctgaagaaggtggccaaggagttcggcttccagaacaacggcttcagcgtgtacatcaacagaaacaagaccggcgagatcaccgccagcagcaacaagagcctgaacctgctgaagatcaagcacggcgacctgctgttcctgttccccagcagcctggccggccccagcagcgagatggagaccagcgtgccccccggcttcaaggtgttcggcgcccccaacgtggtggaggacgagatcgaccagtacctgagcaagcaggacggcaagatctacagaagcagagacccccagctgtgcagacacggccccctgggcaagtgcgtgcactgcgtgcccctggagcccttcgacgaggactacctgaaccacctggagccccccgtgaagcacatgagcttccacgcctacatcagaaagctgaccggcggcgccgacaagggcaagttcgtggccctggagaacatcagctgcaagatcaagagcggctgcgagggccacctgccctggcccaacggcatctgcaccaagtgccagcccagcgccatcaccctgaacagacagaagtacagacacgtggacaacatcatgttcgagaaccacaccgtggccgacagattcctggacttctggagaaagaccggcaaccagcacttcggctacctgtacggcagatacaccgagcacaaggacatccccctgggcatcagagccgaggtggccgccatctacgagcccccccagatcggcacccagaacagcctggagctgctggaggaccccaaggccgaggtggtggacgagatcgccgccaagctgggcctgagaaaggtgggctggatcttcaccgacctggtgagcgaggacaccagaaagggcaccgtgagatacagcagaaacaaggacacctacttcctgagcagcgaggagtgcatcaccgccggcgacttccagaacaagcaccccaacatgtgcagactgagccccgacggccacttcggcagcaagttcgtgaccgccgtggccaccggcggccccgacaaccaggtgcacttcgagggctaccaggtgagcaaccagtgcatggccctggtgagagacgagtgcctgctgccctgcaaggacgcccccgagctgggctacgccaaggagagcagcagcgagcagtacgtgcccgacgtgttctacaaggacgtggacaagttcggcaacgagatcacccagctggccagacccctgcccgtggagtacctgatcatcgacatcaccaccaccttccccaaggaccccgtgtacaccttcagcatcagccagaaccccttccccatcgagaacagagacgtgctgggcgagacccaggacttccacagcctggccacctacctgagccagaacaccagcagcgtgttcctggacaccatcagcgacttccacctgctgctgttcctggtgaccaacgaggtgatgcccctgcaggacagcatcagcctgctgctggaggccgtgagaaccagaaacgaggagctggcccagacctggaagagaagcgagcagtgggccaccatcgagcagctgtgcagcaccgtgggcggccagctgcccggcctgcacgagtacggcgccgtgggcggcagcacccacaccgccaccgccgccatgtgggcctgccagcactgcaccttcatgaaccagcccggcaccggccactgcgagatgtgcagcctgcccagaacctag

SEQ ID NO: 20122 - DNA, 1851 bp, Artificial Sequence
  Description of Artificial Sequence: Synthetic coding sequence
gccgaggtggtgatcatcagagtgcagagccccgacggcgtgaagagaatcaccgccaccaagagagagaccgccgccaccttcctgaagaaggtggccaaggagttcggcttccagaacaacggcttcagcgtgtacatcaacagaaacaagaccggcgagatcaccgccagcagcaacaagagcctgaacctgctgaagatcaagcacggcgacctgctgttcctgttccccagcagcctggccggccccagcagcgagatggagaccagcgtgccccccggcttcaaggtgttcggcgcccccaacgtggtggaggacgagatcgaccagtacctgagcaagcaggacggcaagatctacagaagcagagacccccagctgtgcagacacggccccctgggcaagtgcgtgcactgcgtgcccctggagcccttcgacgaggactacctgaaccacctggagccccccgtgaagcacatgagcttccacgcctacatcagaaagctgaccggcggcgccgacaagggcaagttcgtggccctggagaacatcagctgcaagatcaagagcggctgcgagggccacctgccctggcccaacggcatctgcaccaagtgccagcccagcgccatcaccctgaacagacagaagtacagacacgtggacaacatcatgttcgagaaccacaccgtggccgacagattcctggacttctggagaaagaccggcaaccagcacttcggctacctgtacggcagatacaccgagcacaaggacatccccctgggcatcagagccgaggtggccgccatctacgagcccccccagatcggcacccagaacagcctggagctgctggaggaccccaaggccgaggtggtggacgagatcgccgccaagctgggcctgagaaaggtgggctggatcttcaccgacctggtgagcgaggacaccagaaagggcaccgtgagatacagcagaaacaaggacacctacttcctgagcagcgaggagtgcatcaccgccggcgacttccagaacaagcaccccaacatgtgcagactgagccccgacggccacttcggcagcaagttcgtgaccgccgtggccaccggcggccccgacaaccaggtgcacttcgagggctaccaggtgagcaaccagtgcatggccctggtgagagacgagtgcctgctgccctgcaaggacgcccccgagctgggctacgccaaggagagcagcagcgagcagtacgtgcccgacgtgttctacaaggacgtggacaagttcggcaacgagatcacccagctggccagacccctgcccgtggagtacctgatcatcgacatcaccaccaccttccccaaggaccccgtgtacaccttcagcatcagccagaaccccttccccatcgagaacagagacgtgctgggcgagacccaggacttccacagcctggccacctacctgagccagaacaccagcagcgtgttcctggacaccatcagcgacttccacctgctgctgttcctggtgaccaacgaggtgatgcccctgcaggacagcatcagcctgctgctggaggccgtgagaaccagaaacgaggagctggcccagacctggaagagaagcgagcagtgggccaccatcgagcagctgtgcagcgagtacccccaccccctgcccagacaccccgtggccggcgccggcgagcagcccaccctgcacagcagccccctgcccgtggtgccctggatcccccaccccgccgccagctggcaggtgcccagcgccatgcagagagtggagaccagacccccctgccaggccagaggcagactgagatag

SEQ ID NO: 20123 - DNA, 1371 bp, Artificial Sequence
  Description of Artificial Sequence: Synthetic coding sequence
atgagcttccacgcctacatcagaaagctgaccggcggcgccgacaagggcaagttcgtggccctggagaacatcagctgcaagatcaagagcggctgcgagggccacctgccctggcccaacggcatctgcaccaagtgccagcccagcgccatcaccctgaacagacagaagtacagacacgtggacaacatcatgttcgagaaccacaccgtggccgacagattcctggacttctggagaaagaccggcaaccagcacttcggctacctgtacggcagatacaccgagcacaaggacatccccctgggcatcagagccgaggtggccgccatctacgagcccccccagatcggcacccagaacagcctggagctgctggaggaccccaaggccgaggtggtggacgagatcgccgccaagctgggcctgagaaaggtgggctggatcttcaccgacctggtgagcgaggacaccagaaagggcaccgtgagatacagcagaaacaaggacacctacttcctgagcagcgaggagtgcatcaccgccggcgacttccagaacaagcaccccaacatgtgcagactgagccccgacggccacttcggcagcaagttcgtgaccgccgtggccaccggcggccccgacaaccaggtgcacttcgagggctaccaggtgagcaaccagtgcatggccctggtgagagacgagtgcctgctgccctgcaaggacgcccccgagctgggctacgccaaggagagcagcagcgagcagtacgtgcccgacgtgttctacaaggacgtggacaagttcggcaacgagatcacccagctggccagacccctgcccgtggagtacctgatcatcgacatcaccaccaccttccccaaggaccccgtgtacaccttcagcatcagccagaaccccttccccatcgagaacagagacgtgctgggcgagacccaggacttccacagcctggccacctacctgagccagaacaccagcagcgtgttcctggacaccatcagcgacttccacctgctgctgttcctggtgaccaacgaggtgatgcccctgcaggacagcatcagcctgctgctggaggccgtgagaaccagaaacgaggagctggcccagacctggaagagaagcgagcagtgggccaccatcgagcagctgtgcagcgagtacccccaccccctgcccagacaccccgtggccggcgccggcgagcagcccaccctgcacagcagccccctgcccgtggtgccctggatcccccaccccgccgccagctggcaggtgcccagcgccatgcagagagtggagaccagacccccctgccaggccagaggcagactgagatag

SEQ ID NO: 20124 - DNA, 2202 bp, Artificial Sequence
  Description of Artificial Sequence: Synthetic coding sequence
atggaggccagctggagacaggtggccggcggcagaggcagaagcagaggcagagccaccgccgcccccagcggcaacggcgtgcacctgagaggcgccggcggcggcagagagaagggcagcgtgggcgccgtgcccagcggcaccagccccggcggcgtggccaccaccgccgccgccggcagcagacacagccccgccggcagccaggccctgcagaccaccgccgccagcgagctgatgagccagaagaagttcgaggagatcaagaaggccaaccaggccgccgccagaaagctggtggaggagcagttcagcagcagcagcgaggagggcgacgaggacttcgagggcaagcagggcaagatcctggccaacaccttcatcacctacaccacccagaccgacggcgacaccagagagctggagagaaccaagcagtacgtgaacgaggccttccaggccggcgccatgacctgcctgatctgcatcgccagcgtgaagagaaaccaggccgtgtggagctgcagcggctgcttctgcatcttccacatgccctgcatccagaagtgggccaaggacagccagttcctggtgagcagcgtgaccgacgacgacttcggcaagaaggactgcccctggccctgccccaagtgcagattcgagtacaagagaagcgagacccccagcagatactactgctactgcggcaaggtggaggacccccccctggacccctggctggtgccccacagctgcggccaggtgtgcgagagagagttcaagcccccctgcggccacaagtgcctgctgctgtgccaccccggcccctgccccccctgccccaagatggtgaccaccacctgctactgcaagaaggccaagcccatccccagaagatgcagcgccaaggagtggagctgccagctgccctgcggccagaagctgctgtgcggccagcacaagtgcgagaacccctgccacgccggcagctgccagccctgccccagagtgagcagacagaagtgcgtgtgcggcaagaaggtggccgagagaagctgcgccagccccctgtggcactgcgaccaggtgtgcggcaagaccctgccctgcggcaaccacacctgcgagcaggtgtgccacgtgggcgcctgcggcgagtgccccagaagcggcaagagattctgcccctgccagaagagcaagttcagcctgccctgcaccgaggacgtgcccacctgcggcgacagctgcgacaaggtgctggagtgcggcatccacagatgcagccagagatgccacagaggcccctgcgagacctgcagacaggaggtggagaagcactgcagatgcggcaagcacaccaagagaatgccctgccacaagccctacctgtgcgagaccaagtgcgtgaagatgagagactgccagaagcaccagtgcagaagaaagtgctgccccggcaactgccccccctgcgaccagaactgcggcagaaccctgggctgcagaaaccacaagtgccccagcgtgtgccacagaggcagctgctacccctgccccgagaccgtggacgtgaagtgcaactgcggcaacaccaaggtgaccgtgccctgcggcagagagagaaccaccagaccccccaagtgcaaggagcagtgcagcagaccccccacctgccaccacaccagccaggagaagcacagatgccacttcggcagctgccccccctgccaccagccctgccagaaggtgctggagaagtgcggccacctgtgccccgccccctgccacgaccaggccctgatcaagcagaccggcagacaccagcccaccggcccctgggagcagcccagcgagcccgccttcatccagaccgccctgccctgccccccctgccaggtgcccatccccatggagtgcctgggcaagcacgaggtgagccccctgccctgccacgccgtgggcccctacagctgcaagagagtgtgcggcagaatcctggactgccagaaccacacctgcatgaaggagtgccacaaggtgaccaagaccgacggctgcaccggcaagaacaagatcggcaagctgaagctgtgcgacctgagcatgatcctgcagcaggagagcagcaagagcgagagcaccgtgcccgacctgctgacccccagccccatgtgcagcagcacccacgtgatctag

SEQ ID NO: 20125 - DNA, 2736 bp, Artificial Sequence
  Description of Artificial Sequence: Synthetic coding sequence
atggaggccagctggagacaggtggccggcggcagaggcagaagcagaggcagagccaccgccgcccccagcggcaacggcgtgcacctgagaggcgccggcggcggcagagagaagggcagcgtgggcgccgtgcccagcggcaccagccccggcggcgtggccaccaccgccgccgccggcagcagacacagccccgccggcagccaggccctgcagaccaccgccgccagcgagctgatgagccagaagaagttcgaggagatcaagaaggccaaccaggccgccgccagaaagctggtggaggagcagttcagcagcagcagcgaggagggcgacgaggacttcgagggcaagcagggcaagatcctggccaacaccttcatcacctacaccacccagaccgacggcgacaccagagagctggagagaaccaagcagtacgtgaacgaggccttccaggccggcgccatgacctgcctgatctgcatcgccagcgtgaagagaaaccaggccgtgtggagctgcagcggctgcttctgcatcttccacatgccctgcatccagaagtgggccaaggacagccagttcctggtgagcagcgtgaccgacgacgacttcggcaagaaggactgcccctggccctgccccaagtgcagattcgagtacaagagaagcgagacccccagcagatactactgctactgcggcaaggtggaggacccccccctggacccctggctggtgccccacagctgcggccaggtgtgcgagagagagttcaagcccccctgcggccacaagtgcctgctgctgtgccaccccggcccctgccccccctgccccaagatggtgaccaccacctgctactgcaagaaggccaagcccatccccagaagatgcagcgccaaggagtggagctgccagctgccctgcggccagaagctgctgtgcggccagcacaagtgcgagaacccctgccacgccggcagctgccagccctgccccagagtgagcagacagaagtgcgtgtgcggcaagaaggtggccgagagaagctgcgccagccccctgtggcactgcgaccaggtgtgcggcaagaccctgccctgcggcaaccacacctgcgagcaggtgtgccacgtgggcgcctgcggcgagtgccccagaagcggcaagagattctgcccctgccagaagagcaagttcagcctgccctgcaccgaggacgtgcccacctgcggcgacagctgcgacaaggtgctggagtgcggcatccacagatgcagccagagatgccacagaggcccctgcgagacctgcagacaggaggtggagaagcactgcagatgcggcaagcacaccaagagaatgccctgccacaagccctacctgtgcgagaccaagtgcgtgaagatgagagactgccagaagcaccagtgcagaagaaagtgctgccccggcaactgccccccctgcgaccagaactgcggcagaaccctgggctgcagaaaccacaagtgccccagcgtgtgccacagaggcagctgctacccctgccccgagaccgtggacgtgaagtgcaactgcggcaacaccaaggtgaccgtgccctgcggcagagagagaaccaccagaccccccaagtgcaaggagcagtgcagcagaccccccacctgccaccacaccagccaggagaagcacagatgccacttcggcagctgccccccctgccaccagccctgccagaaggtgctggagaagtgcggccacctgtgccccgccccctgccacgaccaggccctgatcaagcagaccggcagacaccagcccaccggcccctgggagcagcccagcgagcccgccttcatccagaccgccctgccctgccccccctgccaggtgcccatccccatggagtgcctgggcaagcacgaggtgagccccctgccctgccacgccgtgggcccctacagctgcaagagagtgtgcggcagaatcctggactgccagaaccacacctgcatgaaggagtgccacaaggtgaccaagaccgacggctgcaccggcaagaacaaggccggccccgagtgcctgcactgcgaggagggctgcagcaagagcagacccctgggctgcctgcacccctgcatcctgagatgccaccccggcgagtgccccccctgcgtgcagatgctgagaatcaagtgccactgcaagatcaccagcctgtacgtggagtgcagaaagatcaccaccgccgacgtgaacgagaagaacctgctgagctgctgcaagaaccagtgccccaaggagctgccctgcggccacagatgcaaggagatgtgccaccccggcgagtgccccttcaactgcaaccagaaggtgaagctgagatgcccctgcaagagaatcaagaaggagctgcagtgcaacaaggtgagagagaaccaggtgagcatcgagtgcgacaccacctgcaaggagatgaagagaaaggccagcgagatcaaggaggccgaggccaaggccgccctggaggaggagaagagaagacagcaggccgagctggaggccttcgagaacagactgaagggcagaagaaagaagaacagaaagagagacgaggtggccgtggagctgagcctgtggcagaagcacaagtactacctgatcagcgtgtgcggcgtggtggtggtggtgttcgcctggtacatcacccacgacgtgaactag

SEQ ID NO: 20126 - DNA, 2736 bp, Artificial Sequence; identical to SEQ ID NO: 20125
  Description of Artificial Sequence: Synthetic coding sequence

SEQ ID NO: 20127 - DNA, 5211 bp, Artificial Sequence
  Description of Artificial Sequence: Synthetic coding sequence
atgaccggctgccccgccagcagcagaagaagaggcttcggcctgttcttcttcctgagactgcacagactgctgctgctgttcctggtgctgagaggcaccctggccaacaagctgaacgtgccccaggtgctgctgcccttcggcagagagcccggcagagtgcccttcctgctggaggcccagagaggctgctacacctggcacagcacccaccacgacgccgtgaccgtggagcccctgtacgagaacggcaccctgtgcagccagaaggccgtgctgatcgccgagagcacccagcccatcagactgagcagcatcatcctggccagagagatcgtgaccgaccacgagctgagatgcgacgtgaaggtggacgtgatcaacagcatcgagatcgtgagcagagccagagagctgtacgtggacgacagccccctggagctgatggtgagagccctggacgccgagggcaacaccttcagcagcctggccggcatgatgttcgagtggagcatcgcccaggacaacgagagcgccagagaggagctgagcagcaagatcagaatcctgaagtacagcgaggccgagtacgccccccccatctacatcgccgagatggagaaggaggagaagcagggcgacgtgatcctggtgagcggcatcagaaccggcgccgccgtggtgaaggtgagaatccacgagcccttctacaagaaggtggccgccgccctgatcagactgctggtgctggagaacatcttcctgatccccagccacgacatctacctgctggtgggcacctacatcaagtaccaggtggccaagatggtgcagggcagagtgaccgaggtgaagttccccctggagcactacatcctggagctgcaggaccacagagtggccctgaacggcagccacagcgagaaggtggccatcctggacgacaagaccgccatggtgaccgccagccagctgggccagaccaacctggtgttcgtgcacaagaacgtgcacatgagaagcgtgagcggcctgcccaactgcaccatctacgtggtggagcccggcttcctgggcttcaccgtgcagcccggcaacagatggagcctggaggtgggccaggtgtacgtgatcaccgtggacgtgttcgacaagagcagcaccaaggtgtacatcagcgacaacctgagaatcacctacgacttccccaaggagtacttcgaggagcagctgaccaccgtgaacggcagctaccacatcgtgaaggccctgaaggacggcgtggtggtgatcaacgccagcctgaccagcatcatctaccagaacaaggacatccagcccatcaagttcctgatcaagcaccagcaggaggtgaagatctacttccccatcatgctgacccccaagttcctggccttcccccaccaccccatgggcatgctgtacagatacaaggtgcaggtggagggcggcagcggcaacttcacctggaccagcagcaacgagaccgtggtgatcgtgaccaccaagggcgtggtgaccgccggccaggtgagaggcaacagcaccgtgctggccagagacgtgcagaaccccttcagatacggcgagatcaagatccacgtgctgaagctgaacaagatggagctgctgcccttccacgccgacgtggagatcggccagatcatcgagatccccatcgccatgtaccacatcaacaaggagaccaaggaggccatggccttcaccgactgcagccacctgagcctggacctgaacatggacaagcagggcgtgttcaccctgctgaaggagggcatccagagacccggccccatgcactgcagcagcacccacatcgccgccaagagcctgggccacaccctggtgaccgtgagcgtgaacgagtgcgacaagtacctggagagcagcgccaccttcgccgcctacgagcccctgaaggccctgaaccccgtggaggtggccctggtgacctggcagagcgtgaaggagatggtgttcgagggcggccccagaccctggatcctggagcccagcagattcttcctggagctgaacgccgagaagaccgagaagatcggcatcgcccaggtgtggctgcccagcaagagaaagcagaaccagtacatctacagaatccagtgcctggacctgggcgagcaggtgctgaccttcagaatcggcaaccaccccggcgtgctgaaccccagccccgccgtggaggtgctgcaggtgagattcatctgcgcccaccccgccagcatgagcgtgacccccgtgtacaaggtgcccgccggcgcccagccctgccccctgccccagcacaacaagtggctgatccccgtgagcagactgagagacaccgtgctggagctggccgtgttcgaccagcacagaagaaagttcgacaacttcagcagcctgatgctggagtggaagagcagcaacgagaccctggcccacttcgaggactacaagagcgtggagatggtggccaaggacgacggcagcggccagaccagactgcacggccaccagatcctgaaggtgcaccagatcaagggcaccgtgctgatcggcgtgaacttcgtgggctacagcgagaagaagagccccaaggagatcagcaacctgcccagaagcgtggacgtggagctgctgctggtggacgacgtgaccgtggtgcccgagaacgccaccatctacaaccaccccgacgtgaaggagaccttcagcctggtggagggcagcggctacttcctggtgaacagcagcgagcagggcgtggtgaccatcacctacatggaggccgagagcagcgtggagctggtgcccctgcaccccggcttcttcaccctggaggtgtacgacctgtgcctggccttcctgggccccgccaccgcccacctgagagtgagcgacatccaggagctggagctggacctgatcgacaaggtggagatcgacaagaccgtgctggtgaccgtgagagtgctgggcagcagcaagagacccttccagaacaagtacttcagaaacatggagctgaagctgcagctggccagcgccatcgtgaccctgacccccatggagcagcaggacgagtacagcgagaactacatcctgagagccaccaccatcggccagaccaccctggtggccatcgccaaggacaagatgggcagaaagtacaccagcacccccagacacatcgaggtgttcccccccttcagactgctgcccgagaagatgaccctgatccccatgaacatgatgcaggtgatgagcgagggcggcccccagccccagagcatcgtgcacttcagcatcagcaaccagaccgtggccgtggtgaacagaagaggccaggtgaccggcaagatcgtgggcaccgccgtggtgcacggcaccatccagaccgtgaacgaggacaccggcaaggtgatcgtgttcagccaggacgaggtgcagatcgaggtggtgcagctgagagccgtgagaatcctggccgccgccaccagactgatcaccgccaccaagatgcccgtgtacgtgatgggcgtgaccagcacccagacccccttcagcttcagcaacgccaaccccggcctgaccttccactggagcatgagcaagagagacgtgctggacctggtgcccagacacagcgaggtgttcctgcagctgcccgtggagcacaacttcgccatggtggtgcacaccaaggccgccggcagaaccagcatcaaggtgaccgtgcactgcatgaacagcagcagcggccagttcgagggcaacctgctggagctgagcgacgaggtgcagatcctggtgttcgagaagctgcagctgttctaccccgagtgccagcccgagcagatcctgatgcccatcaacagccagctgaagctgcacaccaacagagagggcgccgccttcgtgagcagcagagtgctgaagtgcttccccaacagcagcgtgatcgaggaggacggcgagggcctgctgaaggccggcagcatcgccggcaccgccgtgctggaggtgaccagcatcgagcccttcggcgtgaaccagaccaccatcaccggcgtgcaggtggcccccgtgacctacctgagagtgagcagccagcccaagctgtacaccgcccagggcagaaccctgagcgccttccccctgggcatgagcctgaccttcaccgtgcagttctacaacagcatcggcgagaagttccacacccacaacacccagctgtacctggccctgaacagagacgacctgctgcacatcggccccggcaacaagaactacacctacatggcccaggccgtgaacagaggcctgaccctggtgggcctgtgggacagaagacaccccggcatggccgactacatccccgtggccgtggagcacgccatcgagcccgacaccaagctgaccttcgtgggcgacatcatctgcttcagcacccacctggtgagccagcacggcgagcccggcatctggatgatcagcgccaacaacatcctgcagaccgacatcgtgaccggcgtgggcgtggccagaagccccggcaccgccatgatcttccacgacatccccggcgtggtgaagacctacagagaggtggtggtgaacgccagcagcagactgatgctgagctacgacctgaagacctacctgaccaacaccctgaacagcaccgtgttcaagctgttcatcaccaccggcagaaacggcgtgaacctgaagggcttctgcacccccaaccaggccctggccatcaccaaggtgctgctgcccgccaccctgatgctgtgccacgtgcagttcagcaacaccctgctggacatccccgccagcaaggtgttccaggtgcacagcgacttcagcatggagaaggaccactgcgaggacagcgccatcctgaagagattcaccggcagctaccagatcctgctgctgaccctgttcgccgtgctggccagcaccgccagcatcttcctggcctacaacgccttcctgaacaagatccagaccgtgcccgtggtgtacgtgcccaccctgggcaccccccagcccggcttcttcaacagcaccagcagccccccccacttcatgagcctgcagccccccctggcccagagcagactgcagcactggctgtggagcatcagacactag

SEQ ID NO: 20128 - DNA, 2010 bp, Artificial Sequence
  Description of Artificial Sequence: Synthetic coding sequence
atgggcagaaagtacaccagcacccccagacacatcgaggtgttcccccccttcagactgctgcccgagaagatgaccctgatccccatgaacatgatgcaggtgatgagcgagggcggcccccagccccagagcatcgtgcacttcagcatcagcaaccagaccgtggccgtggtgaacagaagaggccaggtgaccggcaagatcgtgggcaccgccgtggtgcacggcaccatccagaccgtgaacgaggacaccggcaaggtgatcgtgttcagccaggacgaggtgcagatcgaggtggtgcagctgagagccgtgagaatcctggccgccgccaccagactgatcaccgccaccaagatgcccgtgtacgtgatgggcgtgaccagcacccagacccccttcagcttcagcaacgccaaccccggcctgaccttccactggagcatgagcaagagagacgtgctggacctggtgcccagacacagcgaggtgttcctgcagctgcccgtggagcacaacttcgccatggtggtgcacaccaaggccgccggcagaaccagcatcaaggtgaccgtgcactgcatgaacagcagcagcggccagttcgagggcaacctgctggagctgagcgacgaggtgcagatcctggtgttcgagaagctgcagctgttctaccccgagtgccagcccgagcagatcctgatgcccatcaacagccagctgaagctgcacaccaacagagagggcgccgccttcgtgagcagcagagtgctgaagtgcttccccaacagcagcgtgatcgaggaggacggcgagggcctgctgaaggccggcagcatcgccggcaccgccgtgctggaggtgaccagcatcgagcccttcggcgtgaaccagaccaccatcaccggcgtgcaggtggcccccgtgacctacctgagagtgagcagccagcccaagctgtacaccgcccagggcagaaccctgagcgccttccccctgggcatgagcctgaccttcaccgtgcagttctacaacagcatcggcgagaagttccacacccacaacacccagctgtacctggccctgaacagagacgacctgctgcacatcggccccggcaacaagaactacacctacatggcccaggccgtgaacagaggcctgaccctggtgggcctgtgggacagaagacaccccggcatggccgactacatccccgtggccgtggagcacgccatcgagcccgacaccaagctgaccttcgtgggcgacatcatctgcttcagcacccacctggtgagccagcacggcgagcccggcatctggatgatcagcgccaacaacatcctgcagaccgacatcgtgaccggcgtgggcgtggccagaagccccggcaccgccatgatcttccacgacatccccggcgtggtgaagacctacagagaggtggtggtgaacgccagcagcagactgatgctgagctacgacctgaagacctacctgaccaacaccctgaacagcaccgtgttcaagctgttcatcaccaccggcagaaacggcgtgaacctgaagggcttctgcacccccaaccaggccctggccatcaccaaggtgctgctgcccgccaccctgatgctgtgccacgtgcagttcagcaacaccctgctggacatccccgccagcaaggtgttccaggtgcacagcgacttcagcatggagaaggaccactgcgaggacagcgccatcctgaagagattcaccggcagctaccagatcctgctgctgaccctgttcgccgtgctggccagcaccgccagcatcttcctggcctacaacgccttcctgaacaagatccagaccgtgcccgtggtgtacgtgcccaccctgggcaccccccagcccggcttcttcaacagcaccagcagccccccccacttcatgagcctgcagccccccctggcccagagcagactgcagcactggctgtggagcatcagacactag

SEQ ID NO: 20129 - DNA, 5667 bp, Artificial Sequence
  Description of Artificial Sequence: Synthetic coding sequence
atgaccggctgccccgccagcagcagaagaagaggcttcggcctgttcttcttcctgagactgcacagactgctgctgctgttcctggtgctgagaggcaccctggccaacaagctgaacgtgccccaggtgctgctgcccttcggcagagagcccggcagagtgcccttcctgctggaggcccagagaggctgctacacctggcacagcacccaccacgacgccgtgaccgtggagcccctgtacgagaacggcaccctgtgcagccagaaggccgtgctgatcgccgagagcacccagcccatcagactgagcagcatcatcctggccagagagatcgtgaccgaccacgagctgagatgcgacgtgaaggtggacgtgatcaacagcatcgagatcgtgagcagagccagagagctgtacgtggacgacagccccctggagctgatggtgagagccctggacgccgagggcaacaccttcagcagcctggccggcatgatgttcgagtggagcatcgcccaggacaacgagagcgccagagaggagctgagcagcaagatcagaatcctgaagtacagcgaggccgagtacgccccccccatctacatcgccgagatggagaaggaggagaagcagggcgacgtgatcctggtgagcggcatcagaaccggcgccgccgtggtgaaggtgagaatccacgagcccttctacaagaaggtggccgccgccctgatcagactgctggtgctggagaacatcttcctgatccccagccacgacatctacctgctggtgggcacctacatcaagtaccaggtggccaagatggtgcagggcagagtgaccgaggtgaagttccccctggagcactacatcctggagctgcaggaccacagagtggccctgaacggcagccacagcgagaaggtggccatcctggacgacaagaccgccatggtgaccgccagccagctgggccagaccaacctggtgttcgtgcacaagaacgtgcacatgagaagcgtgagcggcctgcccaactgcaccatctacgtggtggagcccggcttcctgggcttcaccgtgcagcccggcaacagatggagcctggaggtgggccaggtgtacgtgatcaccgtggacgtgttcgacaagagcagcaccaaggtgtacatcagcgacaacctgagaatcacctacgacttccccaaggagtacttcgaggagcagctgaccaccgtgaacggcagctaccacatcgtgaaggccctgaaggacggcgtggtggtgatcaacgccagcctgaccagcatcatctaccagaacaaggacatccagcccatcaagttcctgatcaagcaccagcaggaggtgaagatctacttccccatcatgctgacccccaagttcctggccttcccccaccaccccatgggcatgctgtacagatacaaggtgcaggtggagggcggcagcggcaacttcacctggaccagcagcaacgagaccgtggtgatcgtgaccaccaagggcgtggtgaccgccggccaggtgagaggcaacagcaccgtgctggccagagacgtgcagaaccccttcagatacggcgagatcaagatccacgtgctgaagctgaacaagatggagctgctgcccttccacgccgacgtggagatcggccagatcatcgagatccccatcgccatgtaccacatcaacaaggagaccaaggaggccatggccttcaccgactgcagccacctgagcctggacctgaacatggacaagcagggcgtgttcaccctgctgaaggagggcatccagagacccggccccatgcactgcagcagcacccacatcgccgccaagagcctgggccacaccctggtgaccgtgagcgtgaacgagtgcgacaagtacctggagagcagcgccaccttcgccgcctacgagcccctgaaggccctgaaccccgtggaggtggccctggtgacctggcagagcgtgaaggagatggtgttcgagggcggccccagaccctggatcctggagcccagcagattcttcctggagctgaacgccgagaagaccgagaagatcggcatcgcccaggtgtggctgcccagcaagagaaagcagaaccagtacatctacagaatccagtgcctggacctgggcgagcaggtgctgaccttcagaatcggcaaccaccccggcgtgctgaaccccagccccgccgtggaggtgctgcaggtgagattcatctgcgcccaccccgccagcatgagcgtgacccccgtgtacaaggtgcccgccggcgcccagccctgccccctgccccagcacaacaagtggctgatccccgtgagcagactgagagacaccgtgctggagctggccgtgttcgaccagcacagaagaaagttcgacaacttcagcagcctgatgctggagtggaagagcagcaacgagaccctggcccacttcgaggactacaagagcgtggagatggtggccaaggacgacggcagcggccagaccagactgcacggccaccagatcctgaaggtgcaccagatcaagggcaccgtgctgatcggcgtgaacttcgtgggctacagcgagaagaagagccccaaggagatcagcaacctgcccagaagcgtggacgtggagctgctgctggtggacgacgtgaccgtggtgcccgagaacgccaccatctacaaccaccccgacgtgaaggagaccttcagcctggtggagggcagcggctacttcctggtgaacagcagcgagcagggcgtggtgaccatcacctacatggaggccgagagcagcgtggagctggtgcccctgcaccccggcttcttcaccctggaggtgtacgacctgtgcctggccttcctgggccccgccaccgcccacctgagagtgagcgacatccaggagctggagctggacctgatcgacaaggtggagatcgacaagaccgtgctggtgaccgtgagagtgctgggcagcagcaagagacccttccagaacaagtacttcagaaacatggagctgaagctgcagctggccagcgccatcgtgaccctgacccccatggagcagcaggacgagtacagcgagaactacatcctgagagccaccaccatcggccagaccaccctggtggccatcgccaaggacaagatgggcagaaagtacaccagcacccccagacacatcgaggtgttcccccccttcagactgctgcccgagaagatgaccctgatccccatgaacatgatgcaggtgatgagcgagggcggcccccagccccagagcatcgtgcacttcagcatcagcaaccagaccgtggccgtggtgaacagaagaggccaggtgaccggcaagatcgtgggcaccgccgtggtgcacggcaccatccagaccgtgaacgaggacaccggcaaggtgatcgtgttcagccaggacgaggtgcagatcgaggtggtgcagctgagagccgtgagaatcctggccgccgccaccagactgatcaccgccaccaagatgcccgtgtacgtgatgggcgtgaccagcacccagacccccttcagcttcagcaacgccaaccccggcctgaccttccactggagcatgagcaagagagacgtgctggacctggtgcccagacacagcgaggtgttcctgcagctgcccgtggagcacaacttcgccatggtggtgcacaccaaggccgccggcagaaccagcatcaaggtgaccgtgcactgcatgaacagcagcagcggccagttcgagggcaacctgctggagctgagcgacgaggtgcagatcctggtgttcgagaagctgcagctgttctaccccgagtgccagcccgagcagatcctgatgcccatcaacagccagctgaagctgcacaccaacagagagggcgccgccttcgtgagcagcagagtgctgaagtgcttccccaacagcagcgtgatcgaggaggacggcgagggcctgctgaaggccggcagcatcgccggcaccgccgtgctggaggtgaccagcatcgagcccttcggcgtgaaccagaccaccatcaccggcgtgcaggtggcccccgtgacctacctgagagtgagcagccagcccaagctgtacaccgcccagggcagaaccctgagcgccttccccctgggcatgagcctgaccttcaccgtgcagttctacaacagcatcggcgagaagttccacacccacaacacccagctgtacctggccctgaacagagacgacctgctgcacatcggccccggcaacaagaactacacctacatggcccaggccgtgaacagaggcctgaccctggtgggcctgtgggacagaagacaccccggcatggccgactacatccccgtggccgtggagcacgccatcgagcccgacaccaagctgaccttcgtgggcgacatcatctgcttcagcacccacctggtgagccagcacggcgagcccggcatctggatgatcagcgccaacaacatcctgcagaccgacatcgtgaccggcgtgggcgtggccagaagccccggcaccgccatgatcttccacgacatccccggcgtggtgaagacctacagagaggtggtggtgaacgccagcagcagactgatgctgagctacgacctgaagacctacctgaccaacaccctgaacagcaccgtgttcaagctgttcatcaccaccggcagaaacggcgtgaacctgaagggcttctgcacccccaaccaggccctggccatcaccaaggtgctgctgcccgccaccctgatgctgtgccacgtgcagttcagcaacaccctgctggacatccccgccagcaaggtgttccaggtgcacagcgacttcagcatggagaagggcgtgtacgtgtgcatcatcaaggtgagaccccagagcgaggagctgctgcaggccctgagcgtggccgacaccagcgtgtacggctgggccaccctggtgagcgagagaagcaagaacggcatgcagagaatcctgatccccttcatccccgccttctacatcaaccagagcgagctggtgctgagccacaagcaggacatcggcgagatcagagtgctgggcgtggacagagtgctgagaaagctggaggtgatcagcagcagccccgtgctggtggtggccggccacagccacagccccctgacccccggcctggccatctacagcgtgagagtggtgaacttcaccagcttccagcagatggccagccccgtgttcatcaacatcagctgcgtgctgaccagccagagcgaggccgtggtggtgagagccatgaaggacaagctgggcgccgaccactgcgaggacagcgccatcctgaagagattcaccggcagctaccagatcctgctgctgaccctgttcgccgtgctggccagcaccgccagcatcttcctggcctacaacgccttcctgaacaagatccagaccgtgcccgtggtgtacgtgcccaccctgggcaccccccagcccggcttcttcaacagcaccagcagccccccccacttcatgagcctgcagccccccctggcccagagcagactgcagcactggctgtggagcatcagacactag

SEQ ID NO: 20130 - DNA, 639 bp, Artificial Sequence
  Description of Artificial Sequence: Synthetic coding sequence
atggccagcctgttcagcggcagaatcctgatcagaaacaacagcgaccaggacgagctggacaccgaggccgaggtgagcagaagactggagaacagactggtgctgctgttcttcggcgccggcgcctgcccccagtgccaggccttcgtgcccatcctgaaggacttcttcgtgagactgaccgacgagttctacgtgctgagagccgcccagctggccctggtgtacgtgagccaggacagcaccgaggagcagcaggacctgttcctgaaggacatgcccaagaagtggctgttcctgcccttcgaggacgacctgagaagagacctgggcagacagttcagcgtggagagactgcccgccgtggtggtgctgaagcccgacggcgacgtgctgaccagagacggcgccgacgagatccagagactgggcaccgcctgcttcgccaactggcaggaggccgccgaggtgctggacagaaacttccagctgcccgaggacctggaggaccaggagcccagaagcctgaccgagtgcctgagaagacacaagtacagagtggagaaggccgccagaggcggcagagaccccggcggcggcggcggcgaggagggcggcgccggcggcctgttctag

SEQ ID NO: 20131 - DNA, 423 bp, Artificial Sequence
  Description of Artificial Sequence: Synthetic coding sequence
atgctgcccgactgcctgagcgccgagggcgagctgagatgcagaagactgctggccggcgccaccgccagactgagagccagacccgccagcgccgccgtgctggtgcccctgtgcagcgtgagaggcgtgcccgccctgctgtacaccctgagaagcagcagactgaccggcagacacaagggcgacgtgagcttccccggcggcaagtgcgaccccgccgaccaggacgtggtgcacaccgccctgagagagaccagagaggagctgggcctggccgtgcccgaggagcacgtgtggggcctgctgagacccgtgtacgacccccagaaggccaccgtggtgcccgtgctggccggcgtgggccccctggacccccagagcctgagacccaacagcgaggaggtgagctggggcatctag

SEQ ID NO: 20132 - DNA, 711 bp, Artificial Sequence
  Description of Artificial Sequence: Synthetic coding sequence
atgctgcccgactgcctgagcgccgagggcgagctgagatgcagaagactgctggccggcgccaccgccagactgagagccagacccgccagcgccgccgtgctggtgcccctgtgcagcgtgagaggcgtgcccgccctgctgtacaccctgagaagcagcagactgaccggcagacacaagggcgacgtgagcttccccggcggcaagtgcgaccccgccgaccaggacgtggtgcacaccgccctgagagagaccagagaggagctgggcctggccgtgcccgaggagcacgtgtggggcctgctgagacccgtgtacgacccccagaaggccaccgtggtgcccgtgctggccggcgtgggccccctggacccccagagcctgagacccaacagcgaggaggtggacgaggtgttcgccctgcccctggcccacctgctgcagacccagaaccagggctacacccacttctgcagaggcggccacttcagatacaccctgcccgtgttcctgcacggcccccacagagtgtggggcctgaccgccgtgatcaccgagttcgccctgcagctgctggcccccggcacctaccagcccagactggccggcctgacctgcagcggcgccgagggcctggccagacccaagcagcccctggccagcccctgccaggccagcagcacccccggcctgaacaagggcctgtag

SEQ ID NO: 20133 - DNA, 1053 bp, Artificial Sequence
  Description of Artificial Sequence: Synthetic coding sequence
atggccggcagactgctgggcaaggccctggccgccgtgagcctgagcctggccctggccagcgtgaccatcagaagcagcagatgcagaggcatccaggccttcagaaacagcttcagcagcagctggttccacctgaacaccaacgtgatgagcggcagcaacggcagcaaggagaacagccacaacaaggccagaaccagcccctaccccggcagcaaggtggagagaagccaggtgcccaacgagaaggtgggctggctggtggagtggcaggactacaagcccgtggagtacaccgccgtgagcgtgctggccggccccagatgggccgacccccagatcagcgagagcaacttcagccccaagttcaacgagaaggacggccacgtggagagaaagagcaagaacggcctgtacgagatcgagaacggcagacccagaaaccccgccggcagaaccggcctggtgggcagaggcctgctgggcagatggggccccaaccacgccgccgaccccatcatcaccagatggaagagagacagcagcggcaacaagatcatgcaccccgtgagcggcaagcacatcctgcagttcgtggccatcaagagaaaggactgcggcgagtgggccatccccggcggcatggtggaccccggcgagaagatcagcgccaccctgaagagagagttcggcgaggaggccctgaacagcctgcagaagaccagcgccgagaagagagagatcgaggagaagctgcacaagctgttcagccaggaccacctggtgatctacaagggctacgtggacgaccccagaaacaccgacaacgcctggatggagaccgaggccgtgaactaccacgacgagaccggcgagatcatggacaacctgatgctggaggccggcgacgacgccggcaaggtgaagtgggtggacatcaacgacaagctgaagctgtacgccagccacagccagttcatcaagctggtggccgagaagagagacgcccactggagcgaggacagcgaggccgactgccacgccctgtag

SEQ ID NO: 20134 - DNA, 903 bp, Artificial Sequence
  Description of Artificial Sequence: Synthetic coding sequence
atgagcggcagcaacggcagcaaggagaacagccacaacaaggccagaaccagcccctaccccggcagcaaggtggagagaagccaggtgcccaacgagaaggtgggctggctggtggagtggcaggactacaagcccgtggagtacaccgccgtgagcgtgctggccggccccagatgggccgacccccagatcagcgagagcaacttcagccccaagttcaacgagaaggacggccacgtggagagaaagagcaagaacggcctgtacgagatcgagaacggcagacccagaaaccccgccggcagaaccggcctggtgggcagaggcctgctgggcagatggggccccaaccacgccgccgaccccatcatcaccagatggaagagagacagcagcggcaacaagatcatgcaccccgtgagcggcaagcacatcctgcagttcgtggccatcaagagaaaggactgcggcgagtgggccatccccggcggcatggtggaccccggcgagaagatcagcgccaccctgaagagagagttcggcgaggaggccctgaacagcctgcagaagaccagcgccgagaagagagagatcgaggagaagctgcacaagctgttcagccaggaccacctggtgatctacaagggctacgtggacgaccccagaaacaccgacaacgcctggatggagaccgaggccgtgaactaccacgacgagaccggcgagatcatggacaacctgatgctggaggccggcgacgacgccggcaaggtgaagtgggtggacatcaacgacaagctgaagctgtacgccagccacagccagttcatcaagctggtggccgagaagagagacgcccactggagcgaggacagcgaggccgactgccacgccctgtag

SEQ ID NO: 20135 - DNA, 621 bp, Artificial Sequence
  Description of Artificial Sequence: Synthetic coding sequence
atgagcggcagcaacggcagcaaggagaacagccacaacaaggccagaaccagcccctaccccggcagcaaggtggagagaagccaggtgcccaacgagaaggtgggctggctggtggagtggcaggactacaagcccgtggagtacaccgccgtgagcgtgctggccggccccagatgggccgacccccagatcagcgagagcaacttcagccccaagttcaacgagaaggacggccacgtggagagaaagagcaagaacggcctgtacgagatcgagaacggcagacccagaaaccccgccggcagaaccggcctggtgggcagaggcctgctgggcagatggggccccaaccacgccgccgaccccatcatcaccagatggaagagagacagcagcggcaacaagatcatgcaccccgtgagcggcaagcacatcctgcagttcgtggccatcaagagaaaggactgcggcgagtgggccatccccggcggcatggtggaccccggcgagaagatcagcgccaccctgaagagagagttcggcgaggaggccctgaacagcctgcagaagaccagcgccgagaagagagagatcgaggagaagctgcacaagctgtag

SEQ ID NO: 20136 - DNA, 789 bp, Artificial Sequence
  Description of Artificial Sequence: Synthetic coding sequence
atggcccccgccctgctgctgatccccgccgccctggccagcttcatcctggccttcggcaccggcgtggagttcgtgagattcaccagcctgagacccctgctgggcggcatccccgagagcggcggccccgacgccagacagggctggctggccgccctgcaggacagaagcatcctggcccccctggcctgggacctgggcctgctgctgctgttcgtgggccagcacagcctgatggccgccgagagagtgaaggcctggaccagcagatacttcggcgtgctgcagagaagcctgtacgtggcctgcaccgccctggccctgcagctggtgatgagatactgggagcccatccccaagggccccgtgctgtgggaggccagagccgagccctgggccacctgggtgcccctgctgtgcttcgtgctgcacgtgatcagctggctgctgatcttcagcatcctgctggtgttcgactacgccgagctgatgggcctgaagcaggtgtactaccacgtgctgggcctgggcgagcccctggccctgaagagccccagagccctgagactgttcagccacctgagacaccccgtgtgcgtggagctgctgaccgtgctgtgggtggtgcccaccctgggcaccgacagactgctgctggccttcctgctgaccctgtacctgggcctggcccacggcctggaccagcaggacctgagatacctgagagcccagctgcagagaaagctgcacctgctgagcagaccccaggacggcgaggccgagtag

SEQ ID NO: 20137 - DNA, 612 bp, Artificial Sequence
  Description of Artificial Sequence: Synthetic coding sequence
atggcccccgccctgctgctgatccccgccgccctggccagcttcatcctggccttcggcaccggcgtggagttcgtgagattcaccagcctgagacccctgctgggcggcatccccgagagcggcggccccgacgccagacagggctggctggccgccctgcaggacagaagcatcctggcccccctggcctgggacctgggcctgctgctgctgttcgtgggccagcacagcctgatggccgccgagagagtgaaggcctggaccagcagatacttcggcgtgctgcagagaagcctgtacgtggcctgcaccgccctggccctgcaggtgtactaccacgtgctgggcctgggcgagcccctggccctgaagagccccagagccctgagactgttcagccacctgagacaccccgtgtgcgtggagctgctgaccgtgctgtgggtggtgcccaccctgggcaccgacagactgctgctggccttcctgctgaccctgtacctgggcctggcccacggcctggaccagcaggacctgagatacctgagagcccagctgcagagaaagctgcacctgctgagcagaccccaggacggcgaggccgagtag

SEQ ID NO: 20138 - DNA, 789 bp, Artificial Sequence; identical to SEQ ID NO: 20136
  Description of Artificial Sequence: Synthetic coding sequence

SEQ ID NO: 20139 - DNA, 612 bp, Artificial Sequence; identical to SEQ ID NO: 20137
  Description of Artificial Sequence: Synthetic coding sequence

SEQ ID NO: 20140 - DNA, 789 bp, Artificial Sequence; identical to SEQ ID NO: 20136
  Description of Artificial Sequence: Synthetic coding sequence

SEQ ID NO: 20141 - DNA, 789 bp, Artificial Sequence
  Description of Artificial Sequence: Synthetic coding sequence
tgagagagcggcagagaggccaccggcgagggcgacctgagcagcaagctgggcacccagggcctggagttctggagaggcggcagagtgagaaccgagggcgccgagaagggcggcgacagaagcatcctgaacgccagacagggctggctggccgccctgcaggacagaagcatcctggcccccctggcctgggacctgggcctgctgctgctgttcgtgggccagcacagcctgatggccgccgagagagtgaaggcctggaccagcagatacttcggcgtgctgcagagaagcctgtacgtggcctgcaccgccctggccctgcagctggtgatgagatactgggagcccatccccaagggccccgtgctgtgggaggccagagccgagccctgggccacctgggtgcccctgctgtgcttcgtgctgcacgtgatcagctggctgctgatcttcagcatcctgctggtgttcgactacgccgagctgatgggcctgaagcaggtgtactaccacgtgctgggcctgggcgagcccctggccctgaagagccccagagccctgagactgttcagccacctgagacaccccgtgtgcgtggagctgctgaccgtgctgtgggtggtgcccaccctgggcaccgacagactgctgctggccttcctgctgaccctgtacctgggcctggcccacggcctggaccagcaggacctgagatacctgagagcccagctgcagagaaagctgcacctgctgagcagaccccaggacggcgaggccgagtag

SEQ ID NO: 20142 - DNA, 789 bp, Artificial Sequence; identical to SEQ ID NO: 20136
  Description of Artificial Sequence: Synthetic coding sequence

SEQ ID NO: 20143 - DNA, 612 bp, Artificial Sequence; identical to SEQ ID NO: 20137
  Description of Artificial Sequence: Synthetic coding sequence

SEQ ID NO: 20144 - DNA, 789 bp, Artificial Sequence; identical to SEQ ID NO: 20136
  Description of Artificial Sequence: Synthetic coding sequence

SEQ ID NO: 20145 - DNA, 789 bp, Artificial Sequence; identical to SEQ ID NO: 20136
  Description of Artificial Sequence: Synthetic coding sequence

SEQ ID NO: 20146 - DNA, 789 bp, Artificial Sequence; identical to SEQ ID NO: 20141
  Description of Artificial Sequence: Synthetic coding sequence

SEQ ID NO: 20147 - DNA, 789 bp, Artificial Sequence; identical to SEQ ID NO: 20136
  Description of Artificial Sequence: Synthetic coding sequence

SEQ ID NO: 20148 - DNA, 789 bp, Artificial Sequence; identical to SEQ ID NO: 20141
  Description of Artificial Sequence: Synthetic coding sequence

SEQ ID NO: 20149 - DNA, 789 bp, Artificial Sequence; identical to SEQ ID NO: 20141
  Description of Artificial Sequence: Synthetic coding sequence

SEQ ID NO: 20150 - DNA, 789 bp, Artificial Sequence; identical to SEQ ID NO: 20136
  Description of Artificial Sequence: Synthetic coding sequence

SEQ ID NO: 20151 - DNA, 789 bp, Artificial Sequence; identical to SEQ ID NO: 20141
  Description of Artificial Sequence: Synthetic coding sequence

SEQ ID NO: 20152 - DNA, 789 bp, Artificial Sequence; identical to SEQ ID NO: 20141
  Description of Artificial Sequence: Synthetic coding sequence

SEQ ID NO: 20153 - DNA, 612 bp, Artificial Sequence; identical to SEQ ID NO: 20137
  Description of Artificial Sequence: Synthetic coding sequence

SEQ ID NO: 20154 - DNA, 789 bp, Artificial Sequence; identical to SEQ ID NO: 20141
  Description of Artificial Sequence: Synthetic coding sequence

SEQ ID NO: 20155 - DNA, 612 bp, Artificial Sequence; identical to SEQ ID NO: 20137
  Description of Artificial Sequence: Synthetic coding sequence

SEQ ID NO: 20156 - DNA, 612 bp, Artificial Sequence; identical to SEQ ID NO: 20137
  Description of Artificial Sequence: Synthetic coding sequence

SEQ ID NO: 20157 - DNA, 612 bp, Artificial Sequence; identical to SEQ ID NO: 20137
  Description of Artificial Sequence: Synthetic coding sequence

SEQ ID NO: 20158 - DNA, 750 bp, Artificial Sequence
  Description of Artificial Sequence: Synthetic coding sequence
atggccatgctgagagtgcagcccgaggcccaggccaaggtggacgtgttcagagaggacctgtgcaccaagaccgagaacctgctgggcagctacttccccaagaagatcagcgagctggacgccttcctgaaggagcccgccctgaacgaggccaacctgagcaacctgaaggcccccctggacatccccgtgcccgaccccgtgaaggagaaggagaaggaggagagaaagaagcagcaggagaaggaggacaaggacgagaagaagaagggcgaggacgaggacaagggccccccctgcggccccgtgaactgcaacgagaagatcgtggtgctgctgcagagactgaagcccgagatcaaggacgtgatcgagcagctgaacctggtgaccacctggctgcagctgcagatccccagaatcgaggacggcaacaacttcggcgtggccgtgcaggagaaggtgttcgagctgatgaccagcctgcacaccaagctggagggcttccacacccagatcagcaagtacttcagcgagagaggcgacgccgtgaccaaggccgccaagcagccccacgtgggcgactacagacagctggtgcacgagctggacgaggccgagtacagagacatcagactgatggtgatggagatcagaaacgcctacgccgtgctgtacgacatcatcctgaagaacttcgagaagctgaagaagcccagaggcgagaccaagggcatgatctactag

SEQ ID NO: 20159 - DNA, 5697 bp, Artificial Sequence
  Description of Artificial Sequence: Synthetic coding sequence
atgctgctgagcggcggcgacccccccgcccaggagtggttcatggtgcagaccaagagcaagcccagagtgcagagacagagactgcaggtgcagagaatcttcagagtgaagctgaacgccttccagagcagacccgacaccccctacttctggctgcagctggagggccccagagagaacatgggcaaggccaaggagtacctgaagggcctgtgcagccccgagctgtggaaggaggtgagatacccccccatcctgcactgcgccttcctgggcgcccagggcctgttcctggactgcctgtgctggagcaccctggcctacctggtgcccggcccccccggcagcctgatggtgggcggcctgaccgagagcttcatcatgacccagaactggctggaggagctggtgggcagactgagatggggccccgcccccctgctgacccccagaggcatctgggaggccgaggtgaccagagccttcggcgccctggtgtggatcagaggcgaccagcacgccggcgacctgctgcagctgccccccgccgtgcaggagctgctgctgagcctggtgagagacgccgccggcaaggaggacatcatcgagtggctgagcagattcggcatcagcgacagccacagcgaccccgaggtgctgatctgccccccccagcagcagaaggaggcccccgccatggtgagcgtgggcgagagccccggccccttcgtggacatgggcaccctgcagaacagaggccccgagaacagcaagagactgagcagcctgggcgccaccggcagcctgatcaccgcccagagcaccccccaggaggccgccaaccagctggtgagagtgggcagcaacaaccaggacggcatggacagcgcccaggaggagggcaccgtgcaggccaccagcagccaggacagcaccaaccacacccaggccctgctgaagcagagacaggtgcagaagatcgaggacaagctgctgttccagccccccgtgagcgccctgggcgtgtgccccccctggaaggcctggacccccggccccgccttcggccccctgtggcccggcgccatcgccgccaccttctggagaatcaacgagctgcacagcctgcacctggcctggctgctgagccaggcctgcttcaacttccccttctggcagagacccctgggccccatccagctgaagctgcccggccagaaccccctgcccctgaacctggagtggaagcagaaggagctggcccccctgcccagcgccgagagccccgccggcagacccgacggcggcctgggcggcgaggccgccctgcagaactgccccagacccgagatcagccccaaggtgaccagcctgctggtggtgcccggcagcagcgacgtgaaggacaaggtgagcagcgacctgccccagatcggcccccccctgaccagcaccccccagctgcaggccggcggcgagcccggcgaccagggcagcatgcagctggacttcaagggcctggaggagggccccgcccccgtgctgcccaccggccagggcaagcccgtggcccagggcggcctgaccgaccagagcgtgcccggcgcccagaccgtgcccgagaccctgaaggtgcccatggccgccgccgtgcccaaggccgagaaccccagcagaacccaggtgcccagcgccgcccccaagctgcccaccagcagaatgatgctggccgtgcacaccgagcccgccgcccccgaggtgcccctggcccccaccaagcccaccgcccagctgatggccaccgcccagaagaccgtggtgaaccagcccgtgctggtggcccaggtggagcccaccacccccaagaccccccaggcccagaagatgcccgtggccaagaccagccccgccggccccaagacccccaaggcccaggccggccccgccgccaccgtgagcaaggcccccgccgccagcaaggcccccgccgcccccaaggtgcccgtgacccccagagtgagcagagcccccaagacccccgccgcccagaaggtgcccaccgacgccggccccaccctggacgtggccagactgctgagcgaggtgcagcccaccagcagagccagcgtgagcctgctgaagggccagggccaggccggcagacagggcccccagagcagcggcaccctggccctgagcagcaagcaccagttccagatggagggcctgctgggcgcctgggagggcgcccccagacagccccccagacacctgcaggccaacagcaccgtgaccagcttccagagataccacgaggccctgaacacccccttcgagctgaacctgagcggcgagcccggcaaccagggcctgagaagagtggtgatcgacggcagcagcgtggccatggtgcacggcctgcagcacttcttcagctgcagaggcatcgccatggccgtgcagttcttctggaacagaggccacagagaggtgaccgtgttcgtgcccacctggcagctgaagaagaacagaagagtgagagagagccacttcctgaccaagctgcacagcctgaagatgctgagcatcacccccagccagctggagaacggcaagaagatcaccacctacgactacagattcatggtgaagctggccgaggagaccgacggcatcatcgtgaccaacgagcagatccacatcctgatgaacagcagcaagaagctgatggtgaaggacagactgctgcccttcaccttcgccggcaacctgttcatggtgcccgacgaccccctgggcagagacggccccaccctggacgagttcctgaagaagcccaacagactggacaccgacatcggcaacttcctgaaggtgtggaagaccctgccccccagcagcgccagcgtgaccgagctgagcgacgacgccgacagcggccccctggagagcctgcccaacatggaggaggtgagagaggagaaggaggagagacaggacgaggagcagagacagggccagggcacccagaaggccgccgaggaggacgacctggacagcagcctggccagcgtgttcagagtggagtgccccagcctgagcgaggagatcctgagatgcctgagcctgcacgacccccccgacggcgccctggacatcgacctgctgcccggcgccgccagcccctacctgggcatcccctgggacggcaaggccccctgccagcaggtgctggcccacctggcccagctgaccatccccagcaacttcaccgccctgagcttcttcatgggcttcatggacagccacagagacgccatccccgactacgaggccctggtgggccccctgcacagcctgctgaagcagaagcccgactggcagtgggaccaggagcacgaggaggccttcctggccctgaagagagccctggtgagcgccctgtgcctgatggcccccaacagccagctgcccttcagactggaggtgaccgtgagccacgtggccctgaccgccatcctgcaccaggagcacagcggcagaaagcaccccatcgcctacaccagcaagcccctgctgcccgacgaggagagccagggcccccagagcggcggcgacagcccctacgccgtggcctgggccctgaagcacttcagcagatgcatcggcgacacccccgtggtgctggacctgagctacgccagcagaaccaccgccgaccccgaggtgagagagggcagaagagtgagcaaggcctggctgatcagatggagcctgctggtgcaggacaagggcaagagagccctggagctggccctgctgcagggcctgctgggcgagaacagactgctgacccccgccgccagcatgcccagattcttccaggtgctgccccccttcagcgacctgagcaccttcgtgtgcatccacatgagcggctactgcttctacagagaggacgagtggtgcgccggcttcggcctgtacgtgctgagccccaccagcccccccgtgagcctgagcttcagctgcagcccctacacccccacctacgcccacctggccgccgtggcctgcggcctggagagattcggccagagccccctgcccgtggtgttcctgacccactgcaactggatcttcagcctgctgtgggagctgctgcccctgtggagagccagaggcttcctgagcagcgacggcgcccccctgccccaccccagcctgctgagctacatcatcagcctgaccagcggcctgagcagcctgcccttcatctacagaaccagctacagaggcagcctgttcgccgtgaccgtggacaccctggccaagcagggcgcccagggcggcggccagtggtggagcctgcccaaggacgtgcccgcccccaccgtgagcccccacgccatgggcaagagacccaacctgctggccctgcagctgagcgacagcaccctggccgacatcatcgccagactgcaggccggccagaagctgagcggcagcagccccttcagcagcgccttcaacagcctgagcctggacaaggagagcggcctgctgatgttcaagggcgacaagaagcccagagtgtgggtggtgcccacccagctgagaagagacctgatcttcagcgtgcacgacatccccctgggcgcccaccagagacccgaggagacctacaagaagctgagactgctgggctggtggcccggcatgcaggagcacgtgaaggactactgcagaagctgcctgttctgcatccccagaaacctgatcggcagcgagctgaaggtgatcgagagcccctggcccctgagaagcaccgccccctggagcaacctgcagatcgaggtggtgggccccgtgaccatcagcgaggagggccacaagcacgtgctgatcgtggccgaccccaacaccagatgggtggaggccttccccctgaagccctacacccacaccgccgtggcccaggtgctgctgcagcacgtgttcgccagatggggcgtgcccgtgagactggaggccgcccagggcccccagttcgccagacacgtgctggtgagctgcggcctggccctgggcgcccaggtggccagcctgagcagagacctgcagttcccctgcctgaccagcagcggcgcctactgggagttcaagagagccctgaaggagttcatcttcctgcacggcaagaagtgggccgccagcctgcccctgctgcacctggccttcagagccagcagcaccgacgccacccccttcaaggtgctgaccggcggcgagagcagactgaccgagcccctgtggtgggagatgagcagcgccaacatcgagggcctgaagatggacgtgttcctgctgcagctggtgggcgagctgctggagctgcactggagagtggccgacaaggccagcgagaaggccgagaacagaagattcaagagagagagccaggagaaggagtggaacgtgggcgaccaggtgctgctgctgagcctgcccagaaacggcagcagcgccaagtgggtgggccccttctacatcggcgacagactgagcctgagcctgtacagaatctggggcttccccacccccgagaagctgggctgcatctaccccagcagcctgatgaaggccttcgccaagagcggcacccccctgagcttcaaggtgctggagcagtag

SEQ ID NO: 20160 - DNA, 7797 bp, Artificial Sequence
  Description of Artificial Sequence: Synthetic coding sequence
ggcagacccatcccccccaccagcagccccagcctgctgcccagcgcccagctgcccagcagccacaaccccccccccgtgagctgccagatgcccctgctggacagcaacaccagccaccagatcatggacaccaaccccgacgaggagttcagccccaacagctacctgctgagagcctgcagcggcccccagcaggccagcagcagcggcccccccaaccaccacagccagagcaccctgagaccccccctgccccccccccacaaccacaccctgagccaccaccacagcagcgccaacagcctgaacagaaacagcctgaccaacagaagaagccagatccacgcccccgcccccgcccccaacgacctggccaccacccccgagagcgtgcagctgcaggacagctgggtgctgaacagcaacgtgcccctggagaccagacacttcctgttcaagaccagcagcggcagcacccccctgttcagcagcagcagccccggctaccccctgaccagcggcaccgtgtacacccccccccccagactgctgcccagaaacaccttcagcagaaaggccttcaagctgaagaagcccagcaagtactgcagctggaagtgcgccgccctgagcgccatcgccgccgccctgctgctggccatcctgctggcctacttcatcgccatgcacctgctgggcctgaactggcagctgcagcccgccgacggccacaccttcaacaacggcatcagaaccggcctgcccggcaacgacgacgtggccaccatgcccagcggcggcaaggtgccctggagcctgaagaacagcagcatcgacagcggcgaggccgaggtgggcagaagagtgacccaggaggtgccccccggcgtgttctggagaagccagatccacatcagccagccccagttcctgaagttcaacatcagcctgggcaaggacgccctgttcggcgtgtacatcagaagaggcctgccccccagccacgcccagtacgacttcatggagagactggacggcaaggagaagtggagcgtggtggagagccccagagagagaagaagcatccagaccctggtgcagaacgaggccgtgttcgtgcagtacctggacgtgggcctgtggcacctggccttctacaacgacggcaaggacaaggagatggtgagcttcaacaccgtggtgctggacagcgtgcaggactgccccagaaactgccacggcaacggcgagtgcgtgagcggcgtgtgccactgcttccccggcttcctgggcgccgactgcgccaaggccgcctgccccgtgctgtgcagcggcaacggccagtacagcaagggcacctgccagtgctacagcggctggaagggcgccgagtgcgacgtgcccatgaaccagtgcatcgaccccagctgcggcggccacggcagctgcatcgacggcaactgcgtgtgcagcgccggctacaagggcgagcactgcgaggaggtggactgcctggaccccacctgcagcagccacggcgtgtgcgtgaacggcgagtgcctgtgcagccccggctggggcggcctgaactgcgagctggccagagtgcagtgccccgaccagtgcagcggccacggcacctacctgcccgacaccggcctgtgcagctgcgaccccaactggatgggccccgactgcagcgtggaggtgtgcagcgtggactgcggcacccacggcgtgtgcatcggcggcgcctgcagatgcgaggagggctggaccggcgccgcctgcgaccagagagtgtgccaccccagatgcatcgagcacggcacctgcaaggacggcaagtgcgagtgcagagagggctggaacggcgagcactgcaccatcgacggctgccccgacctgtgcaacggcaacggcagatgcaccctgggccagaacagctggcagtgcgtgtgccagaccggctggagaggccccggctgcaacgtggccatggagaccagctgcgccgacaacaaggacaacgagggcgacggcctggtggactgcctggaccccgactgctgcctgcagagcgcctgccagaacagcctgctgtgcagaggcagcagagaccccctggacatcatccagcagggccagaccgactggcccgccgtgaagagcttctacgacagaatcaagctgctggccggcaaggacagcacccacatcatccccggcgagaaccccttcaacagcagcctggtgagcctgatcagaggccaggtggtgaccaccgacggcacccccctggtgggcgtgaacgtgagcttcgtgaagtaccccaagtacggctacaccatcaccagacaggacggcaccttcgacctgatcgccaacggcggcgccagcctgaccctgcacttcgagagagcccccttcatgagccaggagagaaccgtgtggctgccctggaacagcttctacgccatggacaccctggtgatgaagaccgaggagaacagcatccccagctgcgacctgagcggcttcgtgagacccgaccccatcatcatcagcagccccctgagcaccttcttcagcgccgcccccggccagaaccccatcgtgcccgagacccaggtgctgcacgaggagatcgagctgcccggcagcaacgtgaagctgagatacctgagcagcagaaccgccggctacaagagcctgctgaagatcaccatgacccagagcaccgtgcccctgaacctgatcagagtgcacctgatggtggccgtggagggccacctgttccagaagagcttccaggccagccccaacctggcctacaccttcatctgggacaagaccgacgcctacggccagagagtgtacggcctgagcgacgccgtggtgagcgtgggcttcgagtacgagacctgccccagcctgatcctgtgggagaagagaaccgccctgctgcagggcttcgagctggaccccagcaacctgggcggctggagcctggacaagcaccacatcctgaacgtgaagagcggcatcctgcacaagggcaccggcgagaaccagttcctgacccagcagcccgccatcatcaccagcatcatgggcaacggcagaagaagaagcatcagctgccccagctgcaacggcctggccgagggcaacaagctgctggcccccgtggccctggccgtgggcatcgacggcagcctgtacgtgggcgacttcaactacatcagaagaatcttccccagcagaaacgtgaccagcatcctggagctgagaaacaaggagttcaagcacagcaacaaccccgcccacaagtactacctggccgtggaccccgtgagcggcagcctgtacgtgagcgacaccaacagcagaagaatctacagagtgaagagcctgagcggcaccaaggacctggccggcaacagcgaggtggtggccggcaccggcgagcagtgcctgcccttcgacgaggccagatgcggcgacggcggcaaggccatcgacgccaccctgatgagccccagaggcatcgccgtggacaagaacggcctgatgtacttcgtggacgccaccatgatcagaaaggtggaccagaacggcatcatcagcaccctgctgggcagcaacgacctgaccgccgtgagacccctgagctgcgacagcagcatggacgtggcccaggtgagactggagtggcccaccgacctggccgtgaaccccatggacaacagcctgtacgtgctggagaacaacgtgatcctgagaatcaccgagaaccaccaggtgagcatcatcgccggcagacccatgcactgccaggtgcccggcatcgactacagcctgagcaagctggccatccacagcgccctggagagcgccagcgccatcgccatcagccacaccggcgtgctgtacatcaccgagaccgacgagaagaagatcaacagactgagacaggtgaccaccaacggcgagatctgcctgctggccggcgccgccagcgactgcgactgcaagaacgacgtgaactgcaactgctacagcggcgacgacgcctacgccaccgacgccatcctgaacagccccagcagcctggccgtggcccccgacggcaccatctacatcgccgacctgggcaacatcagaatcagagccgtgagcaagaacaagcccgtgctgaacgccttcaaccagtacgaggccgccagccccggcgagcaggagctgtacgtgttcaacgccgacggcatccaccagtacaccgtgagcctggtgaccggcgagtacctgtacaacttcacctacagcaccgacaacgacgtgaccgagctgatcgacaacaacggcaacagcctgaagatcagaagagacagcagcggcatgcccagacacctgctgatgcccgacaaccagatcatcaccctgaccgtgggcaccaacggcggcctgaaggtggtgagcacccagaacctggagctgggcctgatgacctacgacggcaacaccggcctgctggccaccaagagcgacgagaccggctggaccaccttctacgactacgaccacgagggcagactgaccaacgtgaccagacccaccggcgtggtgaccagcctgcacagagagatggagaagagcatcaccatcgacatcgagaacagcaacagagacgacgacgtgaccgtgatcaccaacctgagcagcgtggaggccagctacaccgtggtgcaggaccaggtgagaaacagctaccagctgtgcaacaacggcaccctgagagtgatgtacgccaacggcatgggcatcagcttccacagcgagccccacgtgctggccggcaccatcacccccaccatcggcagatgcaacatcagcctgcccatggagaacggcctgaacagcatcgagtggagactgagaaaggagcagatcaagggcaaggtgaccatcttcggcagaaagctgagagtgcacggcagaaacctgctgagcatcgactacgacagaaacatcagaaccgagaagatctacgacgaccacagaaagttcaccctgagaatcatctacgaccaggtgggcagacccttcctgtggctgcccagcagcggcctggccgccgtgaacgtgagctacttcttcaacggcagactggccggcctgcagagaggcgccatgagcgagagaaccgacatcgacaagcagggcagaatcgtgagcagaatgttcgccgacggcaaggtgtggagctacagctacctggacaagagcatggtgctgctgctgcagagccagagacagtacatcttcgagtacgacagcagcgacagactgctggccgtgaccatgcccagcgtggccagacacagcatgagcacccacaccagcatcggctacatcagaaacatctacaacccccccgagagcaacgccagcgtgatcttcgactacagcgacgacggcagaatcctgaagaccagcttcctgggcaccggcagacaggtgttctacaagtacggcaagctgagcaagctgagcgagatcgtgtacgacagcaccgccgtgaccttcggctacgacgagaccaccggcgtgctgaagatggtgaacctgcagagcggcggcttcagctgcaccatcagatacagaaagatcggccccctggtggacaagcagatctacagattcagcgaggagggcatggtgaacgccagattcgactacacctaccacgacaacagcttcagaatcgccagcatcaagcccgtgatcagcgagacccccctgcccgtggacctgtacagatacgacgagatcagcggcaaggtggagcacttcggcaagttcggcgtgatctactacgacatcaaccagatcatcaccaccgccgtgatgaccctgagcaagcacttcgacacccacggcagaatcaaggaggtgcagtacgagatgttcagaagcctgatgtactggatgaccgtgcagtacgacagcatgggcagagtgatcaagagagagctgaagctgggcccctacgccaacaccaccaagtacacctacgactacgacggcgacggccagctgcagagcgtggccgtgaacgacagacccacctggagatacagctacgacctgaacggcaacctgcacctgctgaaccccggcaacagcgtgagactgatgcccctgagatacgacctgagagacagaatcaccagactgggcgacgtgcagtacaagatcgacgacgacggctacctgtgccagagaggcagcgacatcttcgagtacaacagcaagggcctgctgaccagagcctacaacaaggccagcggctggagcgtgcagtacagatacgacggcgtgggcagaagagccagctacaagaccaacctgggccaccacctgcagtacttctacagcgacctgcacaaccccaccagaatcacccacgtgtacaaccacagcaacagcgagatcaccagcctgtactacgacctgcagggccacctgttcgccatggagagcagcagcggcgaggagtactacgtggccagcgacaacaccggcacccccctggccgtgttcagcatcaacggcctgatgatcaagcagctgcagtacaccgcctacggcgagatctactacgacagcaaccccgacttccagatggtgatcggcttccacggcggcctgtacgaccccctgaccaagctggtgcacttcacccagagagactacgacgtgctggccggcagatggaccagccccgactacaccatgtggaagaacgtgggcaaggagcccgcccccttcaacctgtacatgttcaagagcaacaaccccctgagcagcgagctggacctgaagaactacgtgaccgacgtgaagagctggctggtgatgttcggcttccagctgagcaacatcatccccggcttccccagagccaagatgtacttcgtgccccccccctacgagctgagcgagagccaggccagcgagaacggccagctgatcaccggcgtgcagcagaccaccgagagacacaaccaggccttcatggccctggagggccaggtgatcaccaagaagctgcacgccagcatcagagagaaggccggccactggttcgccaccaccacccccatcatcggcaagggcatcatgttcgccatcaaggagggcagagtgaccaccggcgtgagcagcatcgccagcgaggacagcagaaaggtggccagcgtgctgaacaacgcctactacctggacaagatgcactacagcatcgagggcaaggacacccactacttcgtgaagatcggcagcgccgacggcgacctggtgaccctgggcaccaccatcggcagaaaggtgctggagagcggcgtgaacgtgaccgtgagccagcccaccctgctggtgaacggcagaaccagaagattcaccaacatcgagttccagtacagcaccctgctgctgagcatcagatacggcctgacccccgacaccctggacgaggagaaggccagagtgctggaccaggccagacagagagccctgggcaccgcctgggccaaggagcagcagaaggccagagacggcagagagggcagcagactgtggaccgagggcgagaagcagcagctgctgagcaccggcagagtgcagggctacgagggctactacgtgctgcccgtggagcagtaccccgagctggccgacagcagcagcaacatccagttcctgagacagaacgagatgggcaagagatag

SEQ ID NO: 20161 - DNA, 8325 bp, Artificial Sequence
  Description of Artificial Sequence: Synthetic coding sequence
atggacgtgaaggacagaagacacagaagcctgaccagaggcagatgcggcaaggagtgcagatacaccagcagcagcctggacagcgaggactgcagagtgcccacccagaagagctacagcagcagcgagaccctgaaggcctacgaccacgacagcagaatgcactacggcaacagagtgaccgacctgatccacagagagagcgacgagttccccagacagggcaccaacttcaccctggccgagctgggcatctgcgagcccagcccccacagaagcggctactgcagcgacatgggcatcctgcaccagggctacagcctgagcaccggcagcgacgccgacagcgacaccgagggcggcatgagccccgagcacgccatcagactgtggggcagaggcatcaagagcagaagaagcagcggcctgagcagcagagagaacagcgccctgaccctgaccgacagcgacaacgagaacaagagcgacgacgagaacggcagacccatcccccccaccagcagccccagcctgctgcccagcgcccagctgcccagcagccacaaccccccccccgtgagctgccagatgcccctgctggacagcaacaccagccaccagatcatggacaccaaccccgacgaggagttcagccccaacagctacctgctgagagcctgcagcggcccccagcaggccagcagcagcggcccccccaaccaccacagccagagcaccctgagaccccccctgccccccccccacaaccacaccctgagccaccaccacagcagcgccaacagcctgaacagaaacagcctgaccaacagaagaagccagatccacgcccccgcccccgcccccaacgacctggccaccacccccgagagcgtgcagctgcaggacagctgggtgctgaacagcaacgtgcccctggagaccagacacttcctgttcaagaccagcagcggcagcacccccctgttcagcagcagcagccccggctaccccctgaccagcggcaccgtgtacacccccccccccagactgctgcccagaaacaccttcagcagaaaggccttcaagctgaagaagcccagcaagtactgcagctggaagtgcgccgccctgagcgccatcgccgccgccctgctgctggccatcctgctggcctacttcatcgccatgcacctgctgggcctgaactggcagctgcagcccgccgacggccacaccttcaacaacggcatcagaaccggcctgcccggcaacgacgacgtggccaccatgcccagcggcggcaaggtgccctggagcctgaagaacagcagcatcgacagcggcgaggccgaggtgggcagaagagtgacccaggaggtgccccccggcgtgttctggagaagccagatccacatcagccagccccagttcctgaagttcaacatcagcctgggcaaggacgccctgttcggcgtgtacatcagaagaggcctgccccccagccacgcccagtacgacttcatggagagactggacggcaaggagaagtggagcgtggtggagagccccagagagagaagaagcatccagaccctggtgcagaacgaggccgtgttcgtgcagtacctggacgtgggcctgtggcacctggccttctacaacgacggcaaggacaaggagatggtgagcttcaacaccgtggtgctggacagcgtgcaggactgccccagaaactgccacggcaacggcgagtgcgtgagcggcgtgtgccactgcttccccggcttcctgggcgccgactgcgccaaggccgcctgccccgtgctgtgcagcggcaacggccagtacagcaagggcacctgccagtgctacagcggctggaagggcgccgagtgcgacgtgcccatgaaccagtgcatcgaccccagctgcggcggccacggcagctgcatcgacggcaactgcgtgtgcagcgccggctacaagggcgagcactgcgaggaggtggactgcctggaccccacctgcagcagccacggcgtgtgcgtgaacggcgagtgcctgtgcagccccggctggggcggcctgaactgcgagctggccagagtgcagtgccccgaccagtgcagcggccacggcacctacctgcccgacaccggcctgtgcagctgcgaccccaactggatgggccccgactgcagcgtggaggtgtgcagcgtggactgcggcacccacggcgtgtgcatcggcggcgcctgcagatgcgaggagggctggaccggcgccgcctgcgaccagagagtgtgccaccccagatgcatcgagcacggcacctgcaaggacggcaagtgcgagtgcagagagggctggaacggcgagcactgcaccatcggcagacagaccgccggcaccgagaccgacggctgccccgacctgtgcaacggcaacggcagatgcaccctgggccagaacagctggcagtgcgtgtgccagaccggctggagaggccccggctgcaacgtggccatggagaccagctgcgccgacaacaaggacaacgagggcgacggcctggtggactgcctggaccccgactgctgcctgcagagcgcctgccagaacagcctgctgtgcagaggcagcagagaccccctggacatcatccagcagggccagaccgactggcccgccgtgaagagcttctacgacagaatcaagctgctggccggcaaggacagcacccacatcatccccggcgagaaccccttcaacagcagcctggtgagcctgatcagaggccaggtggtgaccaccgacggcacccccctggtgggcgtgaacgtgagcttcgtgaagtaccccaagtacggctacaccatcaccagacaggacggcaccttcgacctgatcgccaacggcggcgccagcctgaccctgcacttcgagagagcccccttcatgagccaggagagaaccgtgtggctgccctggaacagcttctacgccatggacaccctggtgatgaagaccgaggagaacagcatccccagctgcgacctgagcggcttcgtgagacccgaccccatcatcatcagcagccccctgagcaccttcttcagcgccgcccccggccagaaccccatcgtgcccgagacccaggtgctgcacgaggagatcgagctgcccggcagcaacgtgaagctgagatacctgagcagcagaaccgccggctacaagagcctgctgaagatcaccatgacccagagcaccgtgcccctgaacctgatcagagtgcacctgatggtggccgtggagggccacctgttccagaagagcttccaggccagccccaacctggcctacaccttcatctgggacaagaccgacgcctacggccagagagtgtacggcctgagcgacgccgtggtgagcgtgggcttcgagtacgagacctgccccagcctgatcctgtgggagaagagaaccgccctgctgcagggcttcgagctggaccccagcaacctgggcggctggagcctggacaagcaccacatcctgaacgtgaagagcggcatcctgcacaagggcaccggcgagaaccagttcctgacccagcagcccgccatcatcaccagcatcatgggcaacggcagaagaagaagcatcagctgccccagctgcaacggcctggccgagggcaacaagctgctggcccccgtggccctggccgtgggcatcgacggcagcctgtacgtgggcgacttcaactacatcagaagaatcttccccagcagaaacgtgaccagcatcctggagctgagaaacaaggagttcaagcacagcaacaaccccgcccacaagtactacctggccgtggaccccgtgagcggcagcctgtacgtgagcgacaccaacagcagaagaatctacagagtgaagagcctgagcggcaccaaggacctggccggcaacagcgaggtggtggccggcaccggcgagcagtgcctgcccttcgacgaggccagatgcggcgacggcggcaaggccatcgacgccaccctgatgagccccagaggcatcgccgtggacaagaacggcctgatgtacttcgtggacgccaccatgatcagaaaggtggaccagaacggcatcatcagcaccctgctgggcagcaacgacctgaccgccgtgagacccctgagctgcgacagcagcatggacgtggcccaggtgagactggagtggcccaccgacctggccgtgaaccccatggacaacagcctgtacgtgctggagaacaacgtgatcctgagaatcaccgagaaccaccaggtgagcatcatcgccggcagacccatgcactgccaggtgcccggcatcgactacagcctgagcaagctggccatccacagcgccctggagagcgccagcgccatcgccatcagccacaccggcgtgctgtacatcaccgagaccgacgagaagaagatcaacagactgagacaggtgaccaccaacggcgagatctgcctgctggccggcgccgccagcgactgcgactgcaagaacgacgtgaactgcaactgctacagcggcgacgacgcctacgccaccgacgccatcctgaacagccccagcagcctggccgtggcccccgacggcaccatctacatcgccgacctgggcaacatcagaatcagagccgtgagcaagaacaagcccgtgctgaacgccttcaaccagtacgaggccgccagccccggcgagcaggagctgtacgtgttcaacgccgacggcatccaccagtacaccgtgagcctggtgaccggcgagtacctgtacaacttcacctacagcaccgacaacgacgtgaccgagctgatcgacaacaacggcaacagcctgaagatcagaagagacagcagcggcatgcccagacacctgctgatgcccgacaaccagatcatcaccctgaccgtgggcaccaacggcggcctgaaggtggtgagcacccagaacctggagctgggcctgatgacctacgacggcaacaccggcctgctggccaccaagagcgacgagaccggctggaccaccttctacgactacgaccacgagggcagactgaccaacgtgaccagacccaccggcgtggtgaccagcctgcacagagagatggagaagagcatcaccatcgacatcgagaacagcaacagagacgacgacgtgaccgtgatcaccaacctgagcagcgtggaggccagctacaccgtggtgcaggaccaggtgagaaacagctaccagctgtgcaacaacggcaccctgagagtgatgtacgccaacggcatgggcatcagcttccacagcgagccccacgtgctggccggcaccatcacccccaccatcggcagatgcaacatcagcctgcccatggagaacggcctgaacagcatcgagtggagactgagaaaggagcagatcaagggcaaggtgaccatcttcggcagaaagctgagagtgcacggcagaaacctgctgagcatcgactacgacagaaacatcagaaccgagaagatctacgacgaccacagaaagttcaccctgagaatcatctacgaccaggtgggcagacccttcctgtggctgcccagcagcggcctggccgccgtgaacgtgagctacttcttcaacggcagactggccggcctgcagagaggcgccatgagcgagagaaccgacatcgacaagcagggcagaatcgtgagcagaatgttcgccgacggcaaggtgtggagctacagctacctggacaagagcatggtgctgctgctgcagagccagagacagtacatcttcgagtacgacagcagcgacagactgctggccgtgaccatgcccagcgtggccagacacagcatgagcacccacaccagcatcggctacatcagaaacatctacaacccccccgagagcaacgccagcgtgatcttcgactacagcgacgacggcagaatcctgaagaccagcttcctgggcaccggcagacaggtgttctacaagtacggcaagctgagcaagctgagcgagatcgtgtacgacagcaccgccgtgaccttcggctacgacgagaccaccggcgtgctgaagatggtgaacctgcagagcggcggcttcagctgcaccatcagatacagaaagatcggccccctggtggacaagcagatctacagattcagcgaggagggcatggtgaacgccagattcgactacacctaccacgacaacagcttcagaatcgccagcatcaagcccgtgatcagcgagacccccctgcccgtggacctgtacagatacgacgagatcagcggcaaggtggagcacttcggcaagttcggcgtgatctactacgacatcaaccagatcatcaccaccgccgtgatgaccctgagcaagcacttcgacacccacggcagaatcaaggaggtgcagtacgagatgttcagaagcctgatgtactggatgaccgtgcagtacgacagcatgggcagagtgatcaagagagagctgaagctgggcccctacgccaacaccaccaagtacacctacgactacgacggcgacggccagctgcagagcgtggccgtgaacgacagacccacctggagatacagctacgacctgaacggcaacctgcacctgctgaaccccggcaacagcgtgagactgatgcccctgagatacgacctgagagacagaatcaccagactgggcgacgtgcagtacaagatcgacgacgacggctacctgtgccagagaggcagcgacatcttcgagtacaacagcaagggcctgctgaccagagcctacaacaaggccagcggctggagcgtgcagtacagatacgacggcgtgggcagaagagccagctacaagaccaacctgggccaccacctgcagtacttctacagcgacctgcacaaccccaccagaatcacccacgtgtacaaccacagcaacagcgagatcaccagcctgtactacgacctgcagggccacctgttcgccatggagagcagcagcggcgaggagtactacgtggccagcgacaacaccggcacccccctggccgtgttcagcatcaacggcctgatgatcaagcagctgcagtacaccgcctacggcgagatctactacgacagcaaccccgacttccagatggtgatcggcttccacggcggcctgtacgaccccctgaccaagctggtgcacttcacccagagagactacgacgtgctggccggcagatggaccagccccgactacaccatgtggaagaacgtgggcaaggagcccgcccccttcaacctgtacatgttcaagagcaacaaccccctgagcagcgagctggacctgaagaactacgtgaccgacgtgaagagctggctggtgatgttcggcttccagctgagcaacatcatccccggcttccccagagccaagatgtacttcgtgccccccccctacgagctgagcgagagccaggccagcgagaacggccagctgatcaccggcgtgcagcagaccaccgagagacacaaccaggccttcatggccctggagggccaggtgatcaccaagaagctgcacgccagcatcagagagaaggccggccactggttcgccaccaccacccccatcatcggcaagggcatcatgttcgccatcaaggagggcagagtgaccaccggcgtgagcagcatcgccagcgaggacagcagaaaggtggccagcgtgctgaacaacgcctactacctggacaagatgcactacagcatcgagggcaaggacacccactacttcgtgaagatcggcagcgccgacggcgacctggtgaccctgggcaccaccatcggcagaaaggtgctggagagcggcgtgaacgtgaccgtgagccagcccaccctgctggtgaacggcagaaccagaagattcaccaacatcgagttccagtacagcaccctgctgctgagcatcagatacggcctgacccccgacaccctggacgaggagaaggccagagtgctggaccaggccagacagagagccctgggcaccgcctgggccaaggagcagcagaaggccagagacggcagagagggcagcagactgtggaccgagggcgagaagcagcagctgctgagcaccggcagagtgcagggctacgagggctactacgtgctgcccgtggagcagtaccccgagctggccgacagcagcagcaacatccagttcctgagacagaacgagatgggcaagagatag

SEQ ID NO: 20162 - DNA, 8322 bp, Artificial Sequence
  Description of Artificial Sequence: Synthetic coding sequence
atggacgtgaaggacagaagacacagaagcctgaccagaggcagatgcggcaaggagtgcagatacaccagcagcagcctggacagcgaggactgcagagtgcccacccagaagagctacagcagcagcgagaccctgaaggcctacgaccacgacagcagaatgcactacggcaacagagtgaccgacctgatccacagagagagcgacgagttccccagacagggcaccaacttcaccctggccgagctgggcatctgcgagcccagcccccacagaagcggctactgcagcgacatgggcatcctgcaccagggctacagcctgagcaccggcagcgacgccgacagcgacaccgagggcggcatgagccccgagcacgccatcagactgtggggcagaggcatcaagagcagaagaagcagcggcctgagcagcagagagaacagcgccctgaccctgaccgacagcgacaacgagaacaagagcgacgacgagaacggcagacccatcccccccaccagcagccccagcctgctgcccagcgcccagctgcccagcagccacaaccccccccccgtgagctgccagatgcccctgctggacagcaacaccagccaccagatcatggacaccaaccccgacgaggagttcagccccaacagctacctgctgagagcctgcagcggcccccagcaggccagcagcagcggcccccccaaccaccacagccagagcaccctgagaccccccctgccccccccccacaaccacaccctgagccaccaccacagcagcgccaacagcctgaacagaaacagcctgaccaacagaagaagccagatccacgcccccgcccccgcccccaacgacctggccaccacccccgagagcgtgcagctgcaggacagctgggtgctgaacagcaacgtgcccctggagaccagacacttcctgttcaagaccagcagcggcagcacccccctgttcagcagcagcagccccggctaccccctgaccagcggcaccgtgtacacccccccccccagactgctgcccagaaacaccttcagcagaaaggccttcaagctgaagaagcccagcaagtactgcagctggaagtgcgccgccctgagcgccatcgccgccgccctgctgctggccatcctgctggcctacttcatcgccatgcacctgctgggcctgaactggcagctgcagcccgccgacggccacaccttcaacaacggcatcagaaccggcctgcccggcaacgacgacgtggccaccatgcccagcggcggcaaggtgccctggagcctgaagaacagcagcatcgacagcggcgaggccgaggtgggcagaagagtgacccaggaggtgccccccggcgtgttctggagaagccagatccacatcagccagccccagttcctgaagttcaacatcagcctgggcaaggacgccctgttcggcgtgtacatcagaagaggcctgccccccagccacgcccagtacgacttcatggagagactggacggcaaggagaagtggagcgtggtggagagccccagagagagaagaagcatccagaccctggtgcagaacgaggccgtgttcgtgcagtacctggacgtgggcctgtggcacctggccttctacaacgacggcaaggacaaggagatggtgagcttcaacaccgtggtgctggacagcgtgcaggactgccccagaaactgccacggcaacggcgagtgcgtgagcggcgtgtgccactgcttccccggcttcctgggcgccgactgcgccaaggccgcctgccccgtgctgtgcagcggcaacggccagtacagcaagggcacctgccagtgctacagcggctggaagggcgccgagtgcgacgtgcccatgaaccagtgcatcgaccccagctgcggcggccacggcagctgcatcgacggcaactgcgtgtgcagcgccggctacaagggcgagcactgcgaggaggtggactgcctggaccccacctgcagcagccacggcgtgtgcgtgaacggcgagtgcctgtgcagccccggctggggcggcctgaactgcgagctggccagagtgcagtgccccgaccagtgcagcggccacggcacctacctgcccgacaccggcctgtgcagctgcgaccccaactggatgggccccgactgcagcgtggaggtgtgcagcgtggactgcggcacccacggcgtgtgcatcggcggcgcctgcagatgcgaggagggctggaccggcgccgcctgcgaccagagagtgtgccaccccagatgcatcgagcacggcacctgcaaggacggcaagtgcgagtgcagagagggctggaacggcgagcactgcaccatcgtgagagagaccatcggcggcgagtgctacggctgccccgacctgtgcaacggcaacggcagatgcaccctgggccagaacagctggcagtgcgtgtgccagaccggctggagaggccccggctgcaacgtggccatggagaccagctgcgccgacaacaaggacaacgagggcgacggcctggtggactgcctggaccccgactgctgcctgcagagcgcctgccagaacagcctgctgtgcagaggcagcagagaccccctggacatcatccagcagggccagaccgactggcccgccgtgaagagcttctacgacagaatcaagctgctggccggcaaggacagcacccacatcatccccggcgagaaccccttcaacagcagcctggtgagcctgatcagaggccaggtggtgaccaccgacggcacccccctggtgggcgtgaacgtgagcttcgtgaagtaccccaagtacggctacaccatcaccagacaggacggcaccttcgacctgatcgccaacggcggcgccagcctgaccctgcacttcgagagagcccccttcatgagccaggagagaaccgtgtggctgccctggaacagcttctacgccatggacaccctggtgatgaagaccgaggagaacagcatccccagctgcgacctgagcggcttcgtgagacccgaccccatcatcatcagcagccccctgagcaccttcttcagcgccgcccccggccagaaccccatcgtgcccgagacccaggtgctgcacgaggagatcgagctgcccggcagcaacgtgaagctgagatacctgagcagcagaaccgccggctacaagagcctgctgaagatcaccatgacccagagcaccgtgcccctgaacctgatcagagtgcacctgatggtggccgtggagggccacctgttccagaagagcttccaggccagccccaacctggcctacaccttcatctgggacaagaccgacgcctacggccagagagtgtacggcctgagcgacgccgtggtgagcgtgggcttcgagtacgagacctgccccagcctgatcctgtgggagaagagaaccgccctgctgcagggcttcgagctggaccccagcaacctgggcggctggagcctggacaagcaccacatcctgaacgtgaagagcggcatcctgcacaagggcaccggcgagaaccagttcctgacccagcagcccgccatcatcaccagcatcatgggcaacggcagaagaagaagcatcagctgccccagctgcaacggcctggccgagggcaacaagctgctggcccccgtggccctggccgtgggcatcgacggcagcctgtacgtgggcgacttcaactacatcagaagaatcttccccagcagaaacgtgaccagcatcctggagctgagaaacaaggagttccacaacaacaaccccgcccacaagtactacctggccgtggaccccgtgagcggcagcctgtacgtgagcgacaccaacagcagaagaatctacagagtgaagagcctgagcggcaccaaggacctggccggcaacagcgaggtggtggccggcaccggcgagcagtgcctgcccttcgacgaggccagatgcggcgacggcggcaaggccatcgacgccaccctgatgagccccagaggcatcgccgtggacaagaacggcctgatgtacttcgtggacgccaccatgatcagaaaggtggaccagaacggcatcatcagcaccctgctgggcagcaacgacctgaccgccgtgagacccctgagctgcgacagcagcatggacgtggcccaggtgagactggagtggcccaccgacctggccgtgaaccccatggacaacagcctgtacgtgctggagaacaacgtgatcctgagaatcaccgagaaccaccaggtgagcatcatcgccggcagacccatgcactgccaggtgcccggcatcgactacagcctgagcaagctggccatccacagcgccctggagagcgccagcgccatcgccatcagccacaccggcgtgctgtacatcaccgagaccgacgagaagaagatcaacagactgagacaggtgaccaccaacggcgagatctgcctgctggccggcgccgccagcgactgcgactgcaagaacgacgtgaactgcaactgctacagcggcgacgacgcctacgccaccgacgccatcctgaacagccccagcagcctggccgtggcccccgacggcaccatctacatcgccgacctgggcaacatcagaatcagagccgtgagcaagaacaagcccgtgctgaacgccttcaaccagtacgaggccgccagccccggcgagcaggagctgtacgtgttcaacgccgacggcatccaccagtacaccgtgagcctggtgaccggcgagtacctgtacaacttcacctacagcaccgacaacgacgtgaccgagctgatcgacaacaacggcaacagcctgaagatcagaagagacagcagcggcatgcccagacacctgctgatgcccgacaaccagatcatcaccctgaccgtgggcaccaacggcggcctgaaggtggtgagcacccagaacctggagctgggcctgatgacctacgacggcaacaccggcctgctggccaccaagagcgacgagaccggctggaccaccttctacgactacgaccacgagggcagactgaccaacgtgaccagacccaccggcgtggtgaccagcctgcacagagagatggagaagagcatcaccatcgacatcgagaacagcaacagagacgacgacgtgaccgtgatcaccaacctgagcagcgtggaggccagctacaccgtggtgcaggaccaggtgagaaacagctaccagctgtgcaacaacggcaccctgagagtgatgtacgccaacggcatgggcatcagcttccacagcgagccccacgtgctggccggcaccatcacccccaccatcggcagatgcaacatcagcctgcccatggagaacggcctgaacagcatcgagtggagactgagaaaggagcagatcaagggcaaggtgaccatcttcggcagaaagctgagagtgcacggcagaaacctgctgagcatcgactacgacagaaacatcagaaccgagaagatctacgacgaccacagaaagttcaccctgagaatcatctacgaccaggtgggcagacccttcctgtggctgcccagcagcggcctggccgccgtgaacgtgagctacttcttcaacggcagactggccggcctgcagagaggcgccatgagcgagagaaccgacatcgacaagcagggcagaatcgtgagcagaatgttcgccgacggcaaggtgtggagctacagctacctggacaagagcatggtgctgctgctgcagagccagagacagtacatcttcgagtacgacagcagcgacagactgctggccgtgaccatgcccagcgtggccagacacagcatgagcacccacaccagcatcggctacatcagaaacatctacaacccccccgagagcaacgccagcgtgatcttcgactacagcgacgacggcagaatcctgaagaccagcttcctgggcaccggcagacaggtgttctacaagtacggcaagctgagcaagctgagcgagatcgtgtacgacagcaccgccgtgaccttcggctacgacgagaccaccggcgtgctgaagatggtgaacctgcagagcggcggcttcagctgcaccatcagatacagaaagatcggccccctggtggacaagcagatctacagattcagcgaggagggcatggtgaacgccagattcgactacacctaccacgacaacagcttcagaatcgccagcatcaagcccgtgatcagcgagacccccctgcccgtggacctgtacagatacgacgagatcagcggcaaggtggagcacttcggcaagttcggcgtgatctactacgacatcaaccagatcatcaccaccgccgtgatgaccctgagcaagcacttcgacacccacggcagaatcaaggaggtgcagtacgagatgttcagaagcctgatgtactggatgaccgtgcagtacgacagcatgggcagagtgatcaagagagagctgaagctgggcccctacgccaacaccaccaagtacacctacgactacgacggcgacggccagctgcagagcgtggccgtgaacgacagacccacctggagatacagctacgacctgaacggcaacctgcacctgctgaaccccggcaacagcgtgagactgatgcccctgagatacgacctgagagacagaatcaccagactgggcgacgtgcagtacaagatcgacgacgacggctacctgtgccagagaggcagcgacatcttcgagtacaacagcaagggcctgctgaccagagcctacaacaaggccagcggctggagcgtgcagtacagatacgacggcgtgggcagaagagccagctacaagaccaacctgggccaccacctgcagtacttctacagcgacctgcacaaccccaccagaatcacccacgtgtacaaccacagcaacagcgagatcaccagcctgtactacgacctgcagggccacctgttcgccatggagagcagcagcggcgaggagtactacgtggccagcgacaacaccggcacccccctggccgtgttcagcatcaacggcctgatgatcaagcagctgcagtacaccgcctacggcgagatctactacgacagcaaccccgacttccagatggtgatcggcttccacggcggcctgtacgaccccctgaccaagctggtgcacttcacccagagagactacgacgtgctggccggcagatggaccagccccgactacaccatgtggaagaacgtgggcaaggagcccgcccccttcaacctgtacatgttcaagagcaacaaccccctgagcagcgagctggacctgaagaactacgtgaccgacgtgaagagctggctggtgatgttcggcttccagctgagcaacatcatccccggcttccccagagccaagatgtacttcgtgccccccccctacgagctgagcgagagccaggccagcgagaacggccagctgatcaccggcgtgcagcagaccaccgagagacacaaccaggccttcatggccctggagggccaggtgatcaccaagaagctgcacgccagcatcagagagaaggccggccactggttcgccaccaccacccccatcatcggcaagggcatcatgttcgccatcaaggagggcagagtgaccaccggcgtgagcagcatcgccagcgaggacagcagaaaggtggccagcgtgctgaacaacgcctactacctggacaagatgcactacagcatcgagggcaaggacacccactacttcgtgaagatcggcagcgccgacggcgacctggtgaccctgggcaccaccatcggcagaaaggtgctggagagcggcgtgaacgtgaccgtgagccagcccaccctgctggtgaacggcagaaccagaagattcaccaacatcgagttccagtacagcaccctgctgctgagcatcagatacggcctgacccccgacaccctggacgaggagaaggccagagtgctggaccaggccagacagagagccctgggcaccgcctgggccaaggagcagcagaaggccagagacggcagagagggcagcagactgtggaccgagggcgagaagcagcagctgctgagcaccggcagagtgcagggctacgagggctactacgtgctgcccgtggagcagtaccccgagctggccgacagcagcagcaacatccagttcctgagacagaacgagatgggcaagagatag

SEQ ID NO: 20163 - DNA, 8100 bp, Artificial Sequence
  Description of Artificial Sequence: Synthetic coding sequence
atggacgtgaaggagagaagaccctactgcagcctgaccaagagcagaagagagaaggagagaagatacaccaacagcagcgccgacaacgaggagtgcagagtgcccacccagaagagctacagcagcagcgagaccctgaaggccttcgaccacgacagcagcagactgctgtacggcaacagagtgaaggacctggtgcacagagaggccgacgagttcaccagacagggccagaacttcaccctgagacagctgggcgtgtgcgagcccgccaccagaagaggcctggccttctgcgccgagatgggcctgccccacagaggctacagcatcagcgccggcagcgacgccgacaccgagaacgaggccgtgatgagccccgagcacgccatgagactgtggggcagaggcgtgaagagcggcagaagcagctgcctgagcagcagaagcaacagcgccctgaccctgaccgacaccgagcacgagaacaagagcgacagcgagaacgagcagcccgccagcaaccagggccagagcaccctgcagcccctgccccccagccacaagcagcacagcgcccagcaccaccccagcatcaccagcctgaacagaaacagcctgaccaacagaagaaaccagagccccgccccccccgccgccctgcccgccgagctgcagaccacccccgagagcgtgcagctgcaggacagctgggtgctgggcagcaacgtgcccctggagagcagacacttcctgttcaagaccggcaccggcaccacccccctgttcagcaccgccacccccggctacaccatggccagcggcagcgtgtacagcccccccaccagacccctgcccagaaacaccctgagcagaagcgccttcaagttcaagaagagcagcaagtactgcagctggaagtgcaccgccctgtgcgccgtgggcgtgagcgtgctgctggccatcctgctgagctacttcatcgccatgcacctgttcggcctgaactggcagctgcagcagaccgagaacgacaccttcgagaacggcaaggtgaacagcgacaccatgcccaccaacaccgtgagcctgcccagcggcgacaacggcaagctgggcggcttcacccaggagaacaacaccatcgacagcggcgagctggacatcggcagaagagccatccaggagatcccccccggcatcttctggagaagccagctgttcatcgaccagccccagttcctgaagttcaacatcagcctgcagaaggacgccctgatcggcgtgtacggcagaaagggcctgccccccagccacacccagtacgacttcgtggagctgctggacggcagcagactgatcgccagagagcagagaagcctgctggagaccgagagagccggcagacaggccagaagcgtgagcctgcacgaggccggcttcatccagtacctggacagcggcatctggcacctggccttctacaacgacggcaagaacgccgagcaggtgagcttcaacaccatcgtgatcgagagcgtggtggagtgccccagaaactgccacggcaacggcgagtgcgtgagcggcacctgccactgcttccccggcttcctgggccccgactgcagcagagccgcctgccccgtgctgtgcagcggcaacggccagtacagcaagggcagatgcctgtgcttcagcggctggaagggcaccgagtgcgacgtgcccaccacccagtgcatcgacccccagtgcggcggcagaggcatctgcatcatgggcagctgcgcctgcaacagcggctacaagggcgagagctgcgaggaggccgactgcatcgaccccggctgcagcaaccacggcgtgtgcatccacggcgagtgccactgcagccccggctggggcggcagcaactgcgagatcctgaagaccatgtgccccgaccagtgcagcggccacggcacctacctgcaggagagcggcagctgcacctgcgaccccaactggaccggccccgactgcagcaacgagatctgcagcgtggactgcggcagccacggcgtgtgcatgggcggcacctgcagatgcgaggagggctggaccggccccgcctgcaaccagagagcctgccaccccagatgcgccgagcacggcacctgcaaggacggcaagtgcgagtgcagccagggctggaacggcgagcactgcaccatcgagggctgccccggcctgtgcaacagcaacggcagatgcaccctggaccagaacggctggcactgcgtgtgccagcccggctggagaggcgccggctgcgacgtggccatggagaccctgtgcaccgacagcaaggacaacgagggcgacggcctgatcgactgcatggaccccgactgctgcctgcagagcagctgccagaaccagccctactgcagaggcctgcccgacccccaggacatcatcagccagagcctgcagagccccagccagcaggccgccaagagcttctacgacagaatcagcttcctgatcggcagcgacagcacccacgtgatccccggcgagagccccttcaacaagagcctggccagcgtgatcagaggccaggtgctgaccgccgacggcacccccctgatcggcgtgaacgtgagcttcttccactaccccgagtacggctacaccatcaccagacaggacggcatgttcgacctggtggccaacggcggcgccagcctgaccctggtgttcgagagaagccccttcctgacccagtaccacaccgtgtggatcccctggaacgtgttctacgtgatggacaccctggtgatgaagaaggaggagaacgacatccccagctgcgacctgagcggcttcgtgagacccaaccccatcatcgtgagcagccccctgagcaccttcttcagaagcagccccgaggacagccccatcatccccgagacccaggtgctgcacgaggagaccaccatccccggcaccgacctgaagctgagctacctgagcagcagagccgccggctacaagagcgtgctgaagatcaccatgacccagagcatcatccccttcaacctgatgaaggtgcacctgatggtggccgtggtgggcagactgttccagaagtggttccccgccagccccaacctggcctacaccttcatctgggacaagaccgacgcctacaaccagaaggtgtacggcctgagcgaggccgtggtgagcgtgggctacgagtacgagagctgcctggacctgaccctgtgggagaagagaaccgccatcctgcagggctacgagctggacgccagcaacatgggcggctggaccctggacaagcaccacgtgctggacgtgcagaacggcatcctgtacaagggcaacggcgagaaccagttcatcagccagcagccccccgtggtgagcagcatcatgggcaacggcagaagaagaagcatcagctgccccagctgcaacggccaggccgacggcaacaagctgctggcccccgtggccctggcctgcggcatcgacggcagcctgtacgtgggcgacttcaactacgtgagaagaatcttccccagcggcaacgtgaccagcgtgctggagctgagcagcaaccccgcccacagatactacctggccaccgaccccgtgaccggcgacctgtacgtgagcgacaccaacaccagaagaatctacagacccaagagcctgaccggcgccaaggacctgaccaagaacgccgaggtggtggccggcaccggcgagcagtgcctgcccttcgacgaggccagatgcggcgacggcggcaaggccgtggaggccaccctgatgagccccaagggcatggccgtggacaagaacggcctgatctacttcgtggacggcaccatgatcagaaaggtggaccagaacggcatcatcagcaccctgctgggcagcaacgacctgaccagcgccagacccctgacctgcgacaccagcatgcacatcagccaggtgagactggagtggcccaccgacctggccatcaaccccatggacaacagcatctacgtgctggacaacaacgtggtgctgcagatcaccgagaacagacaggtgagaatcgccgccggcagacccatgcactgccaggtgcccggcgtggagtaccccgtgggcaagcacgccgtgcagaccaccctggagagcgccaccgccatcgccgtgagctacagcggcgtgctgtacatcaccgagaccgacgagaagaagatcaacagaatcagacaggtgaccaccgacggcgagatcagcctggtggccggcatccccagcgagtgcgactgcaagaacgacgccaactgcgactgctaccagagcggcgacggctacgccaaggacgccaagctgagcgcccccagcagcctggccgccagccccgacggcaccctgtacatcgccgacctgggcaacatcagaatcagagccgtgagcaagaacaagcccctgctgaacagcatgaacttctacgaggtggccagccccaccgaccaggagctgtacatcttcgacatcaacggcacccaccagtacaccgtgagcctggtgaccggcgactacctgtacaacttcagctacagcaacgacaacgacatcaccgccgtgaccgacagcaacggcaacaccctgagaatcagaagagaccccaacagaatgcccgtgagagtggtgagccccgacaaccaggtgatctggctgaccatcggcaccaacggctgcctgaagagcatgaccgcccagggcctggagctggtgctgttcacctaccacggcaacagcggcctgctggccaccaagagcgacgagaccggctggaccaccttcttcgactacgacagcgagggcagactgaccaacgtgaccttccccaccggcgtggtgaccaacctgcacggcgacatggacaaggccatcaccgtggacatcgagagcagcagcagagaggaggacgtgagcatcaccagcaacctgagcagcatcgacagcttctacaccatggtgcaggaccagctgagaaacagctaccagatcggctacgacggcagcctgagaatcatctacgccagcggcctggacagccactaccagaccgagccccacgtgctggccggcaccgccaaccccaccgtggccaagagaaacatgaccctgcccggcgagaacggccagaacctggtggagtggagattcagaaaggagcaggcccagggcaaggtgaacgtgttcggcagaaagctgagagtgaacggcagaaacctgctgagcgtggacttcgacagaaccaccaagaccgagaagatctacgacgaccacagaaagttcctgctgagaatcgcctacgacaccagcggccaccccaccctgtggctgcccagcagcaagctgatggccgtgaacgtgacctacagcagcaccggccagatcgccagcatccagagaggcaccaccagcgagaaggtggactacgacggccagggcagaatcgtgagcagagtgttcgccgacggcaagacctggagctacacctacctggagaagagcatggtgctgctgctgcacagccagagacagtacatcttcgagtacgacatgtgggacagactgagcgccatcaccatgcccagcgtggccagacacaccatgcagaccatcagaagcatcggctactacagaaacatctacaacccccccgagagcaacgccagcatcatcaccgactacaacgaggagggcctgctgctgcagaccgccttcctgggcaccagcagaagagtgctgttcaagtacagaagacagaccagactgagcgagatcctgtacgacagcaccagagtgagcttcacctacgacgagaccgccggcgtgctgaagaccgtgaacctgcagagcgacggcttcatctgcaccatcagatacagacagatcggccccctgatcgacagacagatcttcagattcagcgaggacggcatggtgaacgccagattcgactacagctacgacaacagcttcagagtgaccagcatgcagggcgtgatcaacgagacccccctgcccatcgacctgtaccagttcgacgacatcagcggcaaggtggagcagttcggcaagttcggcgtgatctactacgacatcaaccagatcatcagcaccgccgtgatgacctacaccaagcacttcgacgcccacggcagaatcaaggagatccagtacgagatcttcagaagcctgatgtactggatcaccatccagtacgacaacatgggcagagtgaccaagagagagatcaagatcggccccttcgccaacaccaccaagtacgcctacgagtacgacgtggacggccagctgcagaccgtgtacctgaacgagaagatcatgtggagatacaactacgacctgaacggcaacctgcacctgctgaaccccagcaacagcgccagactgacccccctgagatacgacctgagagacagaatcaccagactgggcgacgtgcagtacagactggacgaggacggcttcctgagacagagaggcaccgagatcttcgagtacagcagcaagggcctgctgaccagagtgtacagcaagggcagcggctggaccgtgatctacagatacgacggcctgggcagaagagtgagcagcaagaccagcctgggccagcacctgcagttcttctacgccgacctgacctaccccaccagaatcacccacgtgtacaaccacagcagcagcgagatcaccagcctgtactacgacctgcagggccacctgttcgccatggagatcagcagcggcgacgagttctacatcgccagcgacaacaccggcacccccctggccgtgttcagcagcaacggcctgatgctgaagcagatccagtacaccgcctacggcgagatctacttcgacagcaacatcgacttccagctggtgatcggcttccacggcggcctgtacgaccccctgaccaagctgatccacttcggcgagagagactacgacatcctggccggcagatggaccacccccgacatcgagatctggaagagaatcggcaaggaccccgcccccttcaacctgtacatgttcagaaacaacaaccccgccagcaagatccacgacgtgaaggactacatcaccgacgtgaacagctggctggtgaccttcggcttccacctgcacaacgccatccccggcttccccgtgcccaagttcgacctgaccgagcccagctacgagctggtgaagagccagcagtgggacgacatcccccccatcttcggcgtgcagcagcaggtggccagacaggccaaggccttcctgagcctgggcaagatggccgaggtgcaggtgagcagaagaagagccggcggcgcccagagctggctgtggttcgccaccgtgaagagcctgatcggcaagggcgtgatgctggccgtgagccagggcagagtgcagaccaacgtgctgaacatcgccaacgaggactgcatcaaggtggccgccgtgctgaacaacgccttctacctggagaacctgcacttcaccatcgagggcaaggacacccactacttcatcaagaccaccacccccgagagcgacctgggcaccctgagactgaccagcggcagaaaggccctggagaacggcatcaacgtgaccgtgagccagagcaccaccgtggtgaacggcagaaccagaagattcgccgacgtggagatgcagttcggcgccctggccctgcacgtgagatacggcatgaccctggacgaggagaaggccagaatcctggagcaggccagacagagagccctggccagagcctgggccagagagcagcagagagtgagagacggcgaggagggcgccagactgtggaccgagggcgagaagagacagctgctgagcgccggcaaggtgcagggctacgacggctactacgtgctgagcgtggagcagtaccccgagctggccgacagcgccaacaacatccagttcctgagacagagcgagatcggcagaagatag

SEQ ID NO: 20164 - DNA, 8100 bp, Artificial Sequence; identical to SEQ ID NO: 20163
  Description of Artificial Sequence: Synthetic coding sequence

SEQ ID NO: 20165 - DNA, 513 bp, Artificial Sequence
  Description of Artificial Sequence: Synthetic coding sequence
atggacgtgaaggagagaagaccctactgcagcctgaccaagagcagaagagagaaggagagaagatacaccaacagcagcgccgacaacgaggagtgcagagtgcccacccagaagagctacagcagcagcgagaccctgaaggccttcgaccacgacagcagcagactgctgtacggcaacagagtgaaggacctggtgcacagagaggccgacgagttcaccagacagggccagaacttcaccctgagacagctgggcgtgtgcgagcccgccaccagaagaggcctggccttctgcgccgagatgggcctgccccacagaggctacagcatcagcgccggcagcgacgccgacaccgagaacgaggccgtgatgagccccgagcacgccatgagactgtggggcagaggcgtgaagagcggcagaagcagctgcctgagcagcagaagcaacagcgccctgaccctgaccgacaccgagcacgagaacaagagcgacagcgagaactag

SEQ ID NO: 20166 - DNA, 981 bp, Artificial Sequence
  Description of Artificial Sequence: Synthetic coding sequence
atgtgccccctgaccctgcaggtgaccggcctgatgaacgtgagcgagcccaacagcagcttcgccttcgtgaacgagttcatcctgcagggcttcacctgcgagtggaccatccagatcttcctgttcagcctgttcaccaccacctacgccctgaccatcaccggcaacggcgccatcgccttcgtgctgtggtgcgactggagactgcacacccccatgtacatgttcctgggcaacttcagcttcctggagatctggtacgtgagcagcaccgtgcccaagatgctggtgaacttcctgagcgagaagaagaacatcagcttcgccggctgcttcctgcagttctacttcttcttcagcctgggcaccagcgagtgcctgctgctgaccgtgatggccttcgaccagtacctggccatctgcagacccctgctgtaccccaacatcatgaccggccacctgtgcgccaagctggtgatcctgtgctgggtgtgcggcttcctgtggttcctgatccccatcgtgctgatcagccagatgcccttctgcggccccaacatcatcgaccacgtggtgtgcgaccccggccccagattcgccctggactgcgtgagcgcccccagaatccagctgttctgctacaccctgagcagcctggtgatcttcggcaacttcctgttcatcatcggcagctacaccctggtgctgaaggccgtgctgggcatgcccagcagcaccggcagacacaaggccttcagcacctgcggcagccacctggccgtggtgagcctgtgctacagcagcctgatggtgatgtacgtgagccccggcctgggccacagcaccggcatgcagaagatcgagaccctgttctacgccatggtgacccccctgttcaaccccctgatctacagcctgcagaacaaggagatcaaggccgccctgagaaaggtgctgggcagcagcaacatcatctag

SEQ ID NO: 20167 - DNA, 960 bp, Artificial Sequence
  Description of Artificial Sequence: Synthetic coding sequence
atggagcccggcaacgacacccagatcagcgagttcctgctgctgggcttcagccaggagcccggcctgcagcccttcctgttcggcctgttcctgagcatgtacctggtgaccgtgctgggcaacctgctgatcatcctggccaccatcagcgacagccacctgcacacccccatgtacttcttcctgagcaacctgagcttcgccgacatctgcgtgaccagcaccaccatccccaagatgctgatgaacatccagacccagaacaaggtgatcacctacatcgcctgcctgatgcagatgtacttcttcatcctgttcgccggcttcgagaacttcctgctgagcgtgatggcctacgacagattcgtggccatctgccaccccctgcactacatggtgatcatgaacccccacctgtgcggcctgctggtgctggccagctggaccatgagcgccctgtacagcctgctgcagatcctgatggtggtgagactgagcttctgcaccgccctggagatcccccacttcttctgcgagctgaaccaggtgatccagctggcctgcagcgacagcttcctgaaccacatggtgatctacttcaccgtggccctgctgggcggcggccccctgaccggcatcctgtacagctacagcaagatcatcagcagcatccacgccatcagcagcgcccagggcaagtacaaggccttcagcacctgcgccagccacctgagcgtggtgagcctgttctacggcgccatcctgggcgtgtacctgagcagcgccgccaccagaaacagccacagcagcgccaccgccagcgtgatgtacaccgtggtgacccccatgctgaaccccttcatctacagcctgagaaacaaggacatcaagagagccctgggcatccacctgctgtggggcaccatgaagggccagttcttcaagaagtgcccctag

SEQ ID NO: 20168 - DNA, 930 bp, Artificial Sequence
  Description of Artificial Sequence: Synthetic coding sequence
atgagagagaacaaccagagcagcaccctggagttcatcctgctgggcgtgaccggccagcaggagcaggaggacttcttctacatcctgttcctgttcatctaccccatcaccctgatcggcaacctgctgatcgtgctggccatctgcagcgacgtgagactgcacaaccccatgtacttcctgctggccaacctgagcctggtggacatcttcttcagcagcgtgaccatccccaagatgctggccaaccacctgctgggcagcaagagcatcagcttcggcggctgcctgacccagatgtacttcatgatcgccctgggcaacaccgacagctacatcctggccgccatggcctacgacagagccgtggccatcagcagacccctgcactacaccaccatcatgagccccagaagctgcatctggctgatcgccggcagctgggtgatcggcaacgccaacgccctgccccacaccctgctgaccgccagcctgagcttctgcggcaaccaggaggtggccaacttctactgcgacatcacccccctgctgaagctgagctgcagcgacatccacttccacgtgaagatgatgtacctgggcgtgggcatcttcagcgtgcccctgctgtgcatcatcgtgagctacatcagagtgttcagcaccgtgttccaggtgcccagcaccaagggcgtgctgaaggccttcagcacctgcggcagccacctgaccgtggtgagcctgtactacggcaccgtgatgggcacctacttcagacccctgaccaactacagcctgaaggacgccgtgatcaccgtgatgtacaccgccgtgacccccatgctgaaccccttcatctacagcctgagaaacagagacatgaaggccgccctgagaaagctgttcaacaagagaatcagcagctag

SEQ ID NO: 20169 - DNA, 930 bp, Artificial Sequence
  Description of Artificial Sequence: Synthetic coding sequence
atgaagaaggagaaccagagcttcaacctggacttcatcctgctgggcgtgaccagccagcaggagcagaacaacgtgttcttcgtgatcttcctgtgcatctaccccatcaccctgaccggcaacctgctgatcatcctggccatctgcgccgacatcagactgcacaaccccatgtacttcctgctggccaacctgagcctggtggacatcatcttcagcagcgtgaccatccccaaggtgctggccaaccacctgctgggcagcaagttcatcagcttcggcggctgcctgatgcagatgtacttcatgatcgccctggccaaggccgacagctacaccctggccgccatggcctacgacagagccgtggccatcagctgccccctgcactacaccaccatcatgagccccagaagctgcatcctgctgatcgccggcagctgggtgatcggcaacaccagcgccctgccccacaccctgctgaccgccagcctgagcttctgcggcaaccaggaggtggccaacttctactgcgacatcatgcccctgctgaagctgagctgcagcgacgtgcacttcaacgtgaagatgatgtacctgggcgtgggcgtgttcagcctgcccctgctgtgcatcatcgtgagctacgtgcaggtgttcagcaccgtgttccaggtgcccagcaccaagagcctgttcaaggccttctgcacctgcggcagccacctgaccgtggtgttcctgtactacggcaccaccatgggcatgtacttcagacccctgaccagctacagccccaaggacgccgtgatcaccgtgatgtacgtggccgtgacccccgccctgaaccccttcatctacagcctgagaaactgggacatgaaggccgccctgcagaagctgttcagcaagagaatcagcagctag

SEQ ID NO: 20170 - DNA, 957 bp, Artificial Sequence
  Description of Artificial Sequence: Synthetic coding sequence
atgatgagcttcgcccccaacgccagccacagccccgtgttcctgctgctgggcttcagcagagccaacatcagctacaccctgctgttcttcctgttcctggccatctacctgaccaccatcctgggcaacgtgaccctggtgctgctgatcagctgggacagcagactgcacagccccatgtactacctgctgagaggcctgagcgtgatcgacatgggcctgagcaccgtgaccctgccccagctgctggcccacctggtgagccactaccccaccatccccgccgccagatgcctggcccagttcttcttcttctacgccttcggcgtgaccgacaccctggtgatcgccgtgatggccctggacagatacgtggccatctgcgaccccctgcactacgccctggtgatgaaccaccagagatgcgcctgcctgctggccctgagctgggtggtgagcatcctgcacaccatgctgagagtgggcctggtgctgcccctgtgctggaccggcgacgccggcggcaacgtgaacctgccccacttcttctgcgaccacagacccctgctgagagccagctgcagcgacatccacagcaacgagctggccatcttcttcgagggcggcttcctgatgctgggcccctgcgccctgatcgtgctgagctacgtgagaatcggcgccgccatcctgagactgcccagcgccgccggcagaagaagagccgtgagcacctgcggcagccacctgaccatggtgggcttcctgtacggcaccatcatctgcgtgtacttccagccccccttccagaacagccagtaccaggacatggtggccagcgtgatgtacaccgccatcacccccctggccaaccccttcgtgtacagcctgcacaacaaggacgtgaagggcgccctgtgcagactgctggagtgggtgaaggtggacccctag

SEQ ID NO: 20171 - DNA, 945 bp, Artificial Sequence
  Description of Artificial Sequence: Synthetic coding sequence
atggagaagagaaacctgaccgtggtgagagagttcgtgctgctgggcctgcccagcagcgccgagcagcagcacctgctgagcgtgctgttcctgtgcatgtacctggccaccaccctgggcaacatgctgatcatcgccaccatcggcttcgacagccacctgcacagccccatgtacttcttcctgagcaacctggccttcgtggacatctgcttcaccagcaccaccgtgccccagatggtggtgaacatcctgaccggcaccaagaccatcagcttcgccggctgcctgacccagctgttcttcttcgtgagcttcgtgaacatggacagcctgctgctgtgcgtgatggcctacgacagatacgtggccatctgccaccccctgcactacaccgccagaatgaacctgtgcctgtgcgtgcagctggtggccggcctgtggctggtgacctacctgcacgccctgctgcacaccgtgctgatcgcccagctgagcttctgcgccagcaacatcatccaccacttcttctgcgacctgaaccccctgctgcagctgagctgcagcgacgtgagcttcaacgtgatgatcatcttcgccgtgggcggcctgctggccctgacccccctggtgtgcatcctggtgagctacggcctgatcttcagcaccgtgctgaagatcaccagcacccagggcaagcagagagccgtgagcacctgcagctgccacctgagcgtggtggtgctgttctacggcaccgccatcgccgtgtacttcagccccagcagcccccacatgcccgagagcgacaccctgagcaccatcatgtacagcatggtggcccccatgctgaaccccttcatctacaccctgagaaacagagacatgaagagaggcctgcagaagatgctgctgaagtgcaccgtgttccagcagcagtag

SEQ ID NO: 20172 - DNA, 945 bp, Artificial Sequence
  Description of Artificial Sequence: Synthetic coding sequence
atgatgggccagaaccagaccagcatcagcgacttcctgctgctgggcctgcccatccagcccgagcagcagaacctgtgctacgccctgttcctggccatgtacctgaccaccctgctgggcaacctgctgatcatcgtgctgatcagactggacagccacctgcacacccccatgtacctgttcctgagcaacctgagcttcagcgacctgtgcttcagcagcgtgaccatccccaagctgctgcagaacatgcagaaccaggaccccagcatcccctacgccgactgcctgacccagatgtacttcttcctgctgttcggcgacctggagagcttcctgctggtggccatggcctacgacagatacgtggccatctgcttccccctgcactacaccgccatcatgagccccatgctgtgcctggccctggtggccctgagctgggtgctgaccaccttccacgccatgctgcacaccctgctgatggccagactgtgcttctgcgccgacaacgtgatcccccacttcttctgcgacatgagcgccctgctgaagctggccttcagcgacaccagagtgaacgagtgggtgatcttcatcatgggcggcctgatcctggtgatccccttcctgctgatcctgggcagctacgccagaatcgtgagcagcatcctgaaggtgcccagcagcaagggcatctgcaaggccttcagcacctgcggcagccacctgagcgtggtgagcctgttctacggcaccgtgatcggcctgtacctgtgcagcagcgccaacagcagcaccctgaaggacaccgtgatggccatgatgtacaccgtggtgacccccatgctgaaccccttcatctacagcctgagaaacagagacatgaagggcgccctgagcagagtgatccaccagaagaagaccttcttcagcctgtag

SEQ ID NO: 20173 - DNA, 972 bp, Artificial Sequence
  Description of Artificial Sequence: Synthetic coding sequence
atgatgggccagaaccagaccagcatcagcgacttcctgctgctgggcctgcccatccagcccgagcagcagaacctgtgctacgccctgttcctggccatgtacctgaccaccctgctgggcaacctgctgatcatcgtgctgatcagactggacagccacctgcacacccccgtgtacctgttcctgagcaacctgagcttcagcgacctgtgcttcagcagcgtgaccatgcccaagctgctgcagaacatgcagaaccaggaccccagcatcccctacgccgactgcctgacccagatgtacttcttcctgtacttcagcgacctggagagcttcctgctggtggccatggcctacgacagatacgtggccatctgcttccccatgcactacaccgccatctgcttcctgctgcactacaccgccatcatgagccccatgctgtgcctgagcgtggtggccctgagctgggtgctgaccaccttccacgccatgctgcacaccctgctgatggccagactgtgcttctgcgccgacaacgtgatcccccacttcttctgcgacatgagcgccctgctgaagctggcctgcagcgacaccagagtgaacgagtgggtgatcttcatcatgggcggcctgatcctggtgatccccttcctgctgatcctgggcagctacgccagaatcgtgagcagcatcctgaaggtgcccagcagcaagggcatctgcaaggccttcagcacctgcggcagccacctgagcgtggtgagcctgttctacggcaccgtgatcggcctgtacctgtgccccagcgccaacagcagcaccctgaaggacaccgtgatggccatgatgtacaccgtggtgacccccatgctgacccccttcatctacagcctgagaaacagagacatgaagggcgccctggagagagtgatctgcaagagaaagaaccccttcctgctgtag

SEQ ID NO: 20174 - DNA, 942 bp, Artificial Sequence
  Description of Artificial Sequence: Synthetic coding sequence
atggagggcaagaacctgaccagcatcagcgagtgcttcctgctgggcttcagcgagcagctggaggagcagaagcccctgttcggcagcttcctgttcatgtacctggtgaccgtggccggcaacctgctgatcatcctggtgatcatcaccgacacccagctgcacacccccatgtacttcttcctggccaacctgagcctggccgacgcctgcttcgtgagcaccaccgtgcccaagatgctggccaacatccagatccagagccaggccatcagctacagcggctgcctgctgcagctgtacttcttcatgctgttcgtgatgctggaggccttcctgctggccgtgatggcctacgactgctacgtggccatctgccaccccctgcactacatcctgatcatgagccccggcctgtgcatcttcctggtgagcgccagctggatcatgaacgccctgcacagcctgctgcacaccctgctgatgaacagcctgagcttctgcgccaaccacgagatcccccacttcttctgcgacatcaaccccctgctgagcctgagctgcaccgaccccttcaccaacgagctggtgatcttcatcaccggcggcctgaccggcctgatctgcgtgctgtgcctgatcatcagctacaccaacgtgttcagcaccatcctgaagatccccagcgcccagggcaagagaaaggccttcagcacctgcagcagccacctgagcgtggtgagcctgttcttcggcaccagcttctgcgtggacttcagcagccccagcacccacagcgcccagaaggacaccgtggccagcgtgatgtacaccgtggtgacccccatgctgaaccccttcatctacagcctgagaaaccaggagatcaagagcagcctgagaaagctgatctgggtgagaaagatccacagcccctag

SEQ ID NO: 20175 - DNA, 1611 bp, Artificial Sequence
  Description of Artificial Sequence: Synthetic coding sequence
atggccgagcacgcccccagaagatgctgcctgggctgggacttcagcacccagcaggtgaaggtggtggccgtggacgccgagctgaacgtgttctacgaggagagcgtgcacttcgacagagacctgcccgagttcggcacccagggcggcgtgcacgtgcacaaggacggcctgaccgtgaccagccccgtgctgatgtgggtgcaggccctggacatcatcctggagaagatgaaggccagcggcttcgacttcagccaggtgctggccctgagcggcgccggccagcagcacggcagcatctactggaaggccggcgcccagcaggccctgaccagcctgagccccgacctgagactgcaccagcagctgcaggactgcttcagcatcagcgactgccccgtgtggatggacagcagcaccaccgcccagtgcagacagctggaggccgccgtgggcggcgcccaggccctgagctgcctgaccggcagcagagcctacgagagattcaccggcaaccagatcgccaagatctaccagcagaaccccgaggcctacagccacaccgagagaatcagcctggtgagcagcttcgccgccagcctgttcctgggcagctacagccccatcgactacagcgacggcagcggcatgaacctgctgcagatccaggacaaggtgtggagccaggcctgcctgggcgcctgcgccccccacctggaggagaagctgagcccccccgtgcccagctgcagcgtggtgggcgccatcagcagctactacgtgcagagatacggcttcccccccggctgcaaggtggtggccttcaccggcgacaaccccgccagcctggccggcatgagactggaggagggcgacatcgccgtgagcctgggcaccagcgacaccctgttcctgtggctgcaggagcccatgcccgccctggagggccacatcttctgcaaccccgtggacagccagcactacatggccctgctgtgcttcaagaacggcagcctgatgagagagaagatcagaaacgagagcgtgagcagaagctggagcgacttcagcaaggccctgcagagcaccgagatgggcaacggcggcaacctgggcttctacttcgacgtgatggagatcacccccgagatcatcggcagacacagattcaacaccgagaaccacaaggtggccgccttccccggcgacgtggaggtgagagccctgatcgagggccagttcatggccaagagaatccacgccgagggcctgggctacagagtgatgagcaagaccaagatcctggccaccggcggcgccagccacaacagagagatcctgcaggtgctggccgacgtgttcgacgcccccgtgtacgtgatcgacaccgccaacagcgcctgcgtgggcagcgcctacagagccttccacggcctggccggcggcaccgacgtgcccttcagcgaggtggtgaagctggcccccaaccccagactggccgccacccccagccccggcgccagccaggtgtacgaggccctgctgccccagtacgccaagctggagcagagaatcctgagccagaccagaggcccccccgagtag

SEQ ID NO: 20176 - DNA, 969 bp, Artificial Sequence
  Description of Artificial Sequence: Synthetic coding sequence
atgagccccgagaaccagagcagcgtgagcgagttcctgctgctgggcctgcccatcagacccgagcagcaggccgtgttcttcgccctgttcctgggcatgtacctgaccaccgtgctgggcaacctgctgatcatgctgctgatccagctggacagccacctgcacacccccatgtacttcttcctgagccacctggccctgaccgacatcagcttcagcagcgtgaccgtgcccaagatgctgatgaacatgcagacccagcacctggccgtgttctacaagggctgcatcagccagacctacttcttcatcttcttcgccgacctggacagcttcctgatcaccagcatggcctacgacagatacgtggccatctgccaccccctgcactacgccaccatcatgacccagagccagtgcgtgatgctggtggccggcagctgggtgatcgcctgcgcctgcgccctgctgcacaccctgctgctggcccagctgagcttctgcgccgaccacatcatcccccactacttctgcgacctgggcgccctgctgaagctgagctgcagcgacaccagcctgaaccagctggccatcttcaccgccgccctgaccgccatcatgctgcccttcctgtgcatcctggtgagctacggccacatcggcgtgaccatcctgcagatccccagcaccaagggcatctgcaaggccctgagcacctgcggcagccacctgagcgtggtgaccatctactacagaaccatcatcggcctgtacttcctgccccccagcagcaacaccaacgacaagaacatcatcgccagcgtgatctacaccgccgtgacccccatgctgaaccccttcatctacagcctgagaaacaaggacatcaagggcgccctgagaaagctgctgagcagaagcggcgccgtggcccacgcctgcaacctgaacaccctgggcggctag

SEQ ID NO: 20177 - DNA, 942 bp, Artificial Sequence
  Description of Artificial Sequence: Synthetic coding sequence
atgagccccgagaaccagagcagcgtgagcgagttcctgctgctgggcctgcccatcagacccgagcagcaggccgtgttcttcaccctgttcctgggcatgtacctgaccaccgtgctgggcaacctgctgatcatgctgctgatccagctggacagccacctgcacacccccatgtacttcttcctgagccacctggccctgaccgacatcagcttcagcagcgtgaccgtgcccaagatgctgatggacatgagaaccaagtacaagagcatcctgtacgaggagtgcatcagccagatgtacttcttcatcttcttcaccgacctggacagcttcctgatcaccagcatggcctacgacagatacgtggccatctgccaccccctgcactacaccgtgatcatgagagaggagctgtgcgtgttcctggtggccgtgagctggatcctgagctgcgccagcagcctgagccacaccctgctgctgaccagactgagcttctgcgccgccaacaccatcccccacgtgttctgcgacctggccgccctgctgaagctgagctgcagcgacatcttcctgaacgagctggtgatgttcaccgtgggcgtggtggtgatcaccctgcccttcatgtgcatcctggtgagctacggctacatcggcgccaccatcctgagagtgcccagcaccaagggcatccacaaggccctgagcacctgcggcagccacctgagcgtggtgagcctgtactacggcagcatcttcggccagtacctgttccccaccgtgagcagcagcatcgacaaggacgtgatcgtggccctgatgtacaccgtggtgacccccatgctgaaccccttcatctacagcctgagaaacagagacatgaaggaggccctgggcaagctgttcagcagagccaccttcttcagctggtag

SEQ ID NO: 20178 - DNA, 942 bp, Artificial Sequence
  Description of Artificial Sequence: Synthetic coding sequence
atgagccccgagaaccagagcagcgtgagcgagttcctgctgctgggcctgcccatcagacccgagcagcaggccgtgttcttcaccctgttcctgggcatgtacctgaccaccgtgctgggcaacctgctgatcatgctgctgatccagctggacagccacctgcacacccccatgtacttcttcctgagccacctggccctgaccgacatcagcttcagcagcgtgaccgtgcccaagatgctgatggacatgagaaccaagtacaagagcatcctgtacgaggagtgcatcagccagatgtacttcttcatcttcttcaccgacctggacagcttcctgatcaccagcatggcctacgacagatacgtggccatctgccaccccctgcactacaccgtgatcatgagagaggagctgtgcgtgttcctggtggccgtgagctggatcctgagctgcgccagcagcctgagccacaccctgctgctgaccagactgatgaagagagagaaccagagcagcgtgagcgagttcctgctgctggacctgcccatctggcccgagcagcaggccgtgttcttcaccctgttcctgggcatgtacctgatcaccgtgctgggcaacctgctgatcatcctgctgatcagactggacagccacctgcacacccccatgttcttcttcctgagccacctggccctgaccgacatcagcctgagcagcgtgaccgtgcccaagatgctgctgagcatgcagacccaggaccagagcatcctgtacgccggctgcgtgacccagatgtacttcttcatcttcttcaccgacctggacaacttcctgctgaccagcatggcctacgacagatacgtggccatctgccaccccctgagatacaccaccatcatgaaggagggcctgtgcaacctgctggtgaccgtgtag

SEQ ID NO: 20179 - DNA, 942 bp, Artificial Sequence
  Description of Artificial Sequence: Synthetic coding sequence
atgaagagagagaaccagagcagcgtgagcgagttcctgctgctggacctgcccatctggcccgagcagcaggccgtgttcttcaccctgttcctgggcatgtacctgatcaccgtgctgggcaacctgctgatcatcctgctgatcagactggacagccacctgcacacccccatgttcttcttcctgagccacctggccctgaccgacatcagcctgagcagcgtgaccgtgcccaagatgctgctgagcatgcagacccaggaccagagcatcctgtacgccggctgcgtgacccagatgtacttcttcatcttcttcaccgacctggacaacttcctgctgaccagcatggcctacgacagatacgtggccatctgccaccccctgagatacaccaccatcatgaaggagggcctgtgcaacctgctggtgaccgtgagctggatcctgagctgcaccaacgccctgagccacaccctgctgctggcccagctgagcttctgcgccgacaacaccatcccccacttcttctgcgacctggtggccctgctgaagctgagctgcagcgacatcagcctgaacgagctggtgatcttcaccgtgggccaggccgtgatcaccctgcccctgatctgcatcctgatcagctacggccacatcggcgtgaccatcctgaaggcccccagcaccaagggcatcttcaaggccctgagcacctgcggcagccacctgagcgtggtgagcctgtactacggcaccatcatcggcctgtacttcctgcccagcagcagcgccagcagcgacaaggacgtgatcgccagcgtgatgtacaccgtgatcacccccctgctgaaccccttcatctacagcctgagaaacagagacatcaagggcgccctggagagactgttcaacagagccaccgtgctgagccagtag

SEQ ID NO: 20180 - DNA, 951 bp, Artificial Sequence
  Description of Artificial Sequence: Synthetic coding sequence
atggaggccgccaacgagagcagcgagggcatcagcttcgtgctgctgggcctgaccaccagccccggccagcagagacccctgttcgtgctgttcctgctgctgtacgtggccagcctgctgggcaacggcctgatcgtggccgccatccaggccagccccgccctgcacgcccccatgtacttcctgctggcccacctgagcttcgccgacctgtgcttcgccagcgtgaccgtgcccaagatgctggccaacctgctggcccacgaccacagcatcagcctggccggctgcctgacccagatgtacttcttcttcgccctgggcgtgaccgacagctgcctgctggccgccatggcctacgactgctacgtggccatcagacaccccctgccctacgccaccagaatgagcagagccatgtgcgccgccctggtgggcatggcctggctggtgagccacgtgcacagcctgctgtacatcctgctgatggccagactgagcttctgcgccagccaccaggtgccccacttcttctgcgaccaccagcccctgctgagactgagctgcagcgacacccaccacatccagctgctgatcttcaccgagggcgccgccgtggtggtgacccccttcctgctgatcctggccagctacggcgccatcgccgccgccgtgctgcagctgcccagcgccagcggcagactgagagccgtgagcacctgcggcagccacctggccgtggtgagcctgttctacggcaccgtgatcgccgtgtacttccaggccaccagcagaagagaggccgagtggggcagagtggccaccgtgatgtacaccgtggtgacccccatgctgaaccccatcatctacagcctgtggaacagagacgtgcagggcgccctgagagccctgctgatcggcagaagaatcagcgccagcgacagctag

SEQ ID NO: 20181 - DNA, 933 bp, Artificial Sequence
  Description of Artificial Sequence: Synthetic coding sequence
atgggcagaaacaacctgaccagacccagcgagttcatcctgctgggcctgagcagcagacccgaggaccagaagcccctgttcgccgtgttcctgcccatctacctgatcaccgtgatcggcaacctgctgatcatcctggccatcagaagcgacaccagactgcagacccccatgtacttcttcctgagcatcctgagcttcgtggacatctgctacgtgaccgtgatcatccccaagatgctggtgaacttcctgagcgagaccaagaccatcagctacagcgagtgcctgacccagatgtacttcttcctggccttcggcaacaccgacagctacctgctggccgccatggccatcgacagatacgtggccatctgcaaccccttccactacatcaccatcatgagccacagatgctgcgtgctgctgctggtgctgagcttctgcatcccccacttccacagcctgctgcacatcctgctgaccaaccagctgatcttctgcgccagcaacgtgatccaccacttcttctgcgacgaccagcccgtgctgaagctgagctgcagcagccacttcgtgaaggagatcaccgtgatgaccgagggcctggccgtgatcatgacccccttcagctgcatcatcatcagctacctgagaatcctgatcaccgtgctgaagatccccagcgccgccggcaagagaaaggccttcagcacctgcggcagccacctgaccgtggtgaccctgttctacggcagcatcagctacctgtacttccagcccctgagcaactacaccgtgaaggaccagatcgccaccatcatctacaccgtgctgacccccatgctgaaccccttcatctacagcctgagaaacaaggacatgaagcagggcctggccaagctgatgcacagaatgaagtgccagtag

SEQ ID NO: 20182 - DNA, 1083 bp, Artificial Sequence
  Description of Artificial Sequence: Synthetic coding sequence
atggagagaaaccacaaccccgacaactgcaacgtgctgaacttcttcttcgccgacaagaagaacaagagaagaaacttcggccagatcgtgagcgacgtgggcagaatctgctacagcgtgagcctgagcctgggcgagcccaccaccatgggcagaaacaacctgaccagacccagcgagttcatcctgctgggcctgagcagcagacccgaggaccagaagcccctgttcgccgtgttcctgcccatctacctgatcaccgtgatcggcaacctgctgatcatcctggccatcagaagcgacaccagactgcagacccccatgtacttcttcctgagcatcctgagcttcgtggacatctgctacgtgaccgtgatcatccccaagatgctggtgaacttcctgagcgagaccaagaccatcagctacagcgagtgcctgacccagatgtacttcttcctggccttcggcaacaccgacagctacctgctggccgccatggccatcgacagatacgtggccatctgcaaccccttccactacatcaccatcatgagccacagatgctgcgtgctgctgctggtgctgagcttctgcatcccccacttccacagcctgctgcacatcctgctgaccaaccagctgatcttctgcgccagcaacgtgatccaccacttcttctgcgacgaccagcccgtgctgaagctgagctgcagcagccacttcgtgaaggagatcaccgtgatgaccgagggcctggccgtgatcatgacccccttcagctgcatcatcatcagctacctgagaatcctgatcaccgtgctgaagatccccagcgccgccggcaagagaaaggccttcagcacctgcggcagccacctgaccgtggtgaccctgttctacggcagcatcagctacctgtacttccagcccctgagcaactacaccgtgaaggaccagatcgccaccatcatctacaccgtgctgacccccatgctgaaccccttcatctacagcctgagaaacaaggacatgaagcagggcctggccaagctgatgcacagaatgaagtgccagtag

SEQ ID NO: 20183 - DNA, 975 bp, Artificial Sequence
  Description of Artificial Sequence: Synthetic coding sequence
atgggcatgagcaacctgaccagactgagcgagttcatcctgctgggcctgagcagcagaagcgaggaccagagacccctgttcgccctgttcctgatcatctacctggtgaccctgatgggcaacctgctgatcatcctggccatccacagcgaccccagactgcagaaccccatgtacttcttcctgagcatcctgagcttcgccgacatctgctacaccaccgtgatcgtgcccaagatgctggtgaacttcctgagcgagaagaagaccatcagctacgccgagtgcctggcccagatgtacttcttcctggtgttcggcaacatcgacagctacctgctggccgccatggccatcaacagatgcgtggccatctgcaaccccttccactacgtgaccgtgatgaacagaagatgctgcgtgctgctgctggccttccccatcaccttcagctacttccacagcctgctgcacgtgctgctggtgaacagactgaccttctgcaccagcaacgtgatccaccacttcttctgcgacgtgaaccccgtgctgaagctgagctgcagcagcaccttcgtgaacgagatcgtggccatgaccgagggcctggccagcgtgatggcccccttcgtgtgcatcatcatcagctacctgagaatcctgatcgccgtgctgaagatccccagcgccgccggcaagcacaaggccttcagcacctgcagcagccacctgaccgtggtgatcctgttctacggcagcatcagctacgtgtacctgcagcccctgagcagctacaccgtgaaggacagaatcgccaccatcaactacaccgtgctgaccagcgtgctgaaccccttcatctacagcctgagaaacaaggacatgaagagaggcctgcagaagctgatcaacaagatcaagagccagatgagcagattcagcaccaagaccaacaagatctgcggcccctag

SEQ ID NO: 20184 - DNA, 936 bp, Artificial Sequence
  Description of Artificial Sequence: Synthetic coding sequence
atggagaccaagaactacagcagcagcaccagcggcttcatcctgctgggcctgagcagcaaccccaagctgcagaagcccctgttcgccatcttcctgatcatgtacctgctgaccgccgtgggcaacgtgctgatcatcctggccatctacagcgaccccagactgcacacccccatgtacttcttcctgagcaacctgagcttcatggacatctgcttcaccaccgtgatcgtgcccaagatgctggtgaacttcctgagcgagaccaagatcatcagctacgtgggctgcctgatccagatgtacttcttcatggccttcggcaacaccgacagctacctgctggccagcatggccatcgacagactggtggccatctgcaaccccctgcactacgacgtggtgatgaagccctggcactgcctgctgatgctgctgggcagctgcagcatcagccacctgcacagcctgttcagagtgctgctgatgagcagactgagcttctgcgccagccacatcatcaagcacttcttctgcgacacccagcccgtgctgaagctgagctgcagcgacaccagcagcagccagatggtggtgatgaccgagaccctggccgtgatcgtgacccccttcctgtgcaccatcttcagctacctgcagatcatcgtgaccgtgctgagaatccccagcgccgccggcaagtggaaggccttcagcacctgcggcagccacctgaccgtggtggtgctgttctacggcagcgtgatctacgtgtacttcagacccctgagcatgtacagcgtgatgaagggcagagtggccaccgtgatgtacaccgtggtgacccccatgctgaaccccttcatctacagcctgagaaacaaggacatgaagagaggcctgaagaagctgagacacagaatctacagctag

SEQ ID NO: 20185 - DNA, 936 bp, Artificial Sequence
  Description of Artificial Sequence: Synthetic coding sequence
atggagatcaagaactacagcagcagcaccagcggcttcatcctgctgggcctgagcagcaacccccagctgcagaagcccctgttcgccatcttcctgatcatgtacctgctggccgccgtgggcaacgtgctgatcatccccgccatctacagcgaccccagactgcacacccccatgtacttcttcctgagcaacctgagcttcatggacatctgcttcaccaccgtgatcgtgcccaagatgctggtgaacttcctgagcgagaccaaggtgatcagctacgtgggctgcctggcccagatgtacttcttcatggccttcggcaacaccgacagctacctgctggccagcatggccatcgacagactggtggccatctgcaaccccctgcactacgacgtggtgatgaagcccagacactgcctgctgatgctgctgggcagctgcagcatcagccacctgcacagcctgttcagagtgctgctgatgagcagactgagcttctgcgccagccacatcatcaagcacttcttctgcgacacccagcccgtgctgaagctgagctgcagcgacaccagcagcagccagatggtggtgatgaccgagaccctggccgtgatcgtgacccccttcctgtgcatcatcttcagctacctgagaatcatggtgaccgtgctgagaatccccagcgccgccggcaagtggaaggccttcagcacctgcggcagccacctgaccgccgtggccctgttctacggcagcatcatctacgtgtacttcagacccctgagcatgtacagcgtggtgagagacagagtggccaccgtgatgtacaccgtggtgacccccatgctgaaccccttcatctacagcctgagaaacaaggacatgaagagaggcctgaagaagctgcaggacagaatctacagatag

SEQ ID NO: 20186 - DNA, 1044 bp, Artificial Sequence
  Description of Artificial Sequence: Synthetic coding sequence
atgagctacttctacagactgaagctgatgaaggaggccgtgctggtgaagctgcccttcaccagcctgcccctgctgctgcagaccctgagcagaaagagcagagacatggagatcaagaactacagcagcagcaccagcggcttcatcctgctgggcctgagcagcaacccccagctgcagaagcccctgttcgccatcttcctgatcatgtacctgctggccgccgtgggcaacgtgctgatcatccccgccatctacagcgaccccagactgcacacccccatgtacttcttcctgagcaacctgagcttcatggacatctgcttcaccaccgtgatcgtgcccaagatgctggtgaacttcctgagcgagaccaaggtgatcagctacgtgggctgcctggcccagatgtacttcttcatggccttcggcaacaccgacagctacctgctggccagcatggccatcgacagactggtggccatctgcaaccccctgcactacgacgtggtgatgaagcccagacactgcctgctgatgctgctgggcagctgcagcatcagccacctgcacagcctgttcagagtgctgctgatgagcagactgagcttctgcgccagccacatcatcaagcacttcttctgcgacacccagcccgtgctgaagctgagctgcagcgacaccagcagcagccagatggtggtgatgaccgagaccctggccgtgatcgtgacccccttcctgtgcatcatcttcagctacctgagaatcatggtgaccgtgctgagaatccccagcgccgccggcaagtggaaggccttcagcacctgcggcagccacctgaccgccgtggccctgttctacggcagcatcatctacgtgtacttcagacccctgagcatgtacagcgtggtgagagacagagtggccaccgtgatgtacaccgtggtgacccccatgctgaaccccttcatctacagcctgagaaacaaggacatgaagagaggcctgaagaagctgcaggacagaatctacagatag

SEQ ID NO: 20187 - DNA, 930 bp, Artificial Sequence
  Description of Artificial Sequence: Synthetic coding sequence
atggagagaatcaaccacaccagcagcgtgagcgagttcatcctgctgggcctgagcagcagacccgaggaccagaagaccctgttcgtgctgttcctgatcgtgtacctggtgaccatcaccggcaacctgctgatcatcctggccatcagattcaacccccacctgcagacccccatgtacttcttcctgagcttcctgagcctgaccgacatctgcttcaccaccagcgtggtgcccaagatgctgatgaacttcctgagcgagaagaagaccatcagctacgccggctgcctgacccagatgtacttcctgtacgccctgggcaacagcgacagctgcctgctggccgtgatggccttcgacagatacgtggccgtgtgcgaccccttccactacgtgaccaccatgagccaccaccactgcgtgctgctggtggccttcagctgcagcttcccccacctgcacagcctgctgcacaccctgctgctgaacagactgaccttctgcgacagcaacgtgatccaccacttcctgtgcgacctgagccccgtgctgaagctgagctgcagcagcatcttcgtgaacgagatcgtgcagatgaccgaggcccccatcgtgctggtgaccagattcctgtgcatcgccttcagctacatcagaatcctgaccaccgtgctgaagatccccagcaccagcggcaagagaaaggccttcagcacctgcggcttctacctgaccgtggtgaccctgttctacggcagcatcttctgcgtgtacctgcagccccccagcacctacgccgtgaaggaccacgtggccaccatcgtgtacaccgtgctgagcagcatgctgaaccccttcatctacagcctgagaaacaaggacctgaagcagggcctgagaaagctgatgagcaagagaagctag

SEQ ID NO: 20188 - DNA, 951 bp, Artificial Sequence
  Description of Artificial Sequence: Synthetic coding sequence
atcacccccatggagcccagaaaccagaccagcgccagccagttcatcctgctgggcctgagcgagaagcccgagcaggagaccctgctgttcagcctgttcttctgcatgtacctggtgatggtggtgggcaacctgctgatcatcctggccatcagcatcgacagccacctgcacacccccatgtacttcttcctggccaacctgagcctggtggacttctgcctggccaccaacaccatccccaagatgctggtgagcctgcagaccggcagcaaggccatcagctacccctgctgcctgatccagatgtacttcttccacttcttcggcatcgtggacagcgtgatcatcgccatgatggcctacgacagattcgtggccatctgccaccccctgcactacgccaagatcatgagcctgagactgtgcagactgctggtgggcgccctgtgggccttcagctgcttcatcagcctgacccacatcctgctgatggccagactggtgttctgcggcagccacgaggtgccccactacttctgcgacctgacccccatcctgagactgagctgcaccgacaccagcgtgaacagaatcttcatcctgatcgtggccggcatggtgatcgccacccccttcgtgtgcatcctggccagctacgccagaatcctggtggccatcatgaaggtgcccagcgccggcggcagaaagaaggccttcagcacctgcagcagccacctgagcgtggtggccctgttctacggcaccaccatcggcgtgtacctgtgccccagcagcgtgctgaccaccgtgaaggagaaggccagcgccgtgatgtacaccgccgtgacccccatgctgaaccccttcatctacagcctgagaaacagagacctgaagggcgccctgagaaagctggtgaacagaaagatcaccagcagcagctag

SEQ ID NO: 20189 - DNA, 942 bp, Artificial Sequence
  Description of Artificial Sequence: Synthetic coding sequence
atggagcccagaaaccagaccagcgccagccagttcatcctgctgggcctgagcgagaagcccgagcaggagaccctgctgttcagcctgttcttctgcatgtacctggtgatggtggtgggcaacctgctgatcatcctggccatcagcatcgacagccacctgcacacccccatgtacttcttcctggccaacctgagcctggtggacttctgcctggccaccaacaccatccccaagatgctggtgagcctgcagaccggcagcaaggccatcagctacccctgctgcctgatccagatgtacttcttccacttcttcggcatcgtggacagcgtgatcatcgccatgatggcctacgacagattcgtggccatctgccaccccctgcactacgccaagatcatgagcctgagactgtgcagactgctggtgggcgccctgtgggccttcagctgcttcatcagcctgacccacatcctgctgatggccagactggtgttctgcggcagccacgaggtgccccactacttctgcgacctgacccccatcctgagactgagctgcaccgacaccagcgtgaacagaatcttcatcctgatcgtggccggcatggtgatcgccacccccttcgtgtgcatcctggccagctacgccagaatcctggtggccatcatgaaggtgcccagcgccggcggcagaaagaaggccttcagcacctgcagcagccacctgagcgtggtggccctgttctacggcaccaccatcggcgtgtacctgtgccccagcagcgtgctgaccaccgtgaaggagaaggccagcgccgtgatgtacaccgccgtgacccccatgctgaaccccttcatctacagcctgagaaacagagacctgaagggcgccctgagaaagctggtgaacagaaagatcaccagcagcagctag

SEQ ID NO: 20190 - DNA, 936 bp, Artificial Sequence
  Description of Artificial Sequence: Synthetic coding sequence
atggagaaccagagcagcatcagcgagttcttcctgagaggcatcagcgccccccccgagcagcagcagagcctgttcggcatcttcctgtgcatgtacctggtgaccctgaccggcaacctgctgatcatcctggccatcggcagcgacctgcacctgcacacccccatgtacttcttcctggccaacctgagcttcgtggacatgggcctgaccagcagcaccgtgaccaagatgctggtgaacatccagaccagacaccacaccatcagctacaccggctgcctgacccagatgtacttcttcctgatgttcggcgacctggacagcttcttcctggccgccatggcctacgacagatacgtggccatctgccaccccctgtgctacagcaccgtgatgagaccccaggtgtgcgccctgatgctggccctgtgctgggtgctgaccaacatcgtggccctgacccacaccttcctgatggccagactgagcttctgcgtgaccggcgagatcgcccacttcttctgcgacatcacccccgtgctgaagctgagctgcagcgacacccacatcaacgagatgatggtgttcgtgctgggcggcaccgtgctgatcgtgcccttcctgtgcatcgtgaccagctacatccacatcgtgcccgccatcctgagagtgagaaccagaggcggcgtgggcaaggccttcagcacctgcagcagccacctgtgcgtggtgtgcgtgttctacggcaccctgttcagcgcctacctgtgcccccccagcatcgccagcgaggagaaggacatcgccgccgccgccatgtacaccatcgtgacccccatgctgaaccccttcatctacagcctgagaaacaaggacatgaagggcgccctgaagagactgttcagccacagaagcatcgtgagcagctag

SEQ ID NO: 20191 - DNA, 993 bp, Artificial Sequence
  Description of Artificial Sequence: Synthetic coding sequence
atggagggcttctacctgagaagaagccacgagctgcagggcatgggcaagcccggcagagtgaaccagaccaccgtgagcgacttcctgctgctgggcctgagcgagtggcccgaggagcagcccctgctgttcggcatcttcctgggcatgtacctggtgaccatggtgggcaacctgctgatcatcctggccatcagcagcgacccccacctgcacacccccatgtacttcttcctggccaacctgagcctgaccgacgcctgcttcaccagcgccagcatccccaagatgctggccaacatccacacccagagccagatcatcagctacagcggctgcctggcccagctgtacttcctgctgatgttcggcggcctggacaactgcctgctggccgtgatggcctacgacagatacgtggccatctgccagcccctgcactacagcaccagcatgagcccccagctgtgcgccctgatgctgggcgtgtgctgggtgctgaccaactgccccgccctgatgcacaccctgctgctgaccagagtggccttctgcgcccagaaggccatcccccacttctactgcgaccccagcgccctgctgaagctggcctgcagcgacacccacgtgaacgagctgatgatcatcaccatgggcctgctgttcctgaccgtgcccctgctgctgatcgtgttcagctacgtgagaatcttctgggccgtgttcgtgatcagcagccccggcggcagatggaaggccttcagcacctgcggcagccacctgaccgtggtgctgctgttctacggcagcctgatgggcgtgtacctgctgccccccagcacctacagcaccgagagagagagcagagccgccgtgctgtacatggtgatcatccccaccctgaaccccttcatctacagcctgagaaacagagacatgaaggaggccctgggcaagctgttcgtgagcggcaagaccttcttcctgtag

SEQ ID NO: 20192 - DNA, 945 bp, Artificial Sequence
  Description of Artificial Sequence: Synthetic coding sequence
atggacaacagcaactggaccagcgtgagccacttcgtgctgctgggcatcagcacccaccccgaggagcagatccccctgttcctggtgttcagcctgatgtacgccatcaacatcagcggcaacctggccatcatcaccctgatcctgagcgcccccagactgcacatccccatgtacatcttcctgagcaacctggccctgaccgacatctgcttcaccagcaccaccgtgcccaagatgctgcagatcatcttcagccccaccaaggtgatcagctacaccggctgcctggcccagacctacttcttcatctgcttcgccgtgatggagaacttcatcctggccgtgatggcctacgacagatacatcgccatctgccaccccttccactacaccatgatcctgaccagaatgctgtgcgtgaagatggtggtgatgtgccacgccctgagccacctgcacgccatgctgcacaccttcctgatcggccagctgatcttctgcgccgacaacagaatcccccacttcttctgcgacctgtacgccctgatgaagatcagctgcaccagcacctacctgaacaccctgatgatccacaccgagggcgccgtggtgatcagcggcgccctggccttcatcaccgccagctacgcctgcatcatcctggtggtgctgagaatccccagcgccaagggcagatggaagaccttcagcacctgcggcagccacctgaccgtggtggccatcttctacggcaccctgagctgggtgtacttcagacccctgagcagctacagcgtgaccaagggcagaatcatcaccgtggtgtacaccgtggtgacccccatgctgaaccccttcatctacagcctgagaaacggcgacgtgaagggcggcttcatgaagtggatgagcagaatgcagaccttcttcttcagatag

SEQ ID NO: 20193 - DNA, 978 bp, Artificial Sequence
  Description of Artificial Sequence: Synthetic coding sequence
atgaagaccttcagcagcttcctgcagatcggcagaaacatgcaccagggcaaccagaccaccatcaccgagttcatcctgctgggcttcttcaagcaggacgagcaccagaacctgctgttcgtgctgttcctgggcatgtacctggtgaccgtgatcggcaacggcctgatcatcgtggccatcagcctggacacctacctgcacacccccatgtacctgttcctggccaacctgagcttcgccgacatcagcagcatcagcaacagcgtgcccaagatgctggtgaacatccagaccaagagccagagcatcagctacgagagctgcatcacccagatgtacttcagcatcgtgttcgtggtgatcgacaacctgctgctgggcaccatggcctacgaccacttcgtggccatctgccaccccctgaactacaccatcctgatgagacccagattcggcatcctgctgaccgtgatcagctggttcctgagcaacatcatcgccctgacccacaccctgctgctgatccagctgctgttctgcaaccacaacaccctgccccacttcttctgcgacctggcccccctgctgaagctgagctgcagcgacaccctgatcaacgagctggtgctgttcatcgtgggcctgagcgtgatcatcttccccttcaccctgagcttcttcagctacgtgtgcatcatcagagccgtgctgagagtgagcagcacccagggcaagtggaaggccttcagcacctgcggcagccacctgaccgtggtgctgctgttctacggcaccatcgtgggcgtgtacttcttccccagcagcacccaccccgaggacaccgacaagatcggcgccgtgctgttcaccgtggtgacccccatgatcaaccccttcatctacagcctgagaaacaaggacatgaagggcgccctgagaaagctgatcaacagaaagatcagcagcctgtag

SEQ ID NO: 20194 - DNA, 978 bp, Artificial Sequence
  Description of Artificial Sequence: Synthetic coding sequence
atgaagaccctgtgcagcttcctgcagatcagcagaaacatgcaccaggagaaccagaccaccatcaccgagttcatcctgctgggcctgagcaaccaggccgagcaccagaacctgctgttcgtgctgttcctgagcatgtacgtggtgaccgtggtgggcaacggcctgatcatcgtggccatcagcctggacatctacctgcacacccccatgtacctgttcctggcctacctgagcttcgccgacatcagcagcatcagcaacagcgtgcccaagatgctggtgaacatccagaccaacagccagagcatcagctacgagagctgcatcacccagatgtacttcagcatcgtgttcgtggtgaccgacaacctgctgctgggcaccatggccttcgaccacttcgtggccatctgccaccccctgaactacaccaccttcatgagagccagattcggcaccctgctgaccgtgatcagctggttcctgagcaacatcatcgccctgacccacaccctgctgctgatccagctgctgttctgcgaccacaacaccctgccccacttcttctgcgacctggcccccctgctgaagctgagctgcagcgacaccatgatcaacgagctggtgctgttcatcgtgggcctgagcgtgatcatcttccccttcgtgctgatcttcttcagctacgtgtgcatcatcagagccgtgctgggcgtgagcagcacccagggcaagtggaaggccttcagcacctgcggcagccacctgaccatcgccctgctgttctacggcaccaccgtgggcgtgtacttcttccccagcagcacccaccccgaggacaccgacaagatcggcgccgtgctgttcaccgtggtgacccccatgatgaaccccttcatctacagcctgagaaacaaggacatgaagggcgccctgagaaagctgatcaacagaaagatcagcagcctgtag

SEQ ID NO: 20195 - DNA, 912 bp, Artificial Sequence
  Description of Artificial Sequence: Synthetic coding sequence
atgagcttcagcagcctgcccaccgagatccagagcctgctgttcctgaccttcctgaccatctacctggtgaccctgatgggcaactgcctgatcatcctggtgaccctggccgaccccatgctgcacagccccatgtacttcttcctgagaaacctgagcttcctggagatcggcttcaacctggtgatcgtgcccaagatgctgggcaccctgctggcccaggacaccaccatcagcttcctgggctgcgccacccagatgtacttcttcttcttcttcggcgtggccgagtgcttcctgctggccaccatggcctacgacagatacgtggccatctgcagccccctgcactaccccgtgatcatgaaccagagaaccagagccaagctggccgccgccagctggttccccggcttccccgtggccaccgtgcagaccacctggctgttcagcttccccttctgcggcaccaacaaggtgaaccacttcttctgcgacagcccccccgtgctgagactggtgtgcgccgacaccgccctgttcgagatctacgccatcgtgggcaccatcctggtggtgatgatcccctgcctgctgatcctgtgcagctacacccacatcgccgccgccatcctgaagatccccagcgccaagggcaagaacaaggccttcagcacctgcagcagccacctgctggtggtgagcctgttctacatcagcctgagcctgacctacttcagacccaagagcaacaacagccccgagggcaagaagctgctgagcctgagctacaccgtgatgacccccatgctgaaccccatcatctacagcctgagaaacaacgaggtgaagaacgccctgagcagaaccgtgagcaaggccctggccctgagaaactgcatcccctag

SEQ ID NO: 20196 - DNA, 945 bp, Artificial Sequence
  Description of Artificial Sequence: Synthetic coding sequence
atgaagagacagaaccagagctgcgtggtggagttcatcctgctgggcttcagcaacttccccgagctgcaggtgcagctgttcggcgtgttcctggtgatctacgtggtgaccctgatgggcaacgccatcatcaccgtgatcatcagcctgaaccagagcctgcacgtgcccatgtacctgttcctgctgaacctgagcgtggtggaggtgagcttcagcgccgtgatcacccccgagatgctggtggtgctgagcaccgagaagaccatgatcagcttcgtgggctgcttcgcccagatgtacttcatcctgctgttcggcggcaccgagtgcttcctgctgggcgccatggcctacgacagattcgccgccatctgccaccccctgaactaccccgtgatcatgaacagaggcgtgttcatgaagctggtgatcttcagctggatcagcggcatcatggtggccaccgtgcagaccacctgggtgttcagcttccccttctgcggccccaacgagatcaaccacctgttctgcgagaccccccccgtgctggagctggtgtgcgccgacaccttcctgttcgagatctacgccttcaccggcaccatcctgatcgtgatggtgcccttcctgctgatcctgctgagctacatcagagtgctgttcgccatcctgaagatgcccagcaccaccggcagacagaaggccttcagcacctgcgccagccacctgaccagcgtgaccctgttctacggcaccgccaacatgacctacctgcagcccaagagcggctacagccccgagaccaagaagctgatcagcctggcctacaccctgctgacccccctgctgaaccccctgatctacagcctgagaaacagcgagatgaagagaaccctgatcaagctgtggagaagaaaggtgatcctgcacaccttctag

SEQ ID NO: 20197 - DNA, 948 bp, Artificial Sequence
  Description of Artificial Sequence: Synthetic coding sequence
atgatgtgggagaactggaccatcgtgagcgagttcgtgctggtgagcttcagcgccctgagcaccgagctgcaggccctgctgttcctgctgttcctgaccatctacctggtgaccctgatgggcaacgtgctgatcatcctggtgaccatcgccgacagcgccctgcagagccccatgtacttcttcctgagaaacctgagcttcctggagatcggcttcaacctggtgatcgtgcccaagatgctgggcaccctgatcatccaggacaccaccatcagcttcctgggctgcgccacccagatgtacttcttcttcttcttcggcgccgccgagtgctgcctgctggccaccatggcctacgacagatacgtggccatctgcgaccccctgcactaccccgtgatcatgggccacatcagctgcgcccagctggccgccgccagctggttcagcggcttcagcgtggccaccgtgcagaccacctggatcttcagcttccccttctgcggccccaacagagtgaaccacttcttctgcgacagcccccccgtgatcgccctggtgtgcgccgacaccagcgtgttcgagctggaggccctgaccgccaccgtgctgttcatcctgttccccttcctgctgatcctgggcagctacgtgagaatcctgagcaccatcttcagaatgcccagcgccgagggcaagcaccaggccttcagcacctgcagcgcccacctgctggtggtgagcctgttctacagcaccgccatcctgacctacttcagaccccagagcagcgccagcagcgagagcaagaagctgctgagcctgagcagcaccgtggtgacccccatgctgaaccccatcatctacagcagcagaaacaaggaggtgaaggccgccctgaagagactgatccacagaaccctgggcagccagaagctgtag

SEQ ID NO: 20198 - DNA, 954 bp, Artificial Sequence
  Description of Artificial Sequence: Synthetic coding sequence
atggccatcggcaactggaccgagatcagcgagttcatcctgatgagcttcagcagcctgcccaccgagatccagagcctgctgttcctgaccttcctgaccatctacctggtgaccctgaagggcaacagcctgatcatcctggtgaccctggccgaccccatgctgcacagccccatgtacttcttcctgagaaacctgagcttcctggagatcggcttcaacctggtgatcgtgcccaagatgctgggcaccctgctggcccaggacaccaccatcagcttcctgggctgcgccacccagatgtacttcttcttcttcttcggcgtggccgagtgcttcctgctggccaccatggcctacgacagatacgtggccatctgcagccccctgcactaccccgtgatcatgaaccagagaaccagagccaagctggccgccgccagctggttccccggcttccccgtggccaccgtgcagaccacctggctgttcagcttccccttctgcggcaccaacaaggtgaaccacttcttctgcgacagcccccccgtgctgaagctggtgtgcgccgacaccgccctgttcgagatctacgccatcgtgggcaccatcctggtggtgatgatcccctgcctgctgatcctgtgcagctacaccagaatcgccgccgccatcctgaagatccccagcgccaagggcaagcacaaggccttcagcacctgcagcagccacctgctggtggtgagcctgttctacatcagcagcagcctgacctacttctggcccaagagcaacaacagccccgagagcaagaagctgctgagcctgagctacaccgtggtgacccccatgctgaaccccatcatctacagcctgagaaacagcgaggtgaagaacgccctgagcagaaccttccacaaggtgctggccctgagaaactgcatcccctag

SEQ ID NO: 20199 - DNA, 966 bp, Artificial Sequence
  Description of Artificial Sequence: Synthetic coding sequence
atgcccatcctgatggccatcggcaactggaccgagatcagcgagttcatcctgatgagcttcagcagcctgcccaccgagatccagagcctgctgttcctgaccttcctgaccatctacctggtgaccctgaagggcaacagcctgatcatcctggtgaccctggccgaccccatgctgcacagccccatgtacttcttcctgagaaacctgagcttcctggagatcggcttcaacctggtgatcgtgcccaagatgctgggcaccctgctggcccaggacaccaccatcagcttcctgggctgcgccacccagatgtacttcttcttcttcttcggcgtggccgagtgcttcctgctggccaccatggcctacgacagatacgtggccatctgcagccccctgcactaccccgtgatcatgaaccagagaaccagagccaagctggccgccgccagctggttccccggcttccccgtggccaccgtgcagaccacctggctgttcagcttccccttctgcggcaccaacaaggtgaaccacttcttctgcgacagcccccccgtgctgaagctggtgtgcgccgacaccgccctgttcgagatctacgccatcgtgggcaccatcctggtggtgatgatcccctgcctgctgatcctgtgcagctacaccagaatcgccgccgccatcctgaagatccccagcgccaagggcaagcacaaggccttcagcacctgcagcagccacctgctggtggtgagcctgttctacatcagcagcagcctgacctacttctggcccaagagcaacaacagccccgagagcaagaagctgctgagcctgagctacaccgtggtgacccccatgctgaaccccatcatctacagcctgagaaacagcgaggtgaagaacgccctgagcagaaccttccacaaggtgctggccctgagaaactgcatcccctag

SEQ ID NO: 20200 - DNA, 945 bp, Artificial Sequence
  Description of Artificial Sequence: Synthetic coding sequence
atggagagacagaaccagagctgcgtggtggagttcatcctgctgggcttcagcaactaccccgagctgcagggccagctgttcgtggccttcctggtgatctacctggtgaccctgatcggcaacgccatcatcatcgtgatcgtgagcctggaccagagcctgcacgtgcccatgtacctgttcctgctgaacctgagcgtggtggacctgagcttcagcgccgtgatcatgcccgagatgctggtggtgctgagcaccgagaagaccaccatcagcttcggcggctgcttcgcccagatgtacttcatcctgctgttcggcggcgccgagtgcttcctgctgggcgccatggcctacgacagattcgccgccatctgccaccccctgaactaccagatgatcatgaacaagggcgtgttcatgaagctgatcatcttcagctgggccctgggcttcatgctgggcaccgtgcagaccagctgggtgagcagcttccccttctgcggcctgaacgagatcaaccacatcagctgcgagacccccgccgtgctggagctggcctgcgccgacaccttcctgttcgagatctacgccttcaccggcaccttcctgatcatcctggtgcccttcctgctgatcctgctgagctacatcagagtgctgttcgccatcctgaagatgcccagcaccaccggcagacagaaggccttcagcacctgcgccgcccacctgaccagcgtgaccctgttctacggcaccgccagcatgacctacctgcagcccaagagcggctacagccccgagaccaagaaggtgatgagcctgagctacagcctgctgacccccctgctgaacctgctgatctacagcctgagaaacagcgagatgaagagagccctgatgaagctgtggagaagaagagtggtgctgcacaccatctag

SEQ ID NO: 20201 - DNA, 951 bp, Artificial Sequence
  Description of Artificial Sequence: Synthetic coding sequence
atgatctgcgagaaccacaccagagtgaccgagttcatcctgctgggcttcaccaacaaccccgagatgcaggtgagcctgttcatcttcttcctggccatctacaccgtgaccctgctgggcaacttcctgatcgtgaccgtgaccagcgtggacctggccctgcagacccccatgtacttcttcctgcagaacctgagcctgctggaggtgtgcttcaccctggtgatggtgcccaagatgctggtggacctggtgagccccagaaagatcatcagcttcgtgggctgcggcacccagatgtacttcttcttcttcttcggcagcagcgagtgcttcctgctgagcatgatggcctacgacagattcgtggccatctgcaaccccctgcactacagcgtgatcatgaacagaagcctgtgcctgtggatggccatcggcagctggatgagcggcgtgcccgtgagcatgctgcagaccgcctggatgatggccctgcccttctgcggccccaacgccgtggaccacttcttctgcgacggcccccccgtgctgaagctggtgaccgtggacaccaccatgtacgagatgcaggccctggccagcaccctgctgttcatcatgttccccttctgcctgatcctggtgagctacaccagaatcatcatcaccatcctgagaatgagcagcgccaccggcagacagaaggccttcagcacctgcagcagccacctgatcgtggtgagcctgttctacggcaccgccagcctgacctacctgagacccaagagcaaccagagccccgagagcaagaagctggtgagcctgagctacaccgtgatcacccccatgctgaaccccatcatctacggcctgagaaacaacgaggtgaagggcgccgtgaagagaaccatcacccagaaggtgctgcagaagctggacgtgttctag

SEQ ID NO: 20202 - DNA, 1020 bp, Artificial Sequence
  Description of Artificial Sequence: Synthetic coding sequence
atggagaagagagagatcaacagcgccttcggcgtgaagagcagatacagatacctgggccccctgtacgtgatctacacctactaccacatcagaatcatcctgctgttcacccaggcccccgacctggacctgttccccgccgccaacgtgagcatcatgggcgccatcaagctgagccacaacctgcacacccccatgtacttcttcctgtgcggcctgagcttcagcgagacctgcaccaccgtggtggtgatccccagaatgctggtggacttcctgagcgagagcaagaccatcagcctgcccgagtgcgccacccagatgttcttcttcctgggcttcgccagcaacaactgcttcatcatggccgccatgagctacgacagatacaccgccatccacaaccccctgcagtaccacaccctgatgaccagaaagatctgcctgcagatgatgatggccagctggatggtgggcttcctgttcagcctgtgcatcatcgtgaccgtgttcaacctgagcctgtgcgacctgaacaccatccagcactacttctgcgacatcagccccgtggtgagcctggcctgcaactacaccttctaccacgagatggccatcttcgtgctgagcgccttcgtgctggtgggcagctgcatcctgatcatgatcagctacgtgttcatcgtgttcatcgtgatcaagatgcccagcgccaagggcagaagcaaggccttcagcacctgcagcagccacctgaccgtggtgagcatccactacggcttcgcctgcttcgtgtacctgagacccaagaacagcaacagcttcgacgaggacatgctgaccgccatgatctacaccatcctgatgcccctgctgaaccccatcgtgtacagcctgagaaacaaggagatgcagatcgccctgagaaagaccctgggcagcgtgttcggcgtgttcccccagaagaccaagaaggagcccgagcacctgaagaagctgcacagcatcgacaagtag

SEQ ID NO: 20203 - DNA, 954 bp, Artificial Sequence
  Description of Artificial Sequence: Synthetic coding sequence
atgctgagaaacggcagcatcgtgaccgagttcatcctggtgggcttccagcagagcagcaccagcaccagagccctgctgttcgccctgttcctggccctgtacagcctgaccatggccatgaacggcctgatcatcttcatcaccagctggaccgaccccaagctgaacagccccatgtacttcttcctgggccacctgagcctgctggacgtgtgcttcatcaccaccaccatcccccagatgctgatccacctggtggtgagagaccacatcgtgagcttcgtgtgctgcatgacccagatgtacttcgtgttctgcgtgggcgtggccgagtgcatcctgctggccttcatggcctacgacagatacgtggccatctgctaccccctgaactacgtgcccatcatcagccagaaggtgtgcgtgagactggtgggcaccgcctggttcttcggcctgatcaacggcatcttcctggagtacatcagcttcagagagcccttcagaagagacaaccacatcgagagcttcttctgcgaggcccccatcgtgatcggcctgagctgcggcgacccccagttcagcctgtgggccatcttcgccgacgccatcgtggtgatcctgagccccatggtgctgaccgtgaccagctacgtgcacatcctggccaccatcctgagcaaggccagcagcagcggcagaggcaagaccttcagcacctgcgccagccacctgaccgtggtgatcttcctgtacaccagcgccatgttcagctacatgaacccccacagcacccacggccccgacaaggacaagcccttcagcctgctgtacaccatcatcacccccatgtgcaaccccatcatctacagcttcagaaacaaggagatcaaggaggccatggtgagagccctgggcagaaccagactggcccagccccagagcgtgtag

SEQ ID NO: 20204 - DNA, 906 bp, Artificial Sequence
  Description of Artificial Sequence: Synthetic coding sequence
atggagttcgtgctgctgggcttcagcgacatccccaacctgcactggatgctgttcagcatcttcctgctgatgtacctgatgatcctgatgtgcaacggcatcatcatcctgctgatcaagatccaccccgccctgcagacccccatgtacttcttcctgagcaacttcagcctgctggagatctgctacgtgaccatcatcatccccagaatgctgatggacatctggacccagaagggcaacatcagcctgttcgcctgcgccacccagatgtgcttcttcctgatgctgggcggcaccgagtgcctgctgctgaccgtgatggcctacgacagatacgtggccatctgcaagcccctgcagtaccccctggtgatgaaccacaaggtgtgcatccagctgatcatcgccagctggaccatcaccatccccgtggtgatcggcgagacctgccagatcttcctgctgcccttctgcggcaccaacaccatcaaccacttcttctgcgacatcccccccatcctgaagctggcctgcggcaacatcttcgtgaacgagatcaccgtgcacgtggtggccgtggtgttcatcaccgtgcccttcctgctgatcgtggtgagctacggcaagatcatcagcaacatcctgaagctgagcagcgccagaggcaaggccaaggccttcagcacctgcagcagccacctgatcgtggtgatcctgttcttcggcgccggcaccatcacctacctgcagcccaagccccaccagttccagagaatgggcaagctgatcagcctgttctacaccatcctgatccccaccctgaaccccatcatctacaccctgagaaacaaggacatcatggtggccctgagaaagctgctggccaagctgctgacctag

SEQ ID NO: 20205 - DNA, 939 bp, Artificial Sequence
  Description of Artificial Sequence: Synthetic coding sequence
atgagcgccaacaccagcatggtgaccgagttcctgctgctgggcttcagccacctggccgacctgcagggcctgctgttcagcgtgttcctgaccatctacctgctgaccgtggccggcaacttcctgatcgtggtgctggtgagcaccgacgccgccctgcagagccccatgtacttcttcctgagaaccctgagcgccctggagatcggctacaccagcgtgaccgtgcccctgctgctgcaccacctgctgaccggcagaagacacatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatcccccagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcatggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagaaccatccagaagaccgtgcccatggagatctag

SEQ ID NO: 20206 - DNA, 939 bp, Artificial Sequence; identical to SEQ ID NO: 20205
  Description of Artificial Sequence: Synthetic coding sequence

SEQ ID NO: 20207 - DNA, 939 bp, Artificial Sequence
  Description of Artificial Sequence: Synthetic coding sequence
atgagcgccaacaccagcatggtgaccgagttcctgctgctgggcttcagccacctggccgacctgcagggcctgctgttcagcgtgttcctgaccatctacctgctgaccgtggccggcaacttcctgatcgtggtgctggtgagcaccgacgccgccctgcagagccccatgtacctgttcctgagaaccctgagcgccctggagatcggctacaccagcgtgaccgtgcccctgctgctgcaccacctgctgaccggcagaagacacatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatccagcagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcgtggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagaaccatccagaagaccgtgcccatggagatctag

SEQ ID NO: 20208 - DNA, 939 bp, Artificial Sequence
  Description of Artificial Sequence: Synthetic coding sequence
atgagcgccaacaccagcatggtgaccgagttcctgctgctgggcttcagccacctggccgacctgcagggcctgctgttcagcgtgttcctgaccatctacctgctgaccgtggccggcaacttcctgatcgtggtgctggtgagcaccgacgccgccctgcagagccccatgtacttcttcctgagaaccctgagcgccctggagatcggctacaccagcgtgaccgtgcccctgctgctgcaccacctgctgaccggcagaagacacatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatcccccagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcgtggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagaaccatccagaagaccgtgcccatggagatctag

SEQ ID NO: 20209 - DNA, 939 bp, Artificial Sequence; identical to SEQ ID NO: 20205
  Description of Artificial Sequence: Synthetic coding sequence

SEQ ID NO: 20210 - DNA, 939 bp, Artificial Sequence; identical to SEQ ID NO: 20208
  Description of Artificial Sequence: Synthetic coding sequence

SEQ ID NO: 20211 - DNA, 939 bp, Artificial Sequence; identical to SEQ ID NO: 20208
  Description of Artificial Sequence: Synthetic coding sequence

SEQ ID NO: 20212 - DNA, 939 bp, Artificial Sequence; identical to SEQ ID NO: 20208
  Description of Artificial Sequence: Synthetic coding sequence

SEQ ID NO: 20213 - DNA, 888 bp, Artificial Sequence
  Description of Artificial Sequence: Synthetic coding sequence
agcgtgaccgagttcctgctgctgggcgtgaccgacatccaggagctgcagcccttcctgttcgtggtgttcctgaccatctacttcatcagcgtggccggcaacggcgccatcctgatgatcgtgatcagcgaccccagactgcacagccccatgtacttcttcctgggcaacctgagctgcctggacatctgctacagcagcgtgaccctgcccaagatgctgcagaacttcctgagcgcccacaagatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatcccccagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcatggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagatag

SEQ ID NO: 20214 - DNA, 888 bp, Artificial Sequence; identical to SEQ ID NO: 20213
  Description of Artificial Sequence: Synthetic coding sequence

SEQ ID NO: 20215 - DNA, 888 bp, Artificial Sequence
  Description of Artificial Sequence: Synthetic coding sequence
agcgtgaccgagttcctgctgctgggcgtgaccgacatccaggagctgcagcccttcctgttcgtggtgttcctgaccatctacttcatcagcgtggccggcaacggcgccatcctgatgatcgtgatcagcgaccccagactgcacagccccatgtacttcttcctgggcaacctgagctgcctggacatctgctacagcagcgtgaccctgcccaagatgctgcagaacttcctgagcgcccacaagatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatccagcagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcgtggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagatag

SEQ ID NO: 20216 - DNA, 888 bp, Artificial Sequence
  Description of Artificial Sequence: Synthetic coding sequence
agcgtgaccgagttcctgctgctgggcgtgaccgacatccaggagctgcagcccttcctgttcgtggtgttcctgaccatctacttcatcagcgtggccggcaacggcgccatcctgatgatcgtgatcagcgaccccagactgcacagccccatgtacttcttcctgggcaacctgagctgcctggacatctgctacagcagcgtgaccctgcccaagatgctgcagaacttcctgagcgcccacaagatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatcccccagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcgtggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagatag

SEQ ID NO: 20217 - DNA, 915 bp, Artificial Sequence
  Description of Artificial Sequence: Synthetic coding sequence
gagagaatgagcgccaacaccagcatggtgaccgagttcctgctgctgggcttcagccacctggccgacctgcagggcctgctgttcagcgtgttcctgaccatctacctgctgaccgtggccggcaacttcctgatcgtggtgctggtgagcaccgacgccgccctgcagagccccatgtacttcttcctgagaaccctgagcgccctggagatcggctacaccagcgtgaccgtgcccctgctgctgcaccacctgctgaccggcagaagacacatcagcagaagcggctgcgccctgcagatgttcttcttcctgttcttcggcgccaccgagtgctgcctgctggccgccatggcctacgacagatacgccgccatctgcgagcccctgagataccccctgctgctgagccacagagtgtgcctgcagctggccggcagcgcctgggcctgcggcgtgctggtgggcctgggccacacccccttcatcttcagcctgcccttctgcggccccaacaccatcccccagttcttctgcgagatccagcccgtgctgcagctggtgtgcggcgacaccagcctgaacgagctgcagatcatcctggccaccgccctgctgatcctgtgccccttcggcctgatcctgggcagctacggcagaatcctggtgaccatcttcagaatccccagcgtggccggcagaagaaaggccttcagcacctgcagcagccacctgatcgtggtgagcctgttctacggcaccgccctgttcatctacatcagacccaaggccagctacgaccccgccaccgaccccctggtgagcctgttctacgccgtggtgacccccatcctgaaccccatcatctacagcctgagaaacaccgaggtgaaggccgccctgaagagatag

SEQ ID NO: 20218 - DNA, 888 bp, Artificial Sequence; identical to SEQ ID NO: 20216
  Description of Artificial Sequence: Synthetic coding sequence

SEQ ID NO: 20219 - DNA, 888 bp, Artificial Sequence; identical to SEQ ID NO: 20216
  Description of Artificial Sequence: Synthetic coding sequence

SEQ ID NO: 20220 - DNA, 939 bp, Artificial Sequence
  Description of Artificial Sequence: Synthetic coding sequence
atggaggtgaagaactgctgcatggtgaccgagttcatcctgctgggcatcccccacaccgagggcctggagatgaccctgttcgtgctgttcctgcccttctacgcctgcaccctgctgggcaacgtgagcatcctggtggccgtgatgagcagcgccagactgcacacccccatgtacttcttcctgggcaacctgagcgtgttcgacatgggcttcagcagcgtgacctgccccaagatgctgctgtacctgatgggcctgagcagactgatcagctacaaggactgcgtgtgccagctgttcttcttccacttcctgggcagcatcgagtgcttcctgttcaccgtgatggcctacgacagattcaccgccatctgctaccccctgagatacaccgtgatcatgaaccccagaatctgcgtggccctggccgtgggcacctggctgctgggctgcatccacagcagcatcctgaccagcctgaccttcaccctgccctactgcggccccaacgaggtggaccacttcttctgcgacatccccgccctgctgcccctggcctgcgccgacaccagcctggcccagagagtgagcttcaccaacgtgggcctgatcagcctggtgtgcttcctgctgatcctgctgagctacaccagaatcaccatcagcatcctgagcatcagaaccaccgagggcagaagaagagccttcagcacctgcagcgcccacctgatcgccatcctgtgcgcctacggccccatcatcaccgtgtacctgcagcccacccccaaccccatgctgggcaccgtggtgcagatcctgatgaacctggtgggccccatgctgaaccccctgatctacaccctgagaaacaaggaggtgaagaccgccctgaagaccatcctgcacagaaccggccacgtgcccgagagctag

SEQ ID NO: 20221 - DNA, 933 bp, Artificial Sequence
  Description of Artificial Sequence: Synthetic coding sequence
atgggcaagaccaagaacaccagcctggacgccgtggtgaccgacttcatcctgctgggcctgagccacccccccaacctgagaagcctgctgttcctggtgttcttcatcatctacatcctgacccagctgggcaacctgctgatcctgctgaccatgtgggccgaccccaagctgtgcgccagacccatgtacatcctgctgggcgtgctgagcttcctggacatgtggctgagcagcgtgaccgtgcccagactgatcctggacttcacccccagcatcaaggccatccccttcggcggctgcgtggcccagctgtacttcttccacttcctgggcagcacccagtgcttcctgtacaccctgatggcctacgacagatacctggccatctgccagcccctgcactaccccgtgctgatgaacggcagactgtgcaccgtgctggtggccggcgcctgggtggccggcagcatgcacggcagcatccaggccaccctgaccttcagactgccctactgcggccccaaccaggtggactacttcatctgcgacatcagagccgtgctgagactggcctgcgccgacaccaccgtgaacgagctggtgaccttcgtggacgtgagagtggtggccgccagctgcttcatgctgatcctgctgagctacgccaacatcgtgcacgccatcctgaagatcagaaccgccgacggcagaagaagagccttcagcacctgcggcagccacctgatcgtggtgaccgtgtactacgtgccctgcatcttcatctacctgagagccggcagcaaggaccccctggacggcgccgccgccgtgttctacaccgtggtgacccccctgctgaaccccctgatctacaccctgagaaaccaggaggtgaagagcgccctgaagagaatcaccgccggctag

SEQ ID NO: 20222 - DNA, 942 bp, Artificial Sequence
  Description of Artificial Sequence: Synthetic coding sequence
atggagagaatcaacagcaccctgctgaccgccttcatcctgaccggcatcccctaccccctgagactgagaaccctgttcttcgtgttcttcttcctgatctacatcctgacccagctgggcaacctgctgatcctgatcaccgtgtgggccgaccccagactgcacgccagacccatgtacatcttcctgggcgtgctgagcgtgatcgacatgagcatcagcagcatcatcgtgcccagactgatgatgaacttcaccctgggcgtgaagcccatccccttcggcggctgcgtggcccagctgtacttctaccacttcctgggcagcacccagtgcttcctgtacaccctgatggcctacgacagatacctggccatctgccagcccctgagataccccgtgctgatgaccgccaagctgagcgccctgctggtggccggcgcctggatggccggcagcatccacggcgccctgcaggccatcctgaccttcagactgccctactgcggccccaaccaggtggactacttcttctgcgacatccccgccgtgctgagactggcctgcgccgacaccaccgtgaacgagctggtgaccttcgtggacatcggcgtggtggtggccagctgcttcagcctgatcctgctgagctacatccagatcatccaggccatcctgagaatccacaccgccgacggcagaagaagagccttcagcacctgcggcgcccacgtgaccgtggtgaccgtgtactacgtgccctgcgccttcatctacctgagacccgagaccaacagccccctggacggcgccgccgccctggtgcccaccgccatcacccccttcctgaaccccctgatctacaccctgagaaaccaggaggtgaagctggccctgaagagaatgctgagaagccccagaacccccagcgaggtgtag

SEQ ID NO: 20223 - DNA, 936 bp, Artificial Sequence
  Description of Artificial Sequence: Synthetic coding sequence
atgagcaacgccagcctggtgaccgccttcatcctgaccggcctgccccacgcccccggcctggacgccctgctgttcggcatcttcctggtggtgtacgtgctgaccgtgctgggcaacctgctgatcctgctggtgatcagagtggacagccacctgcacacccccatgtactacttcctgaccaacctgagcttcatcgacatgtggttcagcaccgtgaccgtgcccaagatgctgatgaccctggtgagccccagcggcagagccatcagcttccacagctgcgtggcccagctgtacttcttccacttcctgggcagcaccgagtgcttcctgtacaccgtgatgagctacgacagatacctggccatcagctaccccctgagatacaccagcatgatgagcggcagcagatgcgccctgctggccaccggcacctggctgagcggcagcctgcacagcgccgtgcagaccatcctgaccttccacctgccctactgcggccccaaccagatccagcactacttctgcgacgccccccccatcctgaagctggcctgcgccgacaccagcgccaacgtgatggtgatcttcgtggacatcggcatcgtggccagcggctgcttcgtgctgatcgtgctgagctacgtgagcatcgtgtgcagcatcctgagaatcagaaccagcgacggcagaagaagagccttccagacctgcgccagccactgcatcgtggtgctgtgcttcttcgtgccctgcgtggtgatctacctgagacccggcagcatggacgccatggacggcgtggtggccatcttctacaccgtgctgacccccctgctgaaccccgtggtgtacaccctgagaaacaaggaggtgaagaaggccgtgctgaagctgagagacaaggtggcccacccccagagaaagtag

SEQ ID NO: 20224 - DNA, 936 bp, Artificial Sequence
  Description of Artificial Sequence: Synthetic coding sequence
atgagcaacgccaccctgctgaccgccttcatcctgaccggcctgccccacgcccccggcctggacgcccccctgttcggcatcttcctggtggtgtacgtgctgaccgtgctgggcaacctgctgatcctgctggtgatcagagtggacagccacctgcacacccccatgtactacttcctgaccaacctgagcttcatcgacatgtggttcagcaccgtgaccgtgcccaagatgctgatgaccctggtgagccccagcggcagaaccatcagcttccacagctgcgtggcccagctgtacttcttccacttcctgggcagcaccgagtgcttcctgtacaccgtgatgagctacgacagatacctggccatcagctaccccctgagatacaccaacatgatgaccggcagaagctgcgccctgctggccaccggcacctggctgagcggcagcctgcacagcgccgtgcagaccatcctgaccttccacctgccctactgcggccccaaccagatccagcactacttctgcgacgccccccccatcctgaagctggcctgcgccgacaccagcgccaacgagatggtgatcttcgtgaacatcggcctggtggccagcggctgcttcgtgctgatcgtgctgagctacgtgagcatcgtgtgcagcatcctgagaatcagaaccagcgagggcagacacagagccttccagacctgcgccagccactgcatcgtggtgctgtgcttcttcggccccggcctgttcatctacctgagacccggcagcagagacgccctgcacggcgtggtggccgtgttctacaccaccctgacccccctgttcaaccccgtggtgtacaccctgagaaacaaggaggtgaagaaggccctgctgaagctgaagaacggcagcgtgttcgcccagggcgagtag

SEQ ID NO: 20225 - DNA, 936 bp, Artificial Sequence
  Description of Artificial Sequence: Synthetic coding sequence
atgagcaacgccagcctgctgaccgccttcatcctgatgggcctgccccacgcccccgccctggacgcccccctgttcggcgtgttcctggtggtgtacgtgctgaccgtgctgggcaacctgctgatcctgctggtgatcagagtggacagccacctgcacaccaccatgtactacttcctgaccaacctgagcttcatcgacatgtggttcagcaccgtgaccgtgcccaagctgctgatgaccctggtgttccccagcggcagagccatcagcttccacagctgcatggcccagctgtacttcttccacttcctgggcggcaccgagtgcttcctgtacagagtgatgagctgcgacagatacctggccatcagctaccccctgagatacaccagcatgatgaccggcagaagctgcaccctgctggccaccagcacctggctgagcggcagcctgcacagcgccgtgcaggccatcctgaccttccacctgccctactgcggccccaactggatccagcactacctgtgcgacgccccccccatcctgaagctggcctgcgccgacaccagcgccatcgagaccgtgatcttcgtgaccgtgggcatcgtggccagcggctgcttcgtgctgatcgtgctgagctacgtgagcatcgtgtgcagcatcctgagaatcagaaccagcgagggcaagcacagagccttccagacctgcgccagccactgcatcgtggtgctgtgcttcttcggccccggcctgttcatctacctgagacccggcagcagaaaggccgtggacggcgtggtggccgtgttctacaccgtgctgacccccctgctgaaccccgtggtgtacaccctgagaaacaaggaggtgaagaaggccctgctgaagctgaaggacaaggtggcccacagccagagcaagtag

SEQ ID NO: 20226 - DNA, 936 bp, Artificial Sequence
  Description of Artificial Sequence: Synthetic coding sequence
atgagcaagaccagcctggtgaccgccttcatcctgaccggcctgccccacgcccccggcctggacgcccccctgttcggcatcttcctggtggtgtacgtgctgaccgtgctgggcaacctgctgatcctgctggtgatcagagtggacagccacctgcacacccccatgtactacttcctgaccaacctgagcttcatcgacatgtggttcagcaccgtgaccgtgcccaagatgctgatgaccctggtgagccccagcggcagagccatcagcttccacagctgcgtggcccagctgtacttcttccacttcctgggcagcaccgagtgcttcctgtacaccgtgatgagctacgacagatacctggccatcagctaccccctgagatacaccagcatgatgagcggcagcagatgcgccctgctggccaccagcacctggctgagcggcagcctgcacagcgccgtgcagaccatcctgaccttccacctgccctactgcggccccaaccagatccagcactacctgtgcgacgccccccccatcctgaagctggcctgcgccgacaccagcgccaacgagatggtgatcttcgtggacatcggcctggtggccagcggctgcttcctgctgatcgtgctgagctacgtgagcatcgtgtgcagcatcctgagaatccacaccagcgagggcagacacagagccttccagacctgcgccagccactgcatcgtggtgctgtgcttcttcgtgccctgcgtgttcatctacctgagacccggcagcagagacgtggtggacggcgtggtggccatcttctacaccgtgctgacccccctgctgaaccccgtggtgtacaccctgagaaacaaggaggtgaagaaggccgtgctgaagctgagagacaaggtggcccacagccagggcgagtag

SEQ ID NO: 20227 - DNA, 957 bp, Artificial Sequence
  Description of Artificial Sequence: Synthetic coding sequence
atgcagagagccaaccacagcaccgtgacccagttcatcctggtgggcttcagcgtgttcccccacctgcagctgatgctgttcctgctgttcctgctgatgtacctgttcaccctgctgggcaacctgctgatcatggccaccgtgtggagcgagagaagcctgcacacccccatgtacctgttcctgtgcgccctgagcgtgagcgagatcctgtacaccgtggccatcatccccagaatgctggccgacctgctgagcacccagagaagcatcgccttcctggcctgcgccagccagatgttcttcagcttcagcttcggcttcacccacagcttcctgctgaccgtgatgggctacgacagatacgtggccatctgccaccccctgagatacaacgtgctgatgagccccagaggctgcgcctgcctggtgggctgcagctgggccggcggcctggtgatgggcatggtggtgaccagcgccatcttccacctggccttctgcggccacaaggagatccaccacttcgcctgccacgtgccccccctgctgaagctggcctgcggcgacgacgtgctggtggtggccaagggcgtgggcctggtgtgcatcaccgccctgctgggctgcttcctgctgatcctgctgagctacgccttcatcgtggccgccatcctgaagatccccagcgccgagggcagaaacaaggccttcagcacctgcgccagccacctgaccgtggtggtggtgcactacggcttcgccagcgtgatctacctgaagcccaagagcccccagagcctggagggcgacaccctgatgggcatcacctacaccgtgctgacccccttcctgagccccatcatcttcagcctgagaaacaaggagctgaaggtggccatgaagaagaccttcttcagcaagctgtaccccgagaagaacgtgatgatgtag

SEQ ID NO: 20228 - DNA, 948 bp, Artificial Sequence
  Description of Artificial Sequence: Synthetic coding sequence
atgctgggcctgaaccacaccagcatgagcgagttcatcctggtgggcttcagcgccttcccccacctgcagctgatgctgttcctgctgttcctgctgatgtacctgttcaccctgctgggcaacctgctgatcatggccaccgtgtggagcgagagaagcctgcacacccccatgtacctgttcctgtgcgtgctgagcgtgagcgagatcctgtacaccgtggccatcatccccagaatgctggccgacctgctgagcacccagagaagcatcgccttcctggcctgcgccagccagatgttcttcagcttcagcttcggcttcacccacagcttcctgctgaccgtgatgggctacgacagatacgtggccatctgccaccccctgagatacaacgtgctgatgagccccagaggctgcgcctgcctggtgggctgcagctgggccggcggcagcgtgatgggcatggtggtgaccagcgccatcttccagctgaccttctgcggcagccacgagatccagcacttcctgtgccacgtgccccccctgctgaagctggcctgcggcaacaacgtgcccgccgtggccctgggcgtgggcctggtgtgcatcatggccctgctgggctgcttcctgctgatcctgctgagctacgccttcatcgtggccgacatcctgaagatccccagcgccgagggcagaaacaaggccttcagcacctgcgccagccacctgatcgtggtgatcgtgcactacggcttcgccagcgtgatctacctgaagcccaagggcccccacagccaggagggcgacaccctgatggccaccacctacgccgtgctgacccccttcctgagccccatcatcttcagcctgagaaacaaggagctgaaggtggccatgaagagaaccttcctgagcaccctgtacagcagcggcacctag

SEQ ID NO: 20229 - DNA, 951 bp, Artificial Sequence
  Description of Artificial Sequence: Synthetic coding sequence
atgcccggccagaactacagaaccatcagcgagttcatcctgagcggcttcagcgccttcccccagcagctgctgcccgtgctgttcctgctgtacctgctgatgttcctgttcaccctgctgggcaacctgctgatcatggccaccgtgtggatcgagagaagactgcacacccccatgtacctgttcctgtgcgccctgagcatcagcgagatcctgttcaccgtggccatcacccccagaatgctggccgacctgctgttcacccacagaagcatcaccttcgtggcctgcgccatccagatgttcttcagcttcatgttcggcttcacccacagcttcctgctgatggtgatgggctacgaccactacgtgaccatctgccaccccctgcactacaacatgctgatgagccccagaggctgcgcccacctggtggcctggacctgggccggcggcagcgtgatgggcatgatggtgaccatgatggtgttccacctgaccttctgcggcagcaacgtgatccaccacttcctgtgccacgtgctgagcctgctgaagctggcctgcggcagcaagaccagcagcgtgatcatgggcgtgatgctggtgtgcgtgaccgccctgatcggctgcctgttcctgatcatcctgagcttcgtgttcatcgtggccgccatcctgagaatccccagcgccgagggcagacacaagaccttcagcacctgcgtgagccacctgaccgtggtggtgatgcactacagcttcgccagcctgatctacctgaagcccaagggcctgcacagcatgtacagcgacgccctgatggccaccacctacaccgtgttcacccccttcctgagccccatcatcttcagcctgagaaacaaggagctgaagaacgccatcaacaagaacttctgcagaagattctgccccctgagcagctag

SEQ ID NO: 20230 - DNA, 951 bp, Artificial Sequence
  Description of Artificial Sequence: Synthetic coding sequence
atgcccagccagaactacagcatcatcagcgagttcaacctgttcggcttcagcgccttcccccagcacctgctgcccatcctgttcctgctgtacctgctgatgttcctgttcaccctgctgggcaacctgctgatcatggccaccatctggatcgagcacagactgcacacccccatgtacctgttcctgtgcaccctgagcgtgagcgagatcctgttcaccgtggccatcacccccagaatgctggccgacctgctgagcacccaccacagcatcaccttcgtggcctgcgccaaccagatgttcttcagcttcatgttcggcttcacccacagcttcctgctgctggtgatgggctacgacagatacgtggccatctgccaccccctgagatacaacgtgctgatgagccccagagactgcgcccacctggtggcctgcacctgggccggcggcagcgtgatgggcatgatggtgaccaccatcgtgttccacctgaccttctgcggcagcaacgtgatccaccacttcttctgccacgtgctgagcctgctgaagctggcctgcgagaacaagaccagcagcgtgatcatgggcgtgatgctggtgtgcgtgaccgccctgatcggctgcctgttcctgatcatcctgagctacgtgttcatcgtggccgccatcctgagaatccccagcgccgagggcagacacaagaccttcagcacctgcgtgagccacctgaccgtggtggtgacccactacagcttcgccagcttcatctacctgaagcccaagggcctgcacagcatgtacagcgacgccctgatggccaccacctacaccgtgttcacccccttcctgagccccatcatcttcagcctgagaaacaaggagctgaagaacgccatcaacaagaacttctacagaaagttctgcccccccagcagctag

SEQ ID NO: 20231 - DNA, 948 bp, Artificial Sequence
  Description of Artificial Sequence: Synthetic coding sequence
atgcagggcctgaaccacaccagcgtgagcgagttcatcctggtgggcttcagcgccttcccccacctgcagctgatgctgttcctgctgttcctgctgatgtacctgttcaccctgctgggcaacctgctgatcatggccaccgtgtggagcgagagaagcctgcacatgcccatgtacctgttcctgtgcgccctgagcatcaccgagatcctgtacaccgtggccatcatccccagaatgctggccgacctgctgagcacccagagaagcatcgccttcctggcctgcgccagccagatgttcttcagcttcagcttcggcttcacccacagcttcctgctgaccgtgatgggctacgacagatacgtggccatctgccaccccctgagatacaacgtgctgatgagcctgagaggctgcacctgcagagtgggctgcagctgggccggcggcctggtgatgggcatggtggtgaccagcgccatcttccacctggccttctgcggccacaaggagatccaccacttcttctgccacgtgccccccctgctgaagctggcctgcggcgacgacgtgctggtggtggccaagggcgtgggcctggtgtgcatcaccgccctgctgggctgcttcctgctgatcctgctgagctacgccttcatcgtggccgccatcctgaagatccccagcgccgagggcagaaacaaggccttcagcacctgcgccagccacctgaccgtggtggtggtgcactacggcttcgccagcgtgatctacctgaagcccaagggcccccagagccccgagggcgacaccctgatgggcatcacctacaccgtgctgacccccttcctgagccccatcatcttcagcctgagaaacaaggagctgaaggtggccatgaagaagacctgcttcaccaagctgttcccccagaactgctag

SEQ ID NO: 20232 - DNA, 963 bp, Artificial Sequence
  Description of Artificial Sequence: Synthetic coding sequence
atgctgctgtgcttcagattcggcaaccagagcatgaagagagagaacttcaccctgatcaccgacttcgtgttccagggcttcagcagcttccacgagcagcagatcaccctgttcggcgtgttcctggccctgtacatcctgaccctggccggcaacatcatcatcgtgaccatcatcagaatggacctgcacctgcacacccccatgtacttcttcctgagcatgctgagcaccagcgagaccgtgtacaccctggtgatcctgcccagaatgctgagcagcctggtgggcatgagccagcccatcagcctggccggctgcgccacccagatgttcttcttcgtgaccttcggcatcaccaactgcttcctgctgaccgccatgggctacgacagatacgtggccatctgcaaccccctgagatacatggtgatcatgaacaagagactgagaatccagctggtgctgggcgcctgcagcatcggcctgatcgtggccatcacccaggtgaccagcgtgttcagactgcccttctgcgccagaaaggtgccccacttcttctgcgacatcagacccgtgatgaagctgagctgcatcgacaccaccgtgaacgagatcctgaccctgatcatcagcgtgctggtgctggtggtgcccatgggcctggtgttcatcagctacgtgctgatcatcagcaccatcctgaagatcgccagcgtggagggcagaaagaaggccttcgccacctgcgccagccacctgaccgtggtgatcgtgcactacagctgcgccagcatcgcctacctgaagcccaagagcgagaacaccagagagcacgaccagctgatcagcgtgacctacaccgtgatcacccccctgctgaaccccgtggtgtacaccctgagaaacaaggaggtgaaggacgccctgtgcagagccgtgggcggcaagttcagctag

SEQ ID NO: 20233 - DNA, 990 bp, Artificial Sequence
  Description of Artificial Sequence: Synthetic coding sequence
atgcccaagctgaacagcaccttcgtgaccgagttcctgttcgagggcttcagcagcttcagaagacagcacaagctggtgttcttcgtggtgttcctgaccctgtacctgctgaccctgagcggcaacgtgatcatcatgaccatcatcagactggaccaccacctgcacacccccatgtacttcttcctgtgcatgctgagcatcagcgagacctgctacaccgtggccatcatcccccacatgctgagcggcctgctgaacccccaccagcccatcgccacccagagctgcgccacccagctgttcttctacctgaccttcggcatcaacaactgcttcctgctgaccgtgatgggctacgacagatacgtggccatctgcaaccccctgagatacagcgtgatcatgggcaagagagcctgcatccagctggccagcggcagcctgggcatcggcctgggcatggccatcgtgcaggtgaccagcgtgttcggcctgcccttctgcgacgccttcgtgatcagccacttcttctgcgacgtgagacacctgctgaagctggcctgcaccgacaccaccgtgaacgagatcatcaacttcgtggtgagcgtgtgcgtgctggtgctgcccatgggcctggtgttcatcagctacgtgctgatcatcagcaccatcctgaagatcgccagcgccgagggccagaagaaggccttcgccacctgcgccagccacctgaccgtggtgatcatccactacggctgcgccagcatcatctacctgaagcccaagagccagagcagcctgggccaggacagactgatcagcgtgacctacacccaccacagccccaccgagccctgctgcgtgcagcccgaggagcagggcggccagagatgcagcgcccagagcagaggcgccaagaacagcgtgagcctgatgaagagaggctgcgagggcttcagcttcgccttcatcaacatgtactag

SEQ ID NO: 20234 - DNA, 930 bp, Artificial Sequence
  Description of Artificial Sequence: Synthetic coding sequence
atgaagagaaagaacttcaccgaggtgagcgagttcatcttcctgggcttcagcagcttcggcaagcaccagatcaccctgttcgtggtgttcctgaccgtgtacatcctgaccctggtggccaacatcatcatcgtgaccatcatctgcatcgaccaccacctgcacacccccatgtacttcttcctgagcatgctggccagcagcgagaccgtgtacaccctggtgatcgtgcccagaatgctgctgagcctgatcttccacaaccagcccatcagcctggccggctgcgccacccagatgttcttcttcgtgatcctggccaccaacaactgcttcctgctgaccgccatgggctacgacagatacgtggccatctgcagacccctgagatacaccgtgatcatgagcaagggcctgtgcgcccagctggtgtgcggcagcttcggcatcggcctgaccatggccgtgctgcacgtgaccgccatgttcaacctgcccttctgcggcaccgtggtggaccacttcttctgcgacatctaccccgtgatgaagctgagctgcatcgacaccaccatcaacgagatcatcaactacggcgtgagcagcttcgtgatcttcgtgcccatcggcctgatcttcatcagctacgtgctggtgatcagcagcatcctgcagatcgccagcgccgagggcagaaagaagaccttcgccacctgcgtgagccacctgaccgtggtgatcgtgcactgcggctgcgccagcatcgcctacctgaagcccaagagcgagagcagcatcgagaaggacctggtgctgagcgtgacctacaccatcatcacccccctgctgaaccccgtggtgtacagcctgagaaacaaggaggtgaaggacgccctgtgcagagtggtgggcagaaacatcagctag

SEQ ID NO: 20235 - DNA, 942 bp, Artificial Sequence
  Description of Artificial Sequence: Synthetic coding sequence
atggagcaggtgaacaagaccgtggtgagagagttcgtggtgctgggcttcagcagcctggccagactgcagcagctgctgttcgtgatcttcctgctgctgtacctgttcaccctgggcaccaacgccatcatcatcagcaccatcgtgctggacagagccctgcacacccccatgtacttcttcctggccatcctgagctgcagcgagatctgctacaccttcgtgatcgtgcccaagatgctggtggacctgctgagccagaagaagaccatcagcttcctgggctgcgccatccagatgttcagcttcctgttcttcggcagcagccacagcttcctgctggccgccatgggctacgacagatacatggccatctgcaaccccctgagatacagcgtgctgatgggccacggcgtgtgcatgggcctgatggccgccgcctgcgcctgcggcttcaccgtgagcctggtgaccaccagcctggtgttccacctgcccttccacagcagcaaccagctgcaccacttcttctgcgacatcagccccgtgctgaagctggccagccagcacagcggcttcagccagctggtgatcttcatgctgggcgtgttcgccctggtgatccccctgctgctgatcctggtgagctacatcagaatcatcagcgccatcctgaagatccccagcagcgtgggcagatacaagaccttcagcacctgcgccagccacctgatcgtggtgaccgtgcactacagctgcgccagcttcatctacctgagacccaagaccaactacaccagcagccaggacaccctgatcagcgtgagctacaccatcctgacccccctgttcaaccccatgatctacagcctgagaaacaaggagttcaagagcgccctgagaagaaccatcggccagaccttctaccccctgagctag

SEQ ID NO: 20236 - DNA, 939 bp, Artificial Sequence
  Description of Artificial Sequence: Synthetic coding sequence
atggagagagtgaacgagaccgtggtgagagaggtgatcttcctgggcttcagcagcctggccagactgcagcagctgctgttcgtgatcttcctgctgctgtacctgttcaccctgggcaccaacgccatcatcatcagcaccatcgtgctggacagagccctgcacatccccatgtacttcttcctggccatcctgagctgcagcgagatctgctacaccttcatcatcgtgcccaagatgctggtggacctgctgagccagaagaagaccatcagcttcctgggctgcgccatccagatgttcagcttcctgttcctgggctgcagccacagcttcctgctggccgtgatgggctacgacagatacatcgccatctgcaaccccctgagatacagcgtgctgatgggccacggcgtgtgcatgggcctggtggccgccgcctgcgcctgcggcttcaccgtggcccagatcatcaccagcctggtgttccacctgcccttctacagcagcaaccagctgcaccacttcttctgcgacatcgcccccgtgctgaagctggccagccaccacaaccacttcagccagatcgtgatcttcatgctgtgcaccctggtgctggccatccccctgctgctgatcctggtgagctacgtgcacatcctgagcgccatcctgcagttccccagcaccctgggcagatgcaaggccttcagcacctgcgtgagccacctgatcatcgtgaccgtgcactacggctgcgccagcttcatctacctgagaccccagagcaactacagcagcagccaggacgccctgatcagcgtgagctacaccatcatcacccccctgttcaaccccatgatctacagcctgagaaacaaggagttcaagagcgccctgtgcaagatcgtgagaagaaccatcagcctgctgtag

SEQ ID NO: 20237 - DNA, 942 bp, Artificial Sequence
  Description of Artificial Sequence: Synthetic coding sequence
atggccggcgagaaccacaccaccctgcccgagttcctgctgctgggcttcagcgacctgaaggccctgcagggccccctgttctgggtggtgctgctggtgtacctggtgaccctgctgggcaacagcctgatcatcctgctgacccaggtgagccccgccctgcacagccccatgtacttcttcctgagacagctgagcgtggtggagctgttctacaccaccgacatcgtgcccagaaccctggccaacctgggcagcccccacccccaggccatcagcttccagggctgcgccgcccagatgtacgtgttcatcgtgctgggcatcagcgagtgctgcctgctgaccgccatggcctacgacagatacgtggccatctgccagcccctgagatacagcaccctgctgagccccagagcctgcatggccatggtgggcaccagctggctgaccggcatcatcaccgccaccacccacgccagcctgatcttcagcctgcccttcagaagccaccccatcatcccccacttcctgtgcgacatcctgcccgtgctgagactggccagcgccggcaagcacagaagcgagatcagcgtgatgaccgccaccatcgtgttcatcatgatccccttcagcctgatcgtgaccagctacatcagaatcctgggcgccatcctggccatggccagcacccagagcagaagaaaggtgttcagcacctgcagcagccacctgctggtggtgagcctgttcttcggcaccgccagcatcacctacatcagaccccaggccggcagcagcgtgaccaccgacagagtgctgagcctgttctacaccgtgatcacccccatgctgaaccccatcatctacaccctgagaaacaaggacgtgagaagagccctgagacacctggtgaagagacagagacccagcccctag

SEQ ID NO: 20238 - DNA, 960 bp, Artificial Sequence
  Description of Artificial Sequence: Synthetic coding sequence
atgcccgtgggcaagctggtgttcaaccagagcgagcccaccgagttcgtgttcagagccttcaccaccgccaccgagttccaggtgctgctgttcctgctgttcctgctgctgtacctgatgatcctgtgcggcaacaccgccatcatctgggtggtgtgcacccacagcaccctgagaacccccatgtacttcttcctgagcaacctgagcttcctggagctgtgctacaccaccgtggtggtgcccctgatgctgagcaacatcctgggcgcccagaagcccatcagcctggccggctgcggcgcccagatgttcttcttcgtgaccctgggcagcaccgactgcttcctgctggccatcatggcctacgacagatacgtggccatctgccaccccctgcactacaccctgatcatgaccagagagctgtgcacccagatgctgggcggcgccctgggcctggccctgttccccagcctgcagctgaccgccctgatcttcaccctgcccttctgcggccaccaccaggagatcaaccacttcctgtgcgacgtgccccccgtgctgagactggcctgcgccgacatcagagtgcaccaggccgtgctgtacgtggtgagcatcctggtgctgaccatccccttcctgctgatctgcgtgagctacgtgttcatcacctgcgccatcctgagcatcagaagcgccgagggcagaagaagagccttcagcacctgcagcttccacctgaccgtggtgctgctgcagtacggctgctgcagcctggtgtacctgagacccagaagcagcaccagcgaggacgaggacagccagatcgccctggtgtacaccttcgtgacccccctgctgaaccccctgctgtacagcctgagaaacaaggacgtgaagggcgccctgagaagcgccatcatcagaaaggccgccagcgacgccaactag

SEQ ID NO: 20239 - DNA, 1008 bp, Artificial Sequence
  Description of Artificial Sequence: Synthetic coding sequence
atgccccagatcctgatcttcacctacctgaacatgttctacttcttcccccccctgcagatcctggccgagaacctgaccatggtgaccgagttcctgctgctgggcttcagcagcctgggcgagatccagctggccctgttcgtggtgttcctgttcctgtacctggtgatcctgagcggcaacgtgaccatcatcagcgtgatccacctggacaagagcctgcacacccccatgtacttcttcctgggcatcctgagcaccagcgagaccttctacaccttcgtgatcctgcccaagatgctgatcaacctgctgagcgtggccagaaccatcagcttcaactgctgcgccctgcagatgttcttcttcctgggcttcgccatcaccaactgcctgctgctgggcgtgatgggctacgacagatacgccgccatctgccaccccctgcactaccccaccctgatgagctggcaggtgtgcggcaagctggccgccgcctgcgccatcggcggcttcctggccagcctgaccgtggtgaacctggtgttcagcctgcccttctgcagcgccaacaaggtgaaccactacttctgcgacatcagcgccgtgatcctgctggcctgcaccaacaccgacgtgaacgagttcgtgatcttcatctgcggcgtgctggtgctggtggtgcccttcctgttcatctgcgtgagctacctgtgcatcctgagaaccatcctgaagatccccagcgccgagggcagaagaaaggccttcagcacctgcgccagccacctgagcgtggtgatcgtgcactacggctgcgccagcttcatctacctgagacccaccgccaactacgtgagcaacaaggacagactggtgaccgtgacctacaccatcgtgacccccctgctgaaccccatggtgtacagcctgagaaacaaggacgtgcagctggccatcagaaaggtgctgggcaagaagggcagcctgaagctgtacaactag

SEQ ID NO: 20240 - DNA, 996 bp, Artificial Sequence
  Description of Artificial Sequence: Synthetic coding sequence
atgaccagcagaagcgtgtgcgagaagatgaccatgaccaccgagaaccccaaccagaccgtggtgagccacttcttcctggagggcctgagatacaccgccaagcacagcagcctgttcttcctgctgttcctgctgatctacagcatcaccgtggccggcaacctgctgatcctgctgaccgtgggcagcgacagccacctgagcctgcccatgtaccacttcctgggccacctgagcttcctggacgcctgcctgagcaccgtgaccgtgcccaaggtgatggccggcctgctgaccctggacggcaaggtgatcagcttcgagggctgcgccgtgcagctgtactgcttccacttcctggccagcaccgagtgcttcctgtacaccgtgatggcctacgacagatacctggccatctgccagcccctgcactaccccgtggccatgaacagaagaatgtgcgccgagatggccggcatcacctgggccatcggcgccacccacgccgccatccacaccagcctgaccttcagactgctgtactgcggcccctgccacatcgcctacttcttctgcgacatcccccccgtgctgaagctggcctgcaccgacaccaccatcaacgagctggtgatgctggccagcatcggcatcgtggccgccggctgcctgatcctgatcgtgatcagctacatcttcatcgtggccgccgtgctgagaatcagaaccgcccagggcagacagagagccttcagcccctgcaccgcccagctgaccggcgtgctgctgtactacgtgccccccgtgtgcatctacctgcagcccagaagcagcgaggccggcgccggcgcccccgccgtgttctacaccatcgtgacccccatgctgaaccccttcatctacaccctgagaaacaaggaggtgaagcacgccctgcagagactgctgtgcagcagcttcagagagagcaccgccggcagcccccccccctag

SEQ ID NO: 20241 - DNA, 945 bp, Artificial Sequence
  Description of Artificial Sequence: Synthetic coding sequence
atgagaggcttcaacaagaccaccgtggtgacccagttcatcctggtgggcttcagcagcctgggcgagctgcagctgctgctgttcgtgatcttcctgctgctgtacctgaccatcctggtggccaacgtgaccatcatggccgtgatcagattcagctggaccctgcacacccccatgtacggcttcctgttcatcctgagcttcagcgagagctgctacaccttcgtgatcatcccccagctgctggtgcacctgctgagcgacaccaagaccatcagcttcatggcctgcgccacccagctgttcttcttcctgggcttcgcctgcaccaactgcctgctgatcgccgtgatgggctacgacagatacgtggccatctgccaccccctgagatacaccctgatcatcaacaagagactgggcctggagctgatcagcctgagcggcgccaccggcttcttcatcgccctggtggccaccaacctgatctgcgacatgagattctgcggccccaacagagtgaaccactacttctgcgacatggcccccgtgatcaagctggcctgcaccgacacccacgtgaaggagctggccctgttcagcctgagcatcctggtgatcatggtgcccttcctgctgatcctgatcagctacggcttcatcgtgaacaccatcctgaagatccccagcgccgagggcaagaaggccttcgtgacctgcgccagccacctgaccgtggtgttcgtgcactacggctgcgccagcatcatctacctgagacccaagagcaagagcgccagcgacaaggaccagctggtggccgtgacctacaccgtggtgacccccctgctgaaccccctggtgtacagcctgagaaacaaggaggtgaagaccgccctgaagagagtgctgggcatgcccgtggccaccaagatgagctag

SEQ ID NO: 20242 - DNA, 930 bp, Artificial Sequence
  Description of Artificial Sequence: Synthetic coding sequence
atggagggcatcaacaagaccgccaagatgcagttcttcttcagacccttcagccccgaccccgaggtgcagatgctgatcttcgtggtgttcctgatgatgtacctgaccagcctgggcggcaacgccaccatcgccgtgatcgtgcagatcaaccacagcctgcacacccccatgtacttcttcctggccaacctggccgtgctggagatcttctacaccagcagcatcacccccctggccctggccaacctgctgagcatgggcaagacccccgtgagcatcaccggctgcggcacccagatgttcttcttcgtgttcctgggcggcgccgactgcgtgctgctggtggtgatggcctacgaccagttcatcgccatctgccaccccctgagatacagactgatcatgagctggagcctgtgcgtggagctgctggtgggcagcctggtgctgggcttcctgctgagcctgcccctgaccatcctgatcttccacctgcccttctgccacaacgacgagatctaccacttctactgcgacatgcccgccgtgatgagactggcctgcgccgacaccagagtgcacaagaccgccctgtacatcatcagcttcatcgtgctgagcatccccctgagcctgatcagcatcagctacgtgttcatcgtggtggccatcctgagaatcagaagcgccgagggcagacagcaggcctacagcacctgcagcagccacatcctggtggtgctgctgcagtacggctgcaccagcttcatctacctgagccccagcagcagctacagccccgagatgggcagagtggtgagcgtggcctacaccttcatcacccccatcctgaaccccctgatctacagcctgagaaacaaggagctgaaggacgccctgagaaaggccctgagaaagttctag

SEQ ID NO: 20243 - DNA, 918 bp, Artificial Sequence
  Description of Artificial Sequence: Synthetic coding sequence
atggagttcgtgttcctggcctaccccagctgccccgagctgcacatcctgagcttcctgggcgtgagcctggtgtacggcctgatcatcaccggcaacatcctgatcgtggtgagcatccacaccgagacctgcctgtgcaccagcatgtactacttcctgggcagcctgagcggcatcgagatctgctacaccgccgtggtggtgccccacatcctggccaacaccctgcagagcgagaagaccatcaccctgctgggctgcgccacccagatggccttcttcatcgccctgggcagcgccgactgcttcctgctggccgccatggcctacgacagatacgtggccatctgccaccccctgcagtaccccctgctgatgaccctgaccctgtgcgtgcacctggtggtggccagcgtgatcagcggcctgttcctgagcctgcagctggtggccttcatcttcagcctgcccttctgccaggcccagggcatcgagcacttcttctgcgacgtgccccccgtgatgcacgtggtgtgcgcccagagccacatccacgagcagagcgtgctggtggccgccatcctggccatcgccgtgcccttcttcctgatcaccaccagctacaccttcatcgtggccgccctgctgaagatccacagcgccgccggcagacacagagccttcagcacctgcagcagccacctgaccgtggtgctgctgcagtacggctgctgcgccttcatgtacctgtgccccagcagcagctacaaccccaagcaggacagattcatcagcctggtgtacaccctgggcacccccctgctgaaccccctgatctacgccctgagaaacagcgagatgaagggcgccgtgggcagagtgctgaccagaaactgcctgagccagaacagctag

SEQ ID NO: 20244 - DNA, 981 bp, Artificial Sequence
  Description of Artificial Sequence: Synthetic coding sequence
atggtgctgaacgtgtactgctgcttcttccagatcagcgacatccagaccatgaagatcaaccagaccatcctgaaggagttcatcctggtgggcttcagcgtgtacccccacgtgcagaccttcctgttcgtggtgttcttctgcctgtacctgctgaccctggccggcaacctgatcatcatgggcctgacctgggtggacagaagcctgcacacccccatgtacctgttcctgagcgccctgagcttcagcgagacctgctacaccctgaccatcgtgcccaagatgctggaggacctgctggccaaggacagaagcatcagcgtgaccggctgcagcctgcagatgtgcttcttcctgggcctgggcggcaccaactgcatcatcctgaccctgatgggctacgacagattcctggccatctgcaaccccctgagataccccctgctgatgaccaacatcgtgtgcggccagctggtggccagcgcctgcaccgccggcttcttcatcagcctgaccgagaccgccctgatcttcagagacagcttctgcagacccaacctggtgaagcacttcttctgccacatgctggccgtgatcagactgagctgcatcgacagcaaccacaccgagttcatcatcaccctgatcagcgtgagcggcctgctgggcaccctgctgctgatcatcctgaccgacgtgttcatcatcagcaccgtgctgagaatccccagcgccgagggcaagcagaaggccttcaccacctgcgccagccacctgaccgtggtgatcatccacttcggcttcgccagcatcgtgtacctgaagcccgaggccagcggcgacgacaccctgatcgccgtgccctacaccgtgatcacccccttcctgagccccatcatcttcagcctgagaaacaaggacatgaagaacgccttcagaagaatgatgggcaacaccgtggccctgaagaagtag

SEQ ID NO: 20245 - DNA, 942 bp, Artificial Sequence
  Description of Artificial Sequence: Synthetic coding sequence
atgggccagaccaacgtgaccagctggagagacttcgtgttcctgggcttcagcagcagcggcgagctgcagctgctgctgttcgccctgttcctgagcctgtacctggtgaccctgaccagcaacgtgttcatcatcatcgccatcagactggacagccacctgcacacccccatgtacctgttcctgagcttcctgagcttcagcgagacctgctacaccctgggcatcatccccagaatgctgagcggcctggccggcggcgaccaggccatcagctacgtgggctgcgccgcccagatgttcttcagcgccagctgggcctgcaccaactgcttcctgctggccgccatgggcttcgacagatacgtggccatctgcgcccccctgcactacgccagccacatgaaccccaccctgtgcgcccagctggtgatcaccagcttcctgaccggctacctgttcggcctgggcatgaccctggtgatcttccacctgagcttctgcagcagccacgagatccagcacttcttctgcgacaccccccccgtgctgagcctggcctgcggcgacaccggccccagcgagctgagaatcttcatcctgagcctgctggtgctgctggtgagcttcttcttcatcaccatcagctacgcctacatcctggccgccatcctgagaatccccagcgccgagggccagaagaaggccttcagcacctgcgccagccacctgaccgtggtgatcatccactacggctgcgccagcttcgtgtacctgagacccaaggccagctacagcctggagagagaccagctgatcgccatgacctacaccgtggtgacccccctgctgaaccccatcgtgtacagcctgagaaacagagccatccagaccgccctgagaaacgccttcagaggcagactgctgggcaagggctag

SEQ ID NO: 20246 - DNA, 39 bp, Artificial Sequence
  Description of Artificial Sequence: Synthetic coding sequence
gtgaccccccagaagctgagcttctgcagcagccactag

SEQ ID NO: 20247 - DNA, 948 bp, Artificial Sequence
  Description of Artificial Sequence: Synthetic coding sequence
atggagatcgtgagcaccggcaacgagaccatcaccgagttcgtgctgctgggcttctacgacatccccgagctgcacttcctgttcttcatcgtgttcaccgccgtgtacgtgttcatcatcatcggcaacatgctgatcatcgtggccgtggtgagcagccagagactgcacaagcccatgtacatcttcctggccaacctgagcttcctggacatcctgtacaccagcgccgtgatgcccaagatgctggagggcttcctgcaggaggccaccatcagcgtggccggctgcctgctgcagttcttcatcttcggcagcctggccaccgccgagtgcctgctgctggccgtgatggcctacgacagatacctggccatctgctaccccctgcactaccccctgctgatgggccccagaagatacatgggcctggtggtgaccacctggctgagcggcttcgtggtggacggcctggtggtggccctggtggcccagctgagattctgcggccccaaccacatcgaccagttctactgcgacttcatgctgttcgtgggcctggcctgcagcgaccccagagtggcccaggtgaccaccctgatcctgagcgtgttctgcctgaccatccccttcggcctgatcctgaccagctacgccagaatcgtggtggccgtgctgagagtgcccgccggcgccagcagaagaagagccttcagcacctgcagcagccacctggccgtggtgaccaccttctacggcaccctgatgatcttctacgtggcccccagcgccgtgcacagccagctgctgagcaaggtgttcagcctgctgtacaccgtggtgacccccctgttcaaccccgtgatctacaccatgagaaacaaggaggtgcaccaggccctgagaaagatcctgtgcatcaagcagaccgagaccctggactag

SEQ ID NO: 20248 - DNA, 948 bp, Artificial Sequence; identical to SEQ ID NO: 20247
  Description of Artificial Sequence: Synthetic coding sequence

SEQ ID NO: 20249 - DNA, 948 bp, Artificial Sequence; identical to SEQ ID NO: 20247
  Description of Artificial Sequence: Synthetic coding sequence

SEQ ID NO: 20250 - DNA, 948 bp, Artificial Sequence; identical to SEQ ID NO: 20247
  Description of Artificial Sequence: Synthetic coding sequence

SEQ ID NO: 20251 - DNA, 948 bp, Artificial Sequence; identical to SEQ ID NO: 20247
  Description of Artificial Sequence: Synthetic coding sequence

SEQ ID NO: 20252 - DNA, 948 bp, Artificial Sequence; identical to SEQ ID NO: 20247
  Description of Artificial Sequence: Synthetic coding sequence

SEQ ID NO: 20253 - DNA, 948 bp, Artificial Sequence; identical to SEQ ID NO: 20247
  Description of Artificial Sequence: Synthetic coding sequence

SEQ ID NO: 20254 - DNA, 948 bp, Artificial Sequence; identical to SEQ ID NO: 20247
  Description of Artificial Sequence: Synthetic coding sequence

SEQ ID NO: 20255 - DNA, 948 bp, Artificial Sequence; identical to SEQ ID NO: 20247
  Description of Artificial Sequence: Synthetic coding sequence

SEQ ID NO: 20256 - DNA, 948 bp, Artificial Sequence; identical to SEQ ID NO: 20247
  Description of Artificial Sequence: Synthetic coding sequence

SEQ ID NO: 20257 - DNA, 948 bp, Artificial Sequence; identical to SEQ ID NO: 20247
  Description of Artificial Sequence: Synthetic coding sequence

SEQ ID NO: 20258 - DNA, 948 bp, Artificial Sequence; identical to SEQ ID NO: 20247
  Description of Artificial Sequence: Synthetic coding sequence

SEQ ID NO: 20259 - DNA, 948 bp, Artificial Sequence; identical to SEQ ID NO: 20247
  Description of Artificial Sequence: Synthetic coding sequence

SEQ ID NO: 20260 - DNA, 948 bp, Artificial Sequence; identical to SEQ ID NO: 20247
  Description of Artificial Sequence: Synthetic coding sequence

SEQ ID NO: 20261 - DNA, 948 bp, Artificial Sequence; identical to SEQ ID NO: 20247
  Description of Artificial Sequence: Synthetic coding sequence

SEQ ID NO: 20262 - DNA, 948 bp, Artificial Sequence; identical to SEQ ID NO: 20247
  Description of Artificial Sequence: Synthetic coding sequence

SEQ ID NO: 20263 - DNA, 948 bp, Artificial Sequence; identical to SEQ ID NO: 20247
  Description of Artificial Sequence: Synthetic coding sequence

SEQ ID NO: 20264 - DNA, 948 bp, Artificial Sequence; identical to SEQ ID NO: 20247
  Description of Artificial Sequence: Synthetic coding sequence

SEQ ID NO: 20265 - DNA, 948 bp, Artificial Sequence; identical to SEQ ID NO: 20247
  Description of Artificial Sequence: Synthetic coding sequence

SEQ ID NO: 20266 - DNA, 948 bp, Artificial Sequence; identical to SEQ ID NO: 20247
  Description of Artificial Sequence: Synthetic coding sequence

SEQ ID NO: 20267 - DNA, 948 bp, Artificial Sequence; identical to SEQ ID NO: 20247
  Description of Artificial Sequence: Synthetic coding sequence

SEQ ID NO: 20268 - DNA, 1038 bp, Artificial Sequence
  Description of Artificial Sequence: Synthetic coding sequence
atgcacttcctgagccagaacgacctgaacatcaacctgatcccccacctgtgcctgcacagacacagcgtgatcgccggcgccttcaccatccacagacacatgaagatcttcaacagccccagcaacagcagcaccttcaccggcttcatcctgctgggcttcccctgccccagagagggccagatcctgctgttcgtgctgttcaccgtggtgtacctgctgaccctgatgggcaacggcagcatcatctgcgccgtgcactgggaccagagactgcacgcccccatgtacatcctgctggccaacttcagcttcctggagatctgctacgtgaccagcaccgtgcccagcatgctggccaacttcctgagcgacaccaagatcatcagcttcagcggctgcttcctgcagttctacttcttcttcagcctgggcagcaccgagtgcttcttcctggccgtgatggccttcgacagatacctggccatctgcagacccctgagataccccaccatcatgaccagaagactgtgcaccaacctggtggtgaactgctgggtgctgggcttcatctggttcctgatccccatcgtgaacatcagccagatgagcttctgcggcagcagaatcatcgaccacttcctgtgcgaccccgcccccctgctgaccctgacctgcaagaagggccccgtgatcgagctggtgttcagcgtgctgagccccctgcccgtgttcatgctgttcctgttcatcgtgggcagctacgccctggtggtgagagccgtgctgagagtgcccagcgccgccggcagaagaaaggccttcagcacctgcggcagccacctggccgtggtgagcctgttctacggcagcgtgctggtgatgtacggcagcccccccagcaagaacgaggccggcaagcagaagaccgtgaccctgttctacagcgtggtgacccccctgctgaaccccgtgatctacagcctgagaaacaaggacatgagaaaggccctgaagaagttctggggcacctag

SEQ ID NO: 20269 - DNA, 981 bp, Artificial Sequence
  Description of Artificial Sequence: Synthetic coding sequence
atgtgccccctgaccctgcaggtgaccggcctgatgaacgtgagcgagcccaacagcagcttcgccttcgtgaacgagttcatcctgcagggcttcagctgcgagtggaccatccagatcttcctgttcagcctgttcaccaccacctacgccctgaccatcaccggcaacggcgccatcgccttcgtgctgtggtgcgacagaagactgcacacccccatgtacatgttcctgggcaacttcagcttcctggagatctggtacgtgagcagcaccgtgcccaagatgctggtgaacttcctgagcgagaagaagaacatcagcttcgccggctgcttcctgcagttctacttcttcttcagcctgggcaccagcgagtgcctgctgctgaccgtgatggccttcgaccagtacctggccatctgcagacccctgctgtaccccaacatcatgaccggccacctgtacgccaagctggtgatcctgtgctgggtgtgcggcttcctgtggttcctgatccccatcgtgctgatcagccagatgcccttctgcggccccaacatcatcgaccacgtggtgtgcgaccccggccccagattcgccctggactgcgtgagcgcccccagaatccagctgttctgctacaccctgagcagcctggtgatcttcggcaacttcctgttcatcatcggcagctacaccctggtgctgaaggccatgctgggcatgcccagcagcaccggcagacacaaggccttcagcacctgcggcagccacctggccgtggtgagcctgtgctacagcagcctgatggtgatgtacgtgagccccggcctgggccacagcaccggcatgcagaagatcgagaccctgttctacgccatggtgacccccctgttcaaccccctgatctacagcctgcagaacaaggagatcaaggccgccctgagaaaggtgctgggcagcagcaacatcatctag

SEQ ID NO: 20270 - DNA, 975 bp, Artificial Sequence
  Description of Artificial Sequence: Synthetic coding sequence
atgagcttcttcttcgtggacctgagacccatgaacagaagcgccacccacatcgtgaccgagttcatcctgctgggcttccccggctgctggaagatccagatcttcctgttcagcctgttcctggtgatctacgtgctgaccctgctgggcaacggcgccatcatctacgccgtgagatgcaaccccctgctgcacacccccatgtacttcctgctgggcaacttcgccttcctggagatctggtacgtgagcagcaccatccccaacatgctggtgaacatcctgagcaagaccaaggccatcagcttcagcggctgcttcctgcagttctacttcttcttcagcctgggcaccaccgagtgcctgttcctggccgtgatggcctacgacagatacctggccatctgccaccccctgcagtaccccgccatcatgaccgtgagattctgcggcaagctggtgagcttctgctggctgatcggcttcctgggctaccccatccccatcttctacatcagccagctgcccttctgcggccccaacatcatcgaccacttcctgtgcgacatggaccccctgatggccctgagctgcgcccccgcccccatcaccgagtgcatcttctacacccagagcagcctggtgctgttcttcaccagcatgtacatcctgagaagctacatcctgctgctgaccgccgtgttccaggtgcccagcgccgccggcagaagaaaggccttcagcacctgcggcagccacctggtggtggtgagcctgttctacggcaccgtgatggtgatgtacgtgagccccacctacggcatccccaccctgctgcagaagatcctgaccctggtgtacagcgtgaccacccccctgttcaaccccctgatctacaccctgagaaacaaggacatgaagctggccctgagaaacgtgctgttcggcatgagaatcagacagaacagctag

SEQ ID NO: 20271 - DNA, 993 bp, Artificial Sequence
  Description of Artificial Sequence: Synthetic coding sequence
atgttcttcatcatccacagcctggtgaccagcgtgttcctgaccgccctgggcccccagaacagaaccatgcacttcgtgaccgagttcgtgctgctgggcttccacggccagagagagatgcagagctgcttcttcagcttcatcctggtgctgtacctgctgaccctgctgggcaacggcgccatcgtgtgcgccgtgaagctggacagaagactgcacacccccatgtacatcctgctgggcaacttcgccttcctggagatctggtacatcagcagcaccgtgcccaacatgctggtgaacatcctgagcgagatcaagaccatcagcttcagcggctgcttcctgcagttctacttcttcttcagcctgggcaccaccgagtgcttcttcctgagcgtgatggcctacgacagatacctggccatctgcagacccctgcactaccccagcatcatgaccggcaagttctgcatcatcctggtgtgcgtgtgctgggtgggcggcttcctgtgctaccccgtgcccatcgtgctgatcagccagctgcccttctgcggccccaacatcatcgaccacctggtgtgcgaccccggccccctgttcgccctggcctgcatcagcgcccccagcaccgagctgatctgctacaccttcaacagcatgatcatcttcggccccttcctgagcatcctgggcagctacaccctggtgatcagagccgtgctgtgcatccccagcggcgccggcagaaccaaggccttcagcacctgcggcagccacctgatggtggtgagcctgttctacggcaccctgatggtgatgtacgtgagccccaccagcggcaaccccgccggcatgcagaagatcatcaccctggtgtacaccgccatgacccccttcctgaaccccctgatctacagcctgagaaacaaggacatgaaggacgccctgaagagagtgctgggcctgaccgtgagccagaactag

SEQ ID NO: 20272 - DNA, 969 bp, Artificial Sequence
  Description of Artificial Sequence: Synthetic coding sequence
atggagccccagaacaccagcaccgtgaccaacttccagctgctgggcttccagaacctgctggagtggcaggccctgctgttcgtgatcttcctgctgatctactgcctgaccatcatcggcaacgtggtgatcatcaccgtggtgagccagggcctgagactgcacagccccatgtacatgttcctgcagcacctgagcttcctggaggtgtggtacaccagcaccaccgtgcccctgctgctggccaacctgctgagctggggccaggccatcagcttcagcgcctgcatggcccagctgtacttcttcgtgttcctgggcgccaccgagtgcttcctgctggccttcatggcctacgacagatacctggccatctgcagccccctgagataccccttcctgatgcacagaggcctgtgcgccagactggtggtggtgagctggtgcaccggcgtgagcaccggcttcctgcccagcctgatgatcagcagactggacttctgcggcagaaaccagatcaaccacttcttctgcgacctgccccccctgatgcagctgagctgcagcagagtgtacatcaccgaggtgaccatcttcatcctgagcatcgccgtgctgtgcatctgcttcttcctgaccctgggcccctacgtgttcatcgtgagcagcatcctgagaatccccagcaccagcggcagaagaaagaccttcagcacctgcggcagccacctggccgtggtgaccctgtactacggcaccatgatcagcatgtacgtgtgccccagcccccacctgctgcccgagatcaacaagatcatcagcgtgttctacaccgtggtgacccccctgctgaaccccgtgatctacagcctgagaaacaaggacttcaaggaggccgtgagaaaggtgatgagaagaaagtgcggcatcctgtggagcaccagcaagagaaagttcctgtactag

SEQ ID NO: 20273 - DNA, 924 bp, Artificial Sequence
  Description of Artificial Sequence: Synthetic coding sequence
atgctgaacaccaccagcgtgaccgagttcctgctgctgggcgtgaccgacatccaggagctgcagcccttcctgttcgtggtgttcctgaccatctacttcatcagcgtgaccggcaacggcgccgtgctgatgatcgtgatcagcgaccccagactgcacagcctgatgtacttcttcctgggcaacctgagctacctggacatctgctacagcaccgtgaccctgcccaagatgctgcagaacttcctgagcacccacaaggccatcagcttcctgggctgcatcagccagctgcacttcttccacagcctgggcagcaccgagagcatgctgttcgccgtgatggccttcgacctgagcgtggccatctgcaagcccctgagatacaccgtgatcatgaacccccagctgtgcacccagatggccatcaccatctgggtgatcggcttcttccacgccctgctgcacagcgtgatgaccagcagactgaacttctgcggcagcaacagaatccaccacttcctgtgcgacatcaagcccctgctgaagctggcctgcggcaacaccgagctgaaccagtggctgctgagcaccgtgaccggcaccatcgccatgggccccttcttcctgaccctgctgagctacttctacatcatcacctacctgttcttcaagaccagaagctgcagcatgctgtgcaaggccctgagcacctgcgccagccacttcatggtggtgatcctgttctacgcccccgtgctgttcacctacatccaccccgccctggagagcttcatggaccaggacagaatcgtggccatcatgtacaccgtggtgacccccgtgctgaaccccctgatctacaccctgagaaacaaggaggtgaagggcgccctgggcagagtgatcagaagactgtag

SEQ ID NO: 20274 - DNA, 924 bp, Artificial Sequence
  Description of Artificial Sequence: Synthetic coding sequence
atgctgaacaccaccagcgtgaccgagttcctgctgctgggcgtgaccgacatccaggagctgcagcccttcctgttcgtggtgttcctgaccatctacttcatcagcgtgaccggcaacggcgccgtgctgatgatcttcatcagcgaccccagactgcacagccccatgtacttcttcctgggcaacctgagctacctggacatctgctacagcaccgtgaccctgcccaagatgctgcagaacttcctgagcacccacaaggccatcagcttcctgggctgcatcagccagctgcacttcttccacttcctgggcagcaccgagagcatgctgctggccgtgatggccttcgacagaagcgtggccatctgcaagcccctgagatacaccgtgatcatgaacccccagctgtgcacccagatggccatcaccatctgggtgatcggcttcttccacgccctgctgcacagcatcatgaccagcagactgaacttctgcggcagcaacagaatccaccacttcctgtgcgacatcaagcccctgctgaagctggcctgcggcaacaccgagctgaaccagtggctgctgagcaccgtgaccggcaccatcgccatgggccccttcttcctgaccctgctgagctacttctacatcatcacctacctgttcttcaagaccagaagctgcagcatgctgtgcaaggccctgagcacctgcgccagccacttcatggtggtgatcctgttctacgcccccgtgctgttcacctacatccaccccgccctggagagcttcatggaccaggacagaatcgtggccatcatgtacaccgtggtgacccccgtgctgaaccccctgatctacaccctgagaaacaaggaggtgaagggcgccctgggcagagtgatcagaagactgtag

SEQ ID NO: 20275 - DNA, 924 bp, Artificial Sequence
  Description of Artificial Sequence: Synthetic coding sequence
atgctgaacaccaccagcgtgaccgagttcctgctgctgggcgtgaccgacatccaggagctgcagcccttcctgttcgtggtgttcctgaccatctacttcatcagcgtgaccggcaacggcgccgtgctgatgatcttcatcagcgaccccagactgcacagccccatgtacttcttcctgggcaacctgagctacctggacatctgctacagcaccgtgaccctgcccaagatgctgcagaacttcctgagcacccacaaggccatcagcttcctgggctgcatcagccagctgcacttcttccacttcctgggcagcaccgagagcatgctgctggccgtgatggccttcgacagatgcgtggccatctgcaagcccctgagatacaccgtgatcatgaacccccagctgtgcacccagatggccatcaccatctgggtgatcggcttcttccacgccctgctgcacagcatcatgaccagcagactgaacttctgcggcagcaacagaatccaccacttcctgtgcgacatcaagcccctgctgaagctggcctgcggcaacaccgagctgaaccagtggctgctgagcaccgtgaccggcaccatcgccatgggccccttcttcctgaccctgctgagctacttctacatcatcacctacctgttcttcaagaccagaagctgcagcatgctgtgcaaggccctgagcacctgcgccagccacttcatggtggtgatcctgttctacgcccccgtgctgttcacctacatccaccccgccctggagagcttcatggaccaggacagaatcgtggccatcatgtacaccgtggtgacccccgtgctgaaccccctgatctacaccctgagaaacaaggaggtgaagggcgccctgggcagagtgatcagaagactgtag

SEQ ID NO: 20276 - DNA, 951 bp, Artificial Sequence
  Description of Artificial Sequence: Synthetic coding sequence
atggagaacgtgaccaccatgaacgagttcctgctgctgggcctgaccggcgtgcaggagctgcagcccttcttcttcggcatcttcctgatcatctacctgatcaacctgatcggcaacggcagcatcctggtgatggtggtgctggagccccagctgcacagccccatgtacttcttcctgggcaacctgagctgcctggacatcagctacagcagcgtgaccctgcccaagctgctggtgaacctggtgtgcagcagaagagccatcagcttcctgggctgcatcacccagctgcacttcttccacttcctgggcagcaccgaggccatcctgctggccatcatggccttcgacagattcgtggccatctgcaaccccctgagatacaccgtgatcatgaacccccaggtgtgcatcctgctggccgccgccgcctggctgatcagcttcttctacgccctgatgcacagcgtgatgaccgcccacctgagcttctgcggcagccagaagctgaaccacttcttctacgacgtgaagcccctgctggagctggcctgcagcgacaccctgctgaaccagtggctgctgagcatcgtgaccggcagcatcagcatgggcgccttcttcctgaccctgctgagctgcttctacgtgatcggcttcctgctgttcaagaacagaagctgcagaatcctgcacaaggccctgagcacctgcgccagccacttcatggtggtgtgcctgttctacggccccgtgggcttcacctacatcagacccgccagcgccaccagcatgatccaggacagaatcatggccatcatgtacagcgccgtgacccccgtgctgaaccccctgatctacaccctgagaaacaaggaggtgatgatggccctgaagaagatcttcggcagaaagctgttcaaggactggcagcagcaccactag

SEQ ID NO: 20277 - DNA, 951 bp, Artificial Sequence; identical to SEQ ID NO: 20276
  Description of Artificial Sequence: Synthetic coding sequence

SEQ ID NO: 20278 - DNA, 951 bp, Artificial Sequence; identical to SEQ ID NO: 20276
  Description of Artificial Sequence: Synthetic coding sequence

SEQ ID NO: 20279 - DNA, 951 bp, Artificial Sequence; identical to SEQ ID NO: 20276
  Description of Artificial Sequence: Synthetic coding sequence

SEQ ID NO: 20280 - DNA, 951 bp, Artificial Sequence; identical to SEQ ID NO: 20276
  Description of Artificial Sequence: Synthetic coding sequence

SEQ ID NO: 20281 - DNA, 951 bp, Artificial Sequence; identical to SEQ ID NO: 20276
  Description of Artificial Sequence: Synthetic coding sequence

SEQ ID NO: 20282 - DNA, 951 bp, Artificial Sequence; identical to SEQ ID NO: 20276
  Description of Artificial Sequence: Synthetic coding sequence

SEQ ID NO: 20283 - DNA, 951 bp, Artificial Sequence; identical to SEQ ID NO: 20276
  Description of Artificial Sequence: Synthetic coding sequence

SEQ ID NO: 20284 - DNA, 987 bp, Artificial Sequence
  Description of Artificial Sequence: Synthetic coding sequence
atgaagctgtggatggagagccacctgatcgtgcccgagaccagacccagccccagaatgatgagcaaccagaccctggtgaccgagttcatcctgcagggcttcagcgagcaccccgagtacagagtgttcctgttcagctgcttcctgttcctgtacagcggcgccctgaccggcaacgtgctgatcaccctggccatcaccttcaaccccggcctgcacgcccccatgtacttcttcctgctgaacctggccaccatggacatcatctgcaccagcagcatcatgcccaaggccctggccagcctggtgagcgaggagagcagcatcagctacggcggctgcatggcccagctgtacttcctgacctgggccgccagcagcgagctgctgctgctgaccgtgatggcctacgacagatacgccgccatctgccaccccctgcactacagcagcatgatgagcaaggtgttctgcagcggcctggccaccgccgtgtggctgctgtgcgccgtgaacaccgccatccacaccggcctgatgctgagactggacttctgcggccccaacgtgatcatccacttcttctgcgaggtgccccccctgctgctgctgagctgcagcagcacctacgtgaacggcgtgatgatcgtgctggccgacgccttctacggcatcgtgaacttcctgatgaccatcgccagctacggcttcatcgtgagcagcatcctgaaggtgaagaccgcctggggcagacagaaggccttcagcacctgcagcagccacctgaccgtggtgtgcatgtactacaccgccgtgttctacgcctacatcagccccgtgagcggctacagcgccggcaagagcaagctggccggcctgctgtacaccgtgctgagccccaccctgaaccccctgatctacaccctgagaaacaaggaggtgaaggccgccctgagaaagctgttccccttcttcagaaactag

SEQ ID NO: 20285 - DNA, 987 bp, Artificial Sequence; identical to SEQ ID NO: 20284
  Description of Artificial Sequence: Synthetic coding sequence

SEQ ID NO: 20286 - DNA, 987 bp, Artificial Sequence; identical to SEQ ID NO: 20284
  Description of Artificial Sequence: Synthetic coding sequence

SEQ ID NO: 20287 - DNA, 957 bp, Artificial Sequence
  Description of Artificial Sequence: Synthetic coding sequence
atggagtgggagaaccacaccatcctggtggagttcttcctgaagggcctgagcggccaccccagactggagctgctgttcttcgtgctgatcttcatcatgtacgtggtgatcctgctgggcaacggcaccctgatcctgatcagcatcctggacccccacctgcacacccccatgtacttcttcctgggcaacctgagcttcctggacatctgctacaccaccaccagcatccccagcaccctggtgagcttcctgagcgagagaaagaccatcagcctgagcggctgcgccgtgcagatgttcctgggcctggccatgggcaccaccgagtgcgtgctgctgggcatgatggccttcgacagatacgtggccatctgcaaccccctgagataccccatcatcatgagcaaggacgcctacgtgcccatggccgccggcagctggatcatcggcgccgtgaacagcgccgtgcagagcgtgttcgtggtgcagctgcccttctgcagaaacaacatcatcaaccacttcacctgcgagatcctggccgtgatgaagctggcctgcgccgacatcagcgacaacgagttcatcatgctggtggccaccaccctgttcatcctgacccccctgctgctgatcatcgtgagctacaccctgatcatcgtgagcatcttcaagatcagcagcagcgagggcagaagcaaggccagcagcacctgcagcgcccacctgaccgtggtgatcatcttctacggcaccatcctgttcatgtacatgaagcccaagagcaaggagaccctgaacagcgacgacctggacgccaccgacaagatcatcagcatgttctacggcgtgatgacccccatgatgaaccccctgatctacagcctgagaaacaaggacgtgaaggaggccgtgaagcacctgctgaacagaagattcttcagcaagtag

SEQ ID NO: 20288 - DNA, 1044 bp, Artificial Sequence
  Description of Artificial Sequence: Synthetic coding sequence
atgatcgtgcagctgatctgcaccgtgtgcttcctggccgtgaacaccttccacgtgagaagcagcttcgacttcctgaaggccgacgacatgggcgagatcaaccagaccctggtgagcgagttcctgctgctgggcctgagcggctaccccaagatcgagatcgtgtacttcgccctgatcctggtgatgtacctggtgatcctgatcggcaacggcgtgctgatcatcgccagcatcttcgacagccacttccacacccccatgtacttcttcctgggcaacctgagcttcctggacatctgctacaccagcagcagcgtgcccagcaccctggtgagcctgatcagcaagaagagaaacatcagcttcagcggctgcgccgtgcagatgttcttcggcttcgccatgggcagcaccgagtgcctgctgctgggcatgatggccttcgacagatacgtggccatctgcaaccccctgagataccccatcatcctgagcaaggtggcctacgtgctgatggccagcgtgagctggctgagcggcggcatcaacagcgccgtgcagaccctgctggccatgagactgcccttctgcggcaacaacatcatcaaccacttcgcctgcgagatcctggccgtgctgaagctggcctgcgccgacatcagcctgaacatcatcaccatggtgatcagcaacatggccttcctggtgctgcccctgatggtgatcttcttcagctacatgttcatcctgtacaccatcctgcagatgaacagcgccaccggcagaagaaaggccttcagcacctgcagcgcccacctgaccgtggtgatcatcttctacggcaccatcttcttcatgtacgccaagcccaagagccaggacctgatcggcgaggagaagctgcaggccctggacaagctgatcagcctgttctacggcgtggtgacccccatgctgaaccccatcctgtacagcctgagaaacaaggacgtgaaggccgccgtgaagtacctgctgaacaagaagcccatccactag

SEQ ID NO: 20289 - DNA, 957 bp, Artificial Sequence
  Description of Artificial Sequence: Synthetic coding sequence
atggacaagatcaaccagaccttcgtgagagagttcatcctgctgggcctgagcggctaccccaagctggagatcatcttcttcgccctgatcctggtgatgtacgtggtgatcctgatcggcaacggcgtgctgatcatcgccagcatcctggacagcagactgcacatgcccatgtacttcttcctgggcaacctgagcttcctggacatctgctacaccaccagcagcatccccagcaccctggtgagcctgatcagcaagaagagaaacatcagcttcagcggctgcgccgtgcagatgttcttcggcttcgccatgggcagcaccgagtgcttcctgctgggcatgatggccttcgacagatacgtggccatctgcaaccccctgagataccccatcatcatgaacaaggtggtgtacgtgctgctgaccagcgtgagctggctgagcggcggcatcaacagcaccgtgcagaccagcctggccatgagatggcccttctgcggcaacaacatcatcaaccacttcctgtgcgagatcctggccgtgctgaagctggcctgcagcgacatcagcgtgaacatcgtgaccctggccgtgagcaacatcgccttcctggtgctgcccctgctggtgatcttcttcagctacatgttcatcctgtacaccatcctgagaaccaacagcgccaccggcagacacaaggccttcagcacctgcagcgcccacctgaccgtggtgatcatcttctacggcaccatcttcttcatgtacgccaagcccaagagccaggacctgctgggcaaggacaacctgcaggccaccgagggcctggtgagcatgttctacggcgtggtgacccccatgctgaaccccatcatctacagcctgagaaacaaggacgtgaaggccgccatcaagtacctgctgagcagaaaggccatcaaccagtag

SEQ ID NO: 20290 - DNA, 1041 bp, Artificial Sequence
  Description of Artificial Sequence: Synthetic coding sequence
atgttcatccaggtgatcttctacatctgctgcctggccgtgaagatcctgtacatcggcagcagcttcggcatcctgaaggccgacatggacaagatcaaccagaccttcgtgagagagttcatcctgctgggcctgagcggctaccccaagctggagatcatcttcttcgccctgatcctggtgatgtacgtggtgatcctgatcggcaacggcgtgctgatcatcgccagcatcctggacagcagactgcacatgcccatgtacttcttcctgggcaacctgagcttcctggacatctgctacaccaccagcagcatccccagcaccctggtgagcctgatcagcaagaagagaaacatcagcttcagcggctgcgccgtgcagatgttcttcggcttcgccatgggcagcaccgagtgcttcctgctgggcatgatggccttcgacagatacgtggccatctgcaaccccctgagataccccatcatcatgaacaaggtggtgtacgtgctgctgaccagcgtgagctggctgagcggcggcatcaacagcaccgtgcagaccagcctggccatgagatggcccttctgcggcaacaacatcatcaaccacttcctgtgcgagatcctggccgtgctgaagctggcctgcagcgacatcagcgtgaacatcgtgaccctggccgtgagcaacatcgccttcctggtgctgcccctgctggtgatcttcttcagctacatgttcatcctgtacaccatcctgagaaccaacagcgccaccggcagacacaaggccttcagcacctgcagcgcccacctgaccgtggtgatcatcttctacggcaccatcttcttcatgtacgccaagcccaagagccaggacctgctgggcaaggacaacctgcaggccaccgagggcctggtgagcatgttctacggcgtggtgacccccatgctgaaccccatcatctacagcctgagaaacaaggacgtgaaggccgccatcaagtacctgctgagcagaaaggccatcaactag

SEQ ID NO: 20291 - DNA, 957 bp, Artificial Sequence
  Description of Artificial Sequence: Synthetic coding sequence
atggagtgggagaaccacaccatcctggtggagttcttcctgaagggcctgagcggccaccccagactggagctgctgttcttcgtgctgatcttcatcatgtacgtggtgatcctgctgggcaacggcaccctgatcctgatcagcatcctggacccccacctgcacacccccatgtacttcttcctgggcaacctgagcttcctggacatctgctacaccaccaccagcatccccagcaccctggtgagcttcctgagcgagagaaagaccatcagcctgagcggctgcgccgtgcagatgttcctgagcctggccatgggcaccaccgagtgcgtgctgctgggcgtgatggccttcgacagatacgtggccatctgcaaccccctgagataccccatcatcatgagcaaggacgcctacgtgcccatggccgccggcagctggatcatcggcgccgtgaacagcgccgtgcagaccgtgttcgtggtgcagctgcccttctgcagaaacaacatcatcaaccacttcacctgcgagatcctggccgtgatgaagctggcctgcgccgacatcagcggcaacgagttcatcctgctggtgaccaccaccctgttcctgctgacccccctgctgctgatcatcgtgagctacaccctgatcatcctgagcatcttcaagatcagcagcagcgagggcagaagcaagcccagcagcacctgcagcgccagactgaccgtggtgatcaccttctgcggcaccatcttcctgatgtacatgaagcccaagagccaggagaccctgaacagcgacgacctggacgccaccgacaagctgatcttcatcttctacagagtgatgacccccatgatgaaccccctgatctacagcctgagaaacaaggacgtgaaggaggccgtgaagcacctgctgagaagaaagaacttcaacaagtag

SEQ ID NO: 20292 - DNA, 963 bp, Artificial Sequence
  Description of Artificial Sequence: Synthetic coding sequence
atggagagaaccaacgacagcaccagcaccgagttcttcctggtgggcctgagcgcccaccccaagctgcagaccgtgttcttcgtgctgatcctgtggatgtacctgatgatcctgctgggcaacggcgtgctgatcagcgtgatcatcttcgacagccacctgcacacccccatgtacttcttcctgtgcaacctgagcttcctggacgtgtgctacaccagcagcagcgtgcccctgatcctggccagcttcctggccgtgaagaagaaggtgagcttcagcggctgcatggtgcagatgttcatcagcttcgccatgggcgccaccgagtgcatgatcctgggcaccatggccctggacagatacgtggccatctgctaccccctgagataccccgtgatcatgagcaagggcgcctacgtggccatggccgccggcagctgggtgaccggcctggtggacagcgtggtgcagaccgccttcgccatgcagctgcccttctgcgccaacaacgtgatcaagcacttcgtgtgcgagatcctggccatcctgaagctggcctgcgccgacatcagcatcaacgtgatcagcatgaccggcagcaacctgatcgtgctggtgatccccctgctggtgatcagcatcagctacatcttcatcgtggccaccatcctgagaatccccagcaccgagggcaagcacaaggccttcagcacctgcagcgcccacctgaccgtggtgatcatcttctacggcaccatcttcttcatgtacgccaagcccgagagcaaggccagcgtggacagcggcaacgaggacatcatcgaggccctgatcagcctgttctacggcgtgatgacccccatgctgaaccccctgatctacagcctgagaaacaaggacgtgaaggccgccgtgaagaacatcctgtgcagaaagaacttcagcgacggcaagtag

SEQ ID NO: 20293 - DNA, 957 bp, Artificial Sequence
  Description of Artificial Sequence: Synthetic coding sequence
atggagtgggagaaccagaccatcctggtggagttcttcctgaagggccacagcgtgcaccccagactggagctgctgttcttcgtgctgatcttcatcatgtacgtggtgatcctgctgggcaacggcaccctgatcctgatcagcatcctggacccccacctgcacacccccatgtacttcttcctgggcaacctgagcttcctggacatctgctacaccaccaccagcatccccagcaccctggtgagcttcctgagcgagagaaagaccatcagcttcagcggctgcgccgtgcagatgttcctgggcctggccatgggcaccaccgagtgcgtgctgctgggcatgatggccttcgacagatacgtggccatctgcaaccccctgagataccccatcatcatgagcaagaacgcctacgtgcccatggccgtgggcagctggttcgccggcatcgtgaacagcgccgtgcagaccaccttcgtggtgcagctgcccttctgcagaaagaacgtgatcaaccacttcagctgcgagatcctggccgtgatgaagctggcctgcgccgacatcagcggcaacgagttcctgatgctggtggccaccatcctgttcaccctgatgcccctgctgctgatcgtgatcagctacagcctgatcatcagcagcatcctgaagatccacagcagcgagggcagaagcaaggccttcagcacctgcagcgcccacctgaccgtggtgatcatcttctacggcaccatcctgttcatgtacatgaagcccaagagcaaggagaccctgaacagcgacgacctggacgccaccgacaagatcatcagcatgttctacggcgtgatgacccccatgatgaaccccctgatctacagcctgagaaacaaggacgtgaaggaggccgtgaagcacctgcccaacagaagattcttcagcaagtag

SEQ ID NO: 20294 - DNA, 1041 bp, Artificial Sequence
  Description of Artificial Sequence: Synthetic coding sequence
atgtacagattcaccgacttcgacgtgagcaacatcagcatctacctgaaccacgtgctgttctacaccacccagcaggccggcgacctggagcacatggagaccagaaactacagcgccatgaccgagttcttcctggtgggcctgagccagtaccccgagctgcagctgttcctgttcctgctgtgcctgatcatgtacatgatcatcctgctgggcaacagcctgctgatcatcatcaccatcctggacagcagactgcacacccccatgtacttcttcctgggcaacctgagcttcctggacatctgctacaccagcagcagcatcccccccatgctgatcatcttcatgagcgagagaaagagcatcagcttcatcggctgcgccctgcagatggtggtgagcctgggcctgggcagcaccgagtgcgtgctgctggccgtgatggcctacgaccactacgtggccatctgcaaccccctgagatacagcatcatcatgaacggcgtgctgtacgtgcagatggccgcctggagctggatcatcggctgcctgaccagcctgctgcagaccgtgctgaccatgatgctgcccttctgcggcaacaacgtgatcgaccacatcacctgcgagatcctggccctgctgaagctggtgtgcagcgacatcaccatcaacgtgctgatcatgaccgtgaccaacatcgtgagcctggtgatcctgctgctgctgatcttcatcagctacgtgttcatcctgagcagcatcctgagaatcaactgcgccgagggcagaaagaaggccttcagcacctgcagcgcccacagcatcgtggtgatcctgttctacggcagcgccctgttcatgtacatgaagcccaagagcaagaacaccaacaccagcgacgagatcatcggcctgagctacggcgtggtgagccccatgctgaaccccatcatctacagcctgagaaacaaggaggtgaaggaggccgtgaagaaggtgctgagcagacacctgcacctgctgaagatgtag

SEQ ID NO: 20295 - DNA, 960 bp, Artificial Sequence
  Description of Artificial Sequence: Synthetic coding sequence
atgttccccgccaactggaccagcgtgaaggtgttcttcttcctgggcttcttccactaccccaaggtgcaggtgatcatcttcgccgtgtgcctgctgatgtacctgatcaccctgctgggcaacatcttcctgatcagcatcaccatcctggacagccacctgcacacccccatgtacctgttcctgagcaacctgagcttcctggacatctggtacagcagcagcgccctgagccccatgctggccaacttcgtgagcggcagaaacaccatcagcttcagcggctgcgccacccagatgtacctgagcctggccatgggcagcaccgagtgcgtgctgctgcccatgatggcctacgacagatacgtggccatctgcaaccccctgagataccccgtgatcatgaacagaagaacctgcgtgcagatcgccgccggcagctggatgaccggctgcctgaccgccatggtggagatgatgagcgtgctgcccctgagcctgtgcggcaacagcatcatcaaccacttcacctgcgagatcctggccatcctgaagctggtgtgcgtggacaccagcctggtgcagctgatcatgctggtgatcagcgtgctgctgctgcccatgcccatgctgctgatctgcatcagctacgccttcatcctggccagcatcctgagaatcagcagcgtggagggcagaagcaaggccttcagcacctgcaccgcccacctgatggtggtggtgctgttctacggcaccgccctgagcatgcacctgaagcccagcgccgtggacagccaggagatcgacaagttcatggccctggtgtacgccggccagacccccatgctgaaccccatcatctacagcctgagaaacaaggaggtgaaggtggccctgaagaagctgctgatcagaaaccacttcaacaccgccttcatcagcatcctgaagtag

SEQ ID NO: 20296 - DNA, 927 bp, Artificial Sequence
  Description of Artificial Sequence: Synthetic coding sequence
atggccatggacaacgtgaccgccgtgttccagttcctgctgatcggcatcagcaactacccccagtggagagacaccttcttcaccctggtgctgatcatctacctgagcaccctgctgggcaacggcttcatgatcttcctgatccacttcgaccccaacctgcacacccccatctacttcttcctgagcaacctgagcttcctggacctgtgctacggcaccgccagcatgccccaggccctggtgcactgcttcagcacccacccctacctgagctaccccagatgcctggcccagaccagcgtgagcctggccctggccaccgccgagtgcctgctgctggccgccatggcctacgacagagtggtggccatcagcaaccccctgagatacagcgtggtgatgaacggccccgtgtgcgtgtgcctggtggccaccagctggggcaccagcctggtgctgaccgccatgctgatcctgagcctgagactgcacttctgcggcgccaacgtgatcaaccacttcgcctgcgagatcctgagcctgatcaagctgacctgcagcgacaccagcctgaacgagttcatgatcctgatcaccagcatcttcaccctgctgctgcccttcggcttcgtgctgctgagctacatcagaatcgccatggccatcatcagaatcagaagcctgcagggcagactgaaggccttcaccacctgcggcagccacctgaccgtggtgaccatcttctacggcagcgccatcagcatgtacatgaagacccagagcaagagctaccccgaccaggacaagttcatcagcgtgttctacggcgccctgacccccatgctgaaccccctgatctacagcctgagaaagaaggacgtgaagagagccatcagaaaggtgatgctgaagagaacctag

SEQ ID NO: 20297 - DNA, 939 bp, Artificial Sequence
  Description of Artificial Sequence: Synthetic coding sequence
atggagcccctgaacagaaccgaggtgagcgagttcttcctgaagggcttcagcggctaccccgccctggagcacctgctgttccccctgtgcagcgccatgtacctggtgaccctgctgggcaacaccgccatcatggccgtgagcgtgctggacatccacctgcacacccccgtgtacttcttcctgggcaacctgagcaccctggacatctgctacacccccaccttcgtgcccctgatgctggtgcacctgctgagcagcagaaagaccatcagcttcgccgtgtgcgccatccagatgtgcctgagcctgagcaccggcagcaccgagtgcctgctgctggccatcaccgcctacgacagatacctggccatctgccagcccctgagataccacgtgctgatgagccacagactgtgcgtgctgctgatgggcgccgcctgggtgctgtgcctgctgaagagcgtgaccgagatggtgatcagcatgagactgcccttctgcggccaccacgtggtgagccacttcacctgcaagatcctggccgtgctgaagctggcctgcggcaacaccagcgtgagcgaggacttcctgctggccggcagcatcctgctgctgcccgtgcccctggccttcatctgcctgagctacctgctgatcctggccaccatcctgagagtgcccagcgccgccagatgctgcaaggccttcagcacctgcctggcccacctggccgtggtgctgctgttctacggcaccatcatcttcatgtacctgaagcccaagagcaaggaggcccacatcagcgacgaggtgttcaccgtgctgtacgccatggtgaccaccatgctgaaccccaccatctacagcctgagaaacaaggaggtgaaggaggccgccagaaaggtgtggggcagaagcagagccagcagatag

SEQ ID NO: 20298 - DNA, 930 bp, Artificial Sequence
  Description of Artificial Sequence: Synthetic coding sequence
atggccaacctgaccatcgtgaccgagttcatcctgatgggcttcagcaccaacaagaacatgtgcatcctgcacagcatcctgttcctgctgatctacctgtgcgccctgatgggcaacgtgctgatcatcatgatcaccaccctggaccaccacctgcacacccccgtgtacttcttcctgaagaacctgagcttcctggacctgtgcctgatcagcgtgaccgcccccaagagcatcgccaacagcctgatccacaacaacagcatcagcttcctgggctgcgtgagccaggtgttcctgctgctgagcagcgccagcgccgagctgctgctgctgaccgtgatgagcttcgacagatacaccgccatctgccaccccctgcactacgacgtgatcatggacagaagcacctgcgtgcagagagccaccgtgagctggctgtacggcggcctgatcgccgtgatgcacaccgccggcaccttcagcctgagctactgcggcagcaacatggtgcaccagttcttctgcgacatcccccagctgctggccatcagctgcagcgagaacctgatcagagagatcgccctgatcctgatcaacgtggtgctggacttctgctgcttcatcgtgatcatcatcacctacgtgcacgtgttcagcaccgtgaagaagatccccagcaccgagggccagagcaaggcctacagcatctgcctgccccacctgctggtggtgctgttcctgagcaccggcttcatcgcctacctgaagcccgccagcgagagccccagcatcctggacgccgtgatcagcgtgttctacaccatgctgccccccaccttcaaccccatcatctacagcctgagaaacaaggccatcaaggtggccctgggcatgctgatcaagggcaagctgaccaagaagtag

SEQ ID NO: 20299 - DNA, 945 bp, Artificial Sequence
  Description of Artificial Sequence: Synthetic coding sequence
atggccaacgtgaccctggtgaccggcttcctgctgatgggcttcagcaacatccagaagctgagaatcctgtacggcgtgctgttcctgctgatctacctggccgccctgatgagcaacctgctgatcatcaccctgatcaccctggacgtgaagctgcagacccccatgtacttcttcctgaagaacctgagcttcctggacgtgttcctggtgagcgtgcccatccccaagttcatcgtgaacaacctgacccacaacaacagcatcagcatcctgggctgcgccttccagctgctgctgatgaccagcttcagcgccggcgagatcttcatcctgaccgccatgagctacgacagatacgtggccatctgctgccccctgaactacgaggtgatcatgaacaccggcgtgtgcgtgctgatggccagcgtgagctgggccatcggcggcctgttcggcaccgcctacaccgccggcaccttcagcatgcccttctgcggcagcagcgtgatcccccagttcttctgcgacgtgcccagcctgctgagaatcagctgcagcgagaccctgatggtgatctacgccggcatcggcgtgggcgcctgcctgagcatcagctgcttcatctgcatcgtgatcagctacatctacatcttcagcaccgtgctgaagatccccaccaccaagggccagagcaaggccttcagcacctgcttcccccacctgaccgtgttcaccgtgttcatcatcaccgcctacttcgtgtacctgaagccccccagcaacagccccagcgtgatcgacagactgctgagcgtgatctacaccgtgatgccccccgtgttcaaccccgtgacctacagcctgagaaacaacgacatgaagtgcgccctgatcagactgctgcagaagacctacggccaggaggcctacttcatctag

SEQ ID NO: 20300 - DNA, 939 bp, Artificial Sequence
  Description of Artificial Sequence: Synthetic coding sequence
atgcccaacagcaccaccgtgatggagttcctgctgatgagattcagcgacgtgtggaccctgcagatcctgcacagcgccagcttcttcatgctgtacctggtgaccctgatgggcaacatcctgatcgtgaccgtgaccacctgcgacagcagcctgcacatgcccatgtacttcttcctgagaaacctgagcatcctggacgcctgctacatcagcgtgaccgtgcccaccagctgcgtgaacagcctgctggacagcaccaccatcagcaaggccggctgcgtggcccaggtgttcctggtggtgttcttcgtgtacgtggagctgctgttcctgaccatcatggcccacgacagatacgtggccgtgtgccagcccctgcactaccccgtgatcgtgaacagcagaatctgcatccagatgaccctggccagcctgctgagcggcctggtgtacgccggcatgcacaccggcagcaccttccagctgcccttctgcagaagcaacgtgatccaccagttcttctgcgacatccccagcctgctgaagctgagctgcagcgacaccttcagcaacgaggtgatgatcgtggtgagcgccctgggcgtgggcggcggctgcttcatcttcatcatcagaagctacatccacatcttcagcaccgtgctgggcttccccagaggcgccgacagaaccaaggccttcagcacctgcatcccccacatcctggtggtgagcgtgttcctgagcagctgcagcagcgtgtacctgagaccccccgccatccccgccgccacccaggacctgatcctgagcggcttctacagcatcatgccccccctgttcaaccccatcatctacagcctgagaaacaagcagatcaaggtggccatcaagaagatcatgaagagaatcttctacagcgagaacgtgtag

SEQ ID NO: 20301 - DNA, 3666 bp, Artificial Sequence
  Description of Artificial Sequence: Synthetic coding sequence
atgatgttcagaagcgacagaatgtggagctgccactggaagtggaagcccagccccctgctgttcctgttcgccctgtacatcatgtgcgtgccccacagcgtgtggggctgcgccaactgcagagtggtgctgagcaaccccagcggcaccttcaccagcccctgctaccccaacgactaccccaacagccaggcctgcatgtggaccctgagagcccccaccggctacatcatccagatcaccttcaacgacttcgacatcgaggaggcccccaactgcatctacgacagcctgagcctggacaacggcgagagccagaccaagttctgcggcgccaccgccaagggcctgagcttcaacagcagcgccaacgagatgcacgtgagcttcagcagcgacttcagcatccagaagaagggcttcaacgccagctacatcagagtggccgtgagcctgagaaaccagaaggtgatcctgccccagaccagcgacgcctaccaggtgagcgtggccaagagcatcagcatccccgagctgagcgccttcaccctgtgcttcgaggccaccaaggtgggccacgaggacagcgactggaccgccttcagctacagcaacgccagcttcacccagctgctgagcttcggcaaggccaagagcggctacttcctgagcatcagcgacagcaagtgcctgctgaacaacgccctgcccgtgaaggagaaggaggacatcttcgccgagagcttcgagcagctgtgcctggtgtggaacaacagcctgggcagcatcggcgtgaacttcaagagaaactacgagaccgtgccctgcgacagcaccatcagcaaggtgatccccggcaacggcaagctgctgctgggcagcaaccagaacgagatcgtgagcctgaagggcgacatctacaacttcagactgtggaacttcaccatgaacgccaagatcctgagcaacctgagctgcaacgtgaagggcaacgtggtggactggcagaacgacttctggaacatccccaacctggccctgaaggccgagagcaacctgagctgcggcagctacctgatccccctgcccgccgccgagctggccagctgcgccgacctgggcaccctgtgccaggccaccgtgaacagccccagcaccaccccccccaccgtgaccaccaacatgcccgtgaccaacagaatcgacaagcagagaaacgacggcatcatctacagaatcagcgtggtgatccagaacatcctgagacaccccgaggtgaaggtgcagagcaaggtggccgagtggctgaacagcaccttccagaactggaactacaccgtgtacgtggtgaacatcagcttccacctgagcgccggcgaggacaagatcaaggtgaagagaagcctggaggacgagcccagactggtgctgtgggccctgctggtgtacaacgccaccaacaacaccaacctggagggcaagatcatccagcagaagctgctgaagaacaacgagagcctggacgagggcctgagactgcacaccgtgaacgtgagacagctgggccactgcctggccatggaggagcccaagggctactactggcccagcatccagcccagcgagtacgtgctgccctgccccgacaagcccggcttcagcgccagcagaatctgcttctacaacgccaccaaccccctggtgacctactggggccccgtggacatcagcaactgcctgaaggaggccaacgaggtggccaaccagatcctgaacctgaccgccgacggccagaacctgaccagcgccaacatcaccaacatcgtggagcaggtgaagagaatcgtgaacaaggaggagaacatcgacatcaccctgggcagcaccctgatgaacatcttcagcaacatcctgagcagcagcgacagcgacctgctggagagcagcagcgaggccctgaagaccatcgacgagctggccttcaagatcgacctgaacagcaccagccacgtgaacatcaccaccagaaacctggccctgagcgtgagcagcctgctgcccggcaccaacgccatcagcaacttcagcatcggcctgcccagcaacaacgagagctacttccagatggacttcgagagcggccaggtggaccccctggccagcgtgatcctgccccccaacctgctggagaacctgagccccgaggacagcgtgctggtgagaagagcccagttcaccttcttcaacaagaccggcctgttccaggacgtgggcccccagagaaagaccctggtgagctacgtgatggcctgcagcatcggcaacatcaccatccagaacctgaaggaccccgtgcagatcaagatcaagcacaccagaacccaggaggtgcaccaccccatctgcgccttctgggacctgaacaagaacaagagcttcggcggctggaacaccagcggctgcgtggcccacagagacagcgacgccagcgagaccgtgtgcctgtgcaaccacttcacccacttcggcgtgctgatggacctgcccagaagcgccagccagctggacgccagaaacaccaaggtgctgaccttcatcagctacatcggctgcggcatcagcgccatcttcagcgccgccaccctgctgacctacgtggccttcgagaagctgagaagagactaccccagcaagatcctgatgaacctgagcaccgccctgctgttcctgaacctgctgttcctgctggacggctggatcaccagcttcaacgtggacggcctgtgcatcgccgtggccgtgctgctgcacttcttcctgctggccaccttcacctggatgggcctggaggccatccacatgtacatcgccctggtgaaggtgttcaacacctacatcagaagatacatcctgaagttctgcatcatcggctggggcctgcccgccctggtggtgagcgtggtgctggccagcagaaacaacaacgaggtgtacggcaaggagagctacggcaaggagaagggcgacgagttctgctggatccaggaccccgtgatcttctacgtgacctgcgccggctacttcggcgtgatgttcttcctgaacatcgccatgttcatcgtggtgatggtgcagatctgcggcagaaacggcaagagaagcaacagaaccctgagagaggaggtgctgagaaacctgagaagcgtggtgagcctgaccttcctgctgggcatgacctggggcttcgccttcttcgcctggggccccctgaacatccccttcatgtacctgttcagcatcttcaacagcctgcagggcctgttcatcttcatcttccactgcgccatgaaggagaacgtgcagaagcagtggagacagcacctgtgctgcggcagattcagactggccgacaacagcgactggagcaagaccgccaccaacatcatcaagaagagcagcgacaacctgggcaagagcctgagcagcagcagcatcggcagcaacagcacctacctgaccagcaagagcaagagcagcagcaccacctacttcaagagaaacagccacaccgacaacgtgagctacgagcacagcttcaacaagagcggcagcctgagacagtgcttccacggccaggtgctggtgaagaccggcccctgctag

SEQ ID NO: 20302 - DNA, 966 bp, Artificial Sequence
  Description of Artificial Sequence: Synthetic coding sequence
atggtgaacctgaccagcatgagcggcttcctgctgatgggcttcagcgacgagagaaagctgcagatcctgcacgccctggtgttcctggtgacctacctgctggccctgaccggcaacctgctgatcatcaccatcatcaccgtggacagaagactgcacagccccatgtactacttcctgaagcacctgagcctgctggacctgtgcttcatcagcgtgaccgtgccccagagcatcgccaacagcctgatgggcaacggctacatcagcctggtgcagtgcatcctgcaggtgttcttcttcatcgccctggccagcagcgaggtggccatcctgaccgtgatgagctacgacagatacgccgccatctgccagcccctgcactacgagaccatcatggaccccagagcctgcagacacgccgtgatcgccgtgtggatcgccggcggcctgagcggcctgatgcacgccgccatcaacttcagcatccccctgtgcggcaagagagtgatccaccagttcttctgcgacgtgccccagatgctgaagctggcctgcagctacgagttcatcaacgagatcgccctggccgccttcaccaccagcgccgccttcatctgcctgatcagcatcgtgctgagctacatcagaatcttcagcaccgtgctgagaatccccagcgccgagggcagaaccaaggtgttcagcacctgcctgccccacctgttcgtggccaccttcttcctgagcgccgccggcttcgagttcctgagactgcccagcgacagcagcagcaccgtggacctggtgttcagcgtgttctacaccgtgatcccccccaccctgaaccccgtgatctacagcctgagaaacgacagcatgaaggccgccctgagaaagatgctgagcaaggaggagctgccccagagaaagatgtgcctgaaggccatgttcaagctgtag

SEQ ID NO: 20303 - DNA, 966 bp, Artificial Sequence; identical to SEQ ID NO: 20302
  Description of Artificial Sequence: Synthetic coding sequence

SEQ ID NO: 20304 - DNA, 945 bp, Artificial Sequence
  Description of Artificial Sequence: Synthetic coding sequence
atgaccaaccagacccagatgatggagttcctgctggtgagattcaccgagaactgggtgctgctgagactgcacgccctgctgttcagcctgatctacctgaccgccgtgctgatgaacctggtgatcatcctgctgatgatcctggaccacagactgcacatggccatgtacttcttcctgagacacctgagcttcctggacctgtgcctgatcagcgccaccgtgcccaagagcatcctgaacagcgtggccagcaccgacagcatcagcttcctgggctgcgtgctgcagctgttcctggtggtgctgctggccggcagcgagatcggcatcctgaccgccatgagctacgacagatacgccgccatctgctgccccctgcactgcgaggccgtgatgagcagaggcctgtgcgtgcagctgatggccctgagctggctgaacagaggcgccctgggcctgctgtacaccgccggcaccttcagcctgaacttctacggcagcgacgagctgcaccagttcttctgcgacgtgcccgccctgctgaagctgacctgcagcaaggagcacgccatcatcagcgtgagcgtggccatcggcgtgtgctacgccttcagctgcctggtgtgcatcgtggtgagctacgtgtacatcttcagcgccgtgctgagaatcagccagagacagagacagagcaaggccttcagcaactgcgtgccccacctgatcgtggtgaccgtgttcctggtgaccggcgccgtggcctacctgaagcccggcagcgacgcccccagcatcctggacctgctggtgagcgtgttctacagcgtggccccccccaccctgaaccccgtgatctactgcctgaagaacaaggacatcaagagcgccctgagcaaggtgctgtggaacgtgagaagcagcggcgtgatgaagagatag

SEQ ID NO: 20305 - DNA, 933 bp, Artificial Sequence
  Description of Artificial Sequence: Synthetic coding sequence
atgggcgagaaccagaccatggtgaccgagttcctgctgctgggcttcctgctgggccccagaatccagatgctgctgttcggcctgttcagcctgttctacatcttcaccctgctgggcaacggcgccatcctgggcctgatcagcctggacagcagactgcacacccccatgtacttcttcctgagccacctggccgtggtggacatcgcctacaccagaaacaccgtgccccagatgctggccaacctgctgcaccccgccaagcccatcagcttcgccggctgcatgacccagaccttcctgtgcctgagcttcggccacagcgagtgcctgctgctggtgctgatgagctacgacagatacgtggccatctgccaccccctgagatacagcgtgatcatgacctggagagtgtgcatcaccctggccgtgaccagctggacctgcggcagcctgctggccctggcccacgtggtgctgatcctgagactgcccttcagcggcccccacgagatcaaccacttcttctgcgagatcctgagcgtgctgagactggcctgcgccgacacctggctgaaccaggtggtgatcttcgccgcctgcgtgttcttcctggtgggcccccccagcctggtgctggtgagctacagccacatcctggccgccatcctgagaatccagagcggcgagggcagaagaaaggccttcagcacctgcagcagccacctgtgcgtggtgggcctgttcttcggcagcgccatcatcatgtacatggcccccaagagcagacaccccgaggagcagcagaaggtgttcttcctgttctacagcttcttcaaccccaccctgaaccccctgatctacagcctgagaaacggcgaggtgaagggcgccctgagaagagccctgggcaaggagagccacagctag

SEQ ID NO: 20306 - DNA, 933 bp, Artificial Sequence
  Description of Artificial Sequence: Synthetic coding sequence
atggagagcaaccagacctggatcaccgaggtgatcctgctgggcttccaggtggaccccgccctggagctgttcctgttcggcttcttcctgctgttctacagcctgaccctgatgggcaacggcatcatcctgggcctgatctacctggacagcagactgcacacccccatgtacgtgttcctgagccacctggccatcgtggacatgagctacgccagcagcaccgtgcccaagatgctggccaacctggtgatgcacaagaaggtgatcagcttcgccccctgcatcctgcagaccttcctgtacctggccttcgccatcaccgagtgcctgatcctggtgatgatgtgctacgacagatacgtggccatctgccaccccctgcagtacaccctgatcatgaactggagagtgtgcaccgtgctggccagcacctgctggatcttcagcttcctgctggccctggtgcacatcaccctgatcctgagactgcccttctgcggcccccagaagatcaaccacttcttctgccagatcatgagcgtgttcaagctggcctgcgccgacaccagactgaaccaggtggtgctgttcgccggcagcgccttcatcctggtgggccccctgtgcctggtgctggtgagctacctgcacatcctggtggccatcctgagaatccagagcggcgagggcagaagaaaggccttcagcacctgcagcagccacctgtgcgtggtgggcctgttcttcggcagcgccatcgtgatgtacatggcccccaagagcagccacagccaggagagaagaaagatcctgagcctgttctacagcctgttcaaccccatcctgaaccccctgatctacagcctgagaaacgccgaggtgaagggcgccctgaagagagtgctgtggaagcagagaagcatgtag

SEQ ID NO: 20307 - DNA, 933 bp, Artificial Sequence
  Description of Artificial Sequence: Synthetic coding sequence
atggagggcaacaagacctggatcaccgacatcaccctgcccagattccaggtgggccccgccctggagatcctgctgtgcggcctgttcagcgccttctacaccctgaccctgctgggcaacggcgtgatcttcggcatcatctgcctggactgcaagctgcacacccccatgtacttcttcctgagccacctggccatcgtggacatcagctacgccagcaactacgtgcccaagatgctgaccaacctgatgaaccaggagagcaccatcagcttcttcccctgcatcatgcagaccttcctgtacctggccttcgcccacgtggagtgcctgatcctggtggtgatgagctacgacagatacgccgacatctgccaccccctgagatacaacagcctgatgagctggagagtgtgcaccgtgctggccgtggccagctgggtgttcagcttcctgctggccctggtgcccctggtgctgatcctgagcctgcccttctgcggcccccacgagatcaaccacttcttctgcgagatcctgagcgtgctgaagctggcctgcgccgacacctggctgaaccaggtggtgatcttcgccgcctgcgtgttcatcctggtgggccccctgtgcctggtgctggtgagctacctgagaatcctggccgccatcctgagaatccagagcggcgagggcagaagaaaggccttcagcacctgcagcagccacctgtgcgtggtgggcctgttcttcggcagcgccatcgtgacctacatggcccccaagagcagacaccccgaggagcagcagaaggtgctgagcctgttctacagcctgttcaaccccatgctgaaccccctgatctacagcctgagaaacgccgaggtgaagggcgccctgagaagagccctgagaaaggagagactgacctag

SEQ ID NO: 20308 - DNA, 957 bp, Artificial Sequence
  Description of Artificial Sequence: Synthetic coding sequence
atggagggcaaccagacctggatcaccgacatcaccctgctgggcttccaggtgggccccgccctggccatcctgctgtgcggcctgttcagcgtgttctacaccctgaccctgctgggcaacggcgtgatcttcggcatcatctgcctggacagcaagctgcacacccccatgtacttcttcctgagccacctggccatcatcgacatgagctacgccagcaacaacgtgcccaagatgctggccaacctgatgaaccagaagagaaccatcagcttcgtgccctgcatcatgcagaccttcctgtacctggccttcgccgtgaccgagtgcctgatcctggtggtgatgagctacgacagatacgtggccatctgccaccccttccagtacaccgtgatcatgagctggagagtgtgcaccatcctggtgctgaccagctggagctgcggcttcgccctgagcctggtgcacgagatcctgctgctgagactgcccttctgcggccccagagacgtgaaccacctgttctgcgagatcctgagcgtgctgaagctggcctgcgccgacacctgggtgaaccaggtggtgatcttcgccacctgcgtgttcgtgctggtgggccccctgagcctgatcctggtgagctacatgcacatcctgggcgccatcctgaagatccagaccaaggagggcagaatcaaggccttcagcacctgcagcagccacctgtgcgtggtgggcctgttcttcggcatcgccatggtggtgtacatggtgcccgacagcaaccagagagaggagcaggagaagatgctgagcctgttccacagcgtgttcaaccccatgctgaaccccctgatctacagcctgagaaacgcccagctgaagggcgccctgcacagagccctgcagagaaagagaagcatgagaaccgtgtacggcctgtgcctgtag

SEQ ID NO: 20309 - DNA, 933 bp, Artificial Sequence
  Description of Artificial Sequence: Synthetic coding sequence
atgggcggcaaccagaccagcatcaccgagttcctgctgctgggcttccccatcggccccagaatccagatgctgctgttcggcctgttcagcctgttctacatcttcatcctgctgggcaacggcaccatcctgggcctgatcagcctggacagcagactgcacacccccatgtacttcttcctgagccacctggccgtggtggacatcgcctgcgcctgcagcaccgtgccccagatgctggtgaacctgctgcaccccgccaagcccatcagcttcgccggctgcatgacccagatgttcctgttcctgagcttcgcccacaccgagtgcctgctgctggtggtgatgagctacgacagatacgtggccatctgccaccccctgagatacagcaccatcatgacctggaaggtgtgcatcaccctggccctgaccagctggatcctgggcgtgctgctggccctggtgcacctggtgctgctgctgcccctgagcttctgcggcccccagaagctgaaccacttcttctgcgagatcatggccgtgctgaagctggcctgcgccgacacccacatcaacgaggtgatggtgctggccggcgccgtgagcgtgctggtgggcgccttcttcagcaccgtgatcagctacgtgcacatcctgtgcgccatcctgaagatccagagcggcgagggctgccagaaggccttcagcatctgcagcagccacctgtgcgtggtgggcctgttctacggcaccgccatcatcatgtacgtggagccccagtacgagagccccaaggagcagaagaagtacctgctgctgttccacagcctgttcaaccccatgctgaaccccctgatctacagcctgagaaacaaggaggtgcagggcaccctgaagagaatgctggagaagaagagaaccagctag

SEQ ID NO: 20310 - DNA, 933 bp, Artificial Sequence
  Description of Artificial Sequence: Synthetic coding sequence
atgggcgacaacatcaccagcatcagagagttcctgctgctgggcttccccgtgggccccagaatccagatgctgctgttcggcctgttcagcctgttctacgtgttcaccctgctgggcaacggcaccatcctgggcctgatcagcctggacagcagactgcacgcccccatgtacttcttcctgagccacctggccgtggtggacatcgcctacgcctgcaacaccgtgcccagaatgctggtgaacctgctgcaccccgccaagcccatcagcttcgccggcagaatgatgcagaccttcctgttcagcaccttcgccgtgaccgagtgcctgctgctggtggtgatgagctacgacctgtacgtggccatctgccaccccctgagatacctggccatcatgacctggagagtgtgcatcaccctggccgtgaccagctggaccaccggcgtgctgctgagcctgatccacctggtgctgctgctgcccctgcccttctgcagaccccagaagatctaccacttcttctgcgagatcctggccgtgctgaagctggcctgcgccgacacccacatcaacgagaacatggtgctggccggcgccatcagcggcctggtgggccccctgagcaccatcgtggtgagctacatgtgcatcctgtgcgccatcctgcagatccagagcagagaggtgcagagaaaggccttcagaacctgcttcagccacctgtgcgtgatcggcctggtgtacggcaccgccatcatcatgtacgtgggccccagatacggcaaccccaaggagcagaagaagtacctgctgctgttccacagcctgttcaaccccatgctgaaccccctgatctgcagcctgagaaacagcgaggtgaagaacaccctgaagagagtgctgggcgtggagagagccctgtag

SEQ ID NO: 20311 - DNA, 933 bp, Artificial Sequence; identical to SEQ ID NO: 20305
  Description of Artificial Sequence: Synthetic coding sequence

SEQ ID NO: 20312 - DNA, 936 bp, Artificial Sequence
  Description of Artificial Sequence: Synthetic coding sequence
atgaccaagaaccagacctgggtgaccgagttcatcctgctgggcttccccctgagcctgagaatccagatgctgctgagcggcctgttcagcctgctgtacgtgttcaccctgctgggcaacggcgccatcctgggcctgatctggctggacagcagactgcacacccccatgtacttcttcctgagccacctggccatcatcgacatcagctacgccagcaacaacgtgcccaagatgctgaccaacctgggcctgaacaagagaaagaccatcagcttcgtgccctgcaccatgcagaccttcctgtacatggccttcgcccacaccgagtgcctgatcctggtgatgatgagctacgacagatacatggccatctgccaccccctgcagtacagcgtgatcatgagatggggcgtgtgcaccgtgctggccgtgaccagctgggcctgcggcagcctgctggccctggtgcacgtggtgctgatcctgagactgcccttctgcggcccccacgagatcaaccacttcttctgcgagatcctgagcgtgctgaagctggcctgcgccgacacctggctgaaccaggtggtgatcttcgccgccagcgtgttcatcctggtgggccccctgtgcctggtgctggtgagctacagcagaatcctggccgccatcctgagaatccagagcggcgagggcagaagaaaggccttcagcacctgcagcagccacctgtgcatggtgggcctgttcttcggcagcgccatcgtgatgtacatggcccccaagagcagacaccccgaggagcagcagaaggtgctgagcctgttctacagcctgttcaaccccatgctgaaccccctgatctacagcctgagaaacgccgaggtgaagggcgccctgaagagagtgctgtggaagcagagaagcaagtag

SEQ ID NO: 20313 - DNA, 933 bp, Artificial Sequence
  Description of Artificial Sequence: Synthetic coding sequence
atgggcgacaacatcaccagcatcaccgagttcctgctgctgggcttccccgtgggccccagaatccagatgctgctgttcggcctgttcagcctgttctacgtgttcaccctgctgggcaacggcaccatcctgggcctgatcagcctggacagcagactgcacgcccccatgtacttcttcctgagccacctggccgtggtggacatcgcctacgcctgcaacaccgtgcccagaatgctggtgaacctgctgcaccccgccaagcccatcagcttcgccggcagaatgatgcagaccttcctgttcagcaccttcgccgtgaccgagtgcctgctgctggtggtgatgagctacgacctgtacgtggccatctgccaccccctgagatacctggccatcatgacctggagagtgtgcatcaccctggccgtgaccagctggaccaccggcgtgctgctgagcctgatccacctggtgctgctgctgcccctgcccttctgcagaccccagaagatctaccacttcttctgcgagatcctggccgtgctgaagctggcctgcgccgacacccacatcaacgagaacatggtgctggccggcgccatcagcggcctggtgggccccctgagcaccatcgtggtgagctacatgtgcatcctgtgcgccatcctgcagatccagagcagagaggtgcagagaaaggccttctgcacctgcttcagccacctgtgcgtgatcggcctgttctacggcaccgccatcatcatgtacgtgggccccagatacggcaaccccaaggagcagaagaagtacctgctgctgttccacagcctgttcaaccccatgctgaaccccctgatctgcagcctgagaaacagcgaggtgaagaacaccctgaagagagtgctgggcgtggagagagccctgtag

SEQ ID NO: 20314 - DNA, 972 bp, Artificial Sequence
  Description of Artificial Sequence: Synthetic coding sequence
atgtggcagaagaaccagaccagcctggccgacttcatcctggagggcctgttcgacgacagcctgacccacctgttcctgttcagcctgaccatggtggtgttcctgatcgccgtgagcggcaacaccctgaccatcctgctgatctgcatcgacccccagctgcacacccccatgtacttcctgctgagccagctgagcctgatggacctgatgcacgtgagcaccatcatcctgaagatggccaccaactacctgagcggcaagaagagcatcagcttcgtgggctgcgccacccagcacttcctgtacctgtgcctgggcggcgccgagtgcttcctgctggccgtgatgagctacgacagatacgtggccatctgccaccccctgagatacgccgtgctgatgaacaagaaggtgggcctgatgatggccgtgatgagctggctgggcgccagcgtgaacagcctgatccacatggccatcctgatgcacttccccttctgcggccccagaaaggtgtaccacttctactgcgagttccccgccgtggtgaagctggtgtgcggcgacatcaccgtgtacgagaccaccgtgtacatcagcagcatcctgctgctgctgcccatcttcctgatcagcaccagctacgtgttcatcctgcagagcgtgatccagatgagaagcagcggcagcaagagaaacgccttcgccacctgcggcagccacctgaccgtggtgagcctgtggttcggcgcctgcatcttcagctacatgagacccagaagccagtgcaccctgctgcagaacaaggtgggcagcgtgttctacagcatcatcacccccaccctgaacagcctgatctacaccctgagaaacaaggacgtggccaaggccctgagaagagtgctgagaagagacgtgatcacccagtgcatccagagactgcagctgtggctgcccagagtgtag

SEQ ID NO: 20315 - DNA, 951 bp, Artificial Sequence
  Description of Artificial Sequence: Synthetic coding sequence
atggagctgtggaacttcaccctgggcagcggcttcatcctggtgggcatcctgaacgacagcggcagccccgagctgctgtgcgccaccatcaccatcctgtacctgctggccctgatcagcaacggcctgctgctgctggccatcaccatggaggccagactgcacatgcccatgtacctgctgctgggccagctgagcctgatggacctgctgttcaccagcgtggtgacccccaaggccctggccgacttcctgagaagagagaacaccatcagcttcggcggctgcgccctgcagatgttcctggccctgaccatgggcggcgccgaggacctgctgctggccttcatggcctacgacagatacgtggccatctgccaccccctgacctacatgaccctgatgagcagcagagcctgctggctgatggtggccaccagctggatcctggccagcctgagcgccctgatctacaccgtgtacaccatgcactaccccttctgcagagcccaggagatcagacacctgctgtgcgagatcccccacctgctgaaggtggcctgcgccgacaccagcagatacgagctgatggtgtacgtgatgggcgtgaccttcctgatccccagcctggccgccatcctggccagctacacccagatcctgctgaccgtgctgcacatgcccagcaacgagggcagaaagaaggccctggtgacctgcagcagccacctgaccgtggtgggcatgttctacggcgccgccaccttcatgtacgtgctgcccagcagcttccacagcaccagacaggacaacatcatcagcgtgttctacaccatcgtgacccccgccctgaaccccctgatctacagcctgagaaacaaggaggtgatgagagccctgagaagagtgctgggcaagtacatgctgcccgcccacagcaccctgtag

SEQ ID NO: 20316 - DNA, 987 bp, Artificial Sequence
  Description of Artificial Sequence: Synthetic coding sequence
atgggccaccagaaccacaccttcagcagcgacttcatcctgctgggcctgttcagcagcagccccaccagcgtggtgttcttcctggtgctgttcgtgatcttcatcatgagcgtgaccgagaacaccctgatgatcctgctgatcagaagcgacagcagactgcacacccccatgtacttcctgctgagccacctgagcctgatggacatcctgcacgtgagcaacatcgtgcccaagatggtgaccaacttcctgagcggcagcagaaccatcagcttcgccggctgcggcttccaggtgttcctgagcctgaccctgctgggcggcgagtgcctgctgctggccgccatgagctgcgacagatacgtggccatctgccaccccctgagataccccatcctgatgaaggagtacgccagcgccctgatggccggcggcagctggctgatcggcgtgttcaacagcaccgtgcacaccgcctacgccctgcagttccccttctgcggcagcagagccatcgaccacttcttctgcgaggtgcccgccatgctgaagctgagctgcgccgacaccaccagatacgagagaggcgtgtgcgtgagcgccgtgatcttcctgctgatccccttcagcctgatcagcgccagctacggccagatcatcctgaccgtgctgcagatgaagagcagcgaggccagaaagaagagcttcagcacctgcagcttccacatgatcgtggtgaccatgtactacggccccttcatcttcacctacatgagacccaagagctaccacacccccggccaggacaagttcctggccatcttctacaccatcctgacccccaccctgaaccccttcatctacagcttcagaaacaaggacgtgctggccgtgatgaagaacatgctgaagagcaacttcctgcacaagaagatgaacagaaagatccccgagtgcgtgttctgcctgttcctgtgctag

SEQ ID NO: 20317 - DNA, 1008 bp, Artificial Sequence
  Description of Artificial Sequence: Synthetic coding sequence
atgaacatcagcgacgtgatcagcttcgacatcctggtgagcgccatgaagaccggcaaccagagcttcggcaccgacttcctgctggtgggcctgttccagtacggctggatcaacagcctgctgttcgtggtgatcgccaccctgttcaccgtggccctgaccggcaacatcatgctgatccacctgatcagactgaacaccagactgcacacccccatgtacttcctgctgagccagctgagcatcgtggacctgatgtacatcagcaccaccgtgcccaagatggccgtgagcttcctgagccagagcaagaccatcagattcctgggctgcgagatccagacctacgtgttcctggccctgggcggcaccgaggccctgctgctgggcttcatgagctacgacagatacgtggccatctgccaccccctgcactaccccatgctgatgagcaagaagatctgctgcctgatggtggcctgcgcctgggccagcggcagcatcaacgccttcatccacaccctgtacgtgttccagctgcccttctgcagaagcagactgatcaaccacttcttctgcgaggtgcccgccctgctgagcctggtgtgccaggacaccagccagtacgagtacaccgtgctgctgagcggcctgatcatcctgctgctgcccttcctggccatcctggccagctacgccagagtgctgatcgtggtgttccagatgagcagcggcaagggccaggccaaggccgtgagcacctgcagcagccacctgatcgtggccagcctgttctacgccaccaccctgttcacctacaccagaccccacagcctgagaagccccagcagagacaaggccgtggccgtgttctacaccatcgtgacccccctgctgaaccccttcatctacagcctgagaaacaaggaggtgaccggcgccgtgagaagactgctgggctactggatctgctgcagaaagtacgacttcagaagcctgtactag

SEQ ID NO: 20318 - DNA, 930 bp, Artificial Sequence
  Description of Artificial Sequence: Synthetic coding sequence
atgaagaacaagaccgtgctgaccgagttcatcctgctgggcctgaccgacgtgcccgagctgcaggtggccgtgttcaccttcctgttcctggcctacctgctgagcatcctgggcaacctgaccatcctgatcctgaccctgctggacagccacctgcagacccccatgtacttcttcctgagaaacttcagcttcctggagatcagcttcaccaacatcttcatccccagagtgctgatcagcatcaccaccggcaacaagagcatcagcttcgccggctgcttcacccagtacttcttcgccatgttcctgggcgccaccgagttctacctgctggccgccatgagctacgacagatacgtggccatctgcaagcccctgcactacaccaccatcatgagcagcagaatctgcatccagctgatcttctgcagctggctgggcggcctgatggccatcatccccaccatcaccctgatgagccagcaggacttctgcgccagcaacagactgaaccactacttctgcgactacgagcccctgctggagctgagctgcagcgacaccagcctgatcgagaaggtggtgttcctggtggccagcgtgaccctggtggtgaccctggtgctggtgatcctgagctacgccttcatcatcaagaccatcctgaagctgcccagcgcccagcagagaaccaaggccttcagcacctgcagcagccacatgatcgtgatcagcctgagctacggcagctgcatgttcatgtacatcaaccccagcgccaaggagggcgacaccttcaacaagggcgtggccctgctgatcaccagcgtggcccccctgctgaaccccttcatctacaccctgagaaaccagcaggtgaagcagcccttcaaggacatggtgaagaagctgctgaacctgtag

SEQ ID NO: 20319 - DNA, 963 bp, Artificial Sequence
  Description of Artificial Sequence: Synthetic coding sequence
atggacgccaccgcctgcaacgagagcgtggacggcagccccgtgttctacctgctgggcatccccagcctgcccgagaccttcttcctgcccgtgttcttcatcttcctgctgttctacctgctgatcctgatgggcaacgccctgatcctggtggccgtggtggccgagcccagcctgcacaagcccatgtacttcttcctgatcaacctgagcaccctggacatcctgttcaccaccaccaccgtgcccaagatgctgagcctgttcctgctgggcgacagattcctgagcttcagcagctgcctgctgcagatgtacctgttccagagcttcacctgcagcgaggccttcatcctggtggtgatggcctacgacagatacgtggccatctgccaccccctgcactaccccgtgctgatgaacccccagaccaacgccaccctggccgccagcgcctggctgaccgccctgctgctgcccatccccgccgtggtgagaaccagccagatggcctacaacagcatcgcctacatctaccactgcttctgcgaccacctggccgtggtgcaggccagctgcagcgacaccaccccccagaccctgatgggcttctgcatcgccatggtggtgagcttcctgcccctgctgctggtgctgctgagctacgtgcacatcctggccagcgtgctgagaatcagcagcctggagggcagagccaaggccttcagcacctgcagcagccacctgctggtggtgggcacctactacagcagcatcgccatcgcctacgtggcctacagagccgacctgcccctggacttccacatcatgggcaacgtggtgtacgccatcctgacccccatcctgaaccccctgatctacaccctgagaaacagagacgtgaaggccgccatcaccaagatcatgagccaggaccccggctgcgacagaagcatctag

SEQ ID NO: 20320 - DNA, 954 bp, Artificial Sequence
  Description of Artificial Sequence: Synthetic coding sequence
atgaagagcgacaaccacagcttcctgggcgacagccccaaggccttcatcctgctgggcgtgagcgacagaccctggctggagctgcccctgttcgtggtgctgctgctgagctacgtgctggccatgctgggcaacgtggccatcatcctggccagcagagtggacccccagctgcacagccccatgtacatcttcctgagccacctgagcttcctggacctgtgctacaccaccaccaccgtgccccagatgctggtgaacatgggcagcagccagaagaccatcagctacggcggctgcaccgtgcagtacgccgtgttccactggctgggctgcaccgagtgcatcgtgctggccgccatggccctggacagatacgtggccatctgcaagcccctgcactacgccgtgctgatgcacagagccctgtgccagcagctggtggccctggcctggctgagcggcttcggcaacagcttcgtgcaggtggtgctgaccgtgcagctgcccttctgcggcagacaggtgctgaacaacttcttctgcgaggtgcccgccgtgatcaagctgagctgcgccgacaccgccgtgaacgacaccatcctggccgtgctggtggccttcttcgtgctggtgcccctggccctgatcctgctgagctacggcttcatcgccagagccgtgctgagaatccagagcagcaagggcagacacaaggccttcggcacctgcagcagccacctgatgatcgtgagcctgttctacctgcccgccatctacatgtacctgcagccccccagcagctacagccaggagcagggcaagttcatcagcctgttctacagcatcatcacccccaccctgaaccccttcacctacaccctgagaaacaaggacatgaagggcgccctgagaagactgctggccagaatctggagactgtgcggctag

SEQ ID NO: 20321 - DNA, 1074 bp, Artificial Sequence
  Description of Artificial Sequence: Synthetic coding sequence
atgaactgggtgaacaagagcgtgccccaggagttcatcctgctggtgttcagcgaccagccctggctggagatcccccccttcgtgatgttcctgttcagctacatcctgaccatcttcggcaacctgaccatcatcctggtgagccacgtggacttcaagctgcacacccccatgtacttcttcctgagcaacctgagcctgctggacctgtgctacaccaccagcaccgtgccccagatgctggtgaacatctgcaacaccagaaaggtgatcagctacggcggctgcgtggcccagctgttcatcttcctggccctgggcagcaccgagtgcctgctgctggccgtgatgtgcttcgacagattcgtggccatctgcagacccctgcactacagcatcatcatgcaccagagactgtgcttccagctggccgccgccagctggatcagcggcttcagcaacagcgtgctgcagagcacctggaccctgaagatgcccctgtgcggccacaaggaggtggaccacttcttctgcgaggtgcccgccctgctgaagctgagctgcgtggacaccaccgccaacgaggccgagctgttcttcatcagcgtgctgttcctgctgatccccgtgaccctgatcctgatcagctacgccttcatcgtgcaggccgtgctgagaatccagagcgccgagggccagagaaaggccttcggcacctgcggcagccacctgatcgtggtgagcctgttctacggcaccgccatcagcatgtacctgcagccccccagccccagcagcaaggacagaggcaagatggtgagcctgttctgcggcatcatcgcccccatgctgaaccccctgatctacaccctgagaaacaaggaggtgaaggaggccttcaagagactggtggccaagagcctgctgaaccaggagatcagaaacatgcagatgatcagcttcgccaaggacaccgtgctgacctacctgaccaacttcagcgccagctgccccatcttcgtgatcaccatcgagaactactgcaacctgccccagagaaagttcccctag

SEQ ID NO: 20322 - DNA, 942 bp, Artificial Sequence
  Description of Artificial Sequence: Synthetic coding sequence
atgaactgggagaacgagagcagccccaaggagttcatcctgctgggcttcagcgacagagcctggctgcagatgcccctgttcgtggtgctgctgatcagctacaccatcaccatcttcggcaacgtgagcatcatgatggtgtgcatcctggaccccaagctgcacacccccatgtacttcttcctgaccaacctgagcatcctggacctgtgctacaccaccaccaccgtgccccacatgctggtgaacatcggctgcaacaagaagaccatcagctacgccggctgcgtggcccacctgatcatcttcctggccctgggcgccaccgagtgcctgctgctggccgtgatgagcttcgacagatacgtggccgtgtgcagacccctgcactacgtggtgatcatgaactactggttctgcctgagaatggccgccttcagctggctgatcggcttcggcaacagcgtgctgcagagcagcctgaccctgaacatgcccagatgcggccaccaggaggtggaccacttcttctgcgaggtgcccgccctgctgaagctgagctgcgccgacaccaagcccatcgaggccgagctgttcttcttcagcgtgctgatcctgctgatccccgtgaccctgatcctgatcagctacggcttcatcgcccaggccgtgctgaagatcagaagcgccgagggcagacagaaggccttcggcacctgcggcagccacatgatcgtggtgagcctgttctacggcaccgccatctacatgtacctgcagccccccagcagcaccagcaaggactggggcaagatggtgagcctgttctacggcatcatcaccagcatgctgaacagcctgatctacagcctgagaaacaaggacatgaaggaggccttcaagagactgatgcccagaatcttcttctgcaagaagtag

SEQ ID NO: 20323 - DNA, 942 bp, Artificial Sequence; identical to SEQ ID NO: 20322
  Description of Artificial Sequence: Synthetic coding sequence

SEQ ID NO: 20324 - DNA, 942 bp, Artificial Sequence; identical to SEQ ID NO: 20322
  Description of Artificial Sequence: Synthetic coding sequence

SEQ ID NO: 20325 - DNA, 942 bp, Artificial Sequence; identical to SEQ ID NO: 20322
  Description of Artificial Sequence: Synthetic coding sequence

SEQ ID NO: 20326 - DNA, 942 bp, Artificial Sequence; identical to SEQ ID NO: 20322
  Description of Artificial Sequence: Synthetic coding sequence

SEQ ID NO: 20327 - DNA, 942 bp, Artificial Sequence; identical to SEQ ID NO: 20322
  Description of Artificial Sequence: Synthetic coding sequence

SEQ ID NO: 20328 - DNA, 942 bp, Artificial Sequence; identical to SEQ ID NO: 20322
  Description of Artificial Sequence: Synthetic coding sequence

SEQ ID NO: 20329 - DNA, 942 bp, Artificial Sequence; identical to SEQ ID NO: 20322
  Description of Artificial Sequence: Synthetic coding sequence

SEQ ID NO: 20330 - DNA, 942 bp, Artificial Sequence
  Description of Artificial Sequence: Synthetic coding sequence
atgaactgggtgaacgacagcatcatccaggagttcatcctgctgggcttcagcgacagaccctggctggagttccccctgctggtggtgttcctgatcagctacaccgtgaccatcttcggcaacctgaccatcatcctggtgagcagactggacaccaagctgcacacccccatgtacttcttcctgaccaacctgagcctgctggacctgtgctacaccacctgcaccgtgccccagatgctggtgaacctgtgcagcatcagaaaggtgatcagctacagaggctgcgtggcccagctgttcatcttcctggccctgggcgccaccgagtacctgctgctggccgtgatgagcttcgacagattcgtggccatctgcagacccctgcactacagcgtgatcatgcaccagagactgtgcctgcagctggccgccgccagctgggtgaccggcttcagcaacagcgtgtggctgagcaccctgaccctgcagctgcccctgtgcgacccctacgtgatcgaccacttcctgtgcgaggtgcccgccctgctgaagctgagctgcgtggagaccaccgccaacgaggccgagctgttcctggtgagcgagctgttccacctgatccccctgaccctgatcctgatcagctacgccttcatcgtgagagccgtgctgagaatccagagcgccgagggcagacagaaggccttcggcacctgcggcagccacctgatcgtggtgagcctgttctacagcaccgccgtgagcgtgtacctgcagccccccagccccagcagcaaggaccagggcaagatggtgagcctgttctacggcatcatcgcccccatgctgaaccccctgatctacaccctgagaaacaaggaggtgaaggagggcttcaagagactggtggccagagtgttcctgatcaagaagtag

SEQ ID NO: 20331 - DNA, 939 bp, Artificial Sequence
  Description of Artificial Sequence: Synthetic coding sequence
atggacggcgtgaacgacagcagcctgcagggcttcgtgctgatgggcatcagcgaccacccccagctggagatgatcttcttcatcgccatcctgttcagctacctgctgaccctgctgggcaacagcaccatcatcctgctgagcagactggaggccagactgcacacccccatgtacttcttcctgagcaacctgagcagcctggacctggccttcgccaccagcagcgtgccccagatgctgatcaacctgtggggccccggcaagaccatcagctacggcggctgcatcacccagctgtacgtgttcctgtggctgggcgccaccgagtgcatcctgctggtggtgatggccttcgacagatacgtggccgtgtgcagacccctgagatacaccgccatcatgaacccccagctgtgctggctgctggccgtgatcgcctgcctgggcggcctgggcaacagcgtgatccagagcaccttcaccctgcagctgcccctgtgcggccacagaagagtggagggcttcctgtgcgaggtgcccgccatgatcaagctggcctgcggcgacaccagcctgaaccaggccgtgctgaacggcgtgtgcaccttcttcaccgccgtgcccctgagcatcatcgtgatcagctactgcctgatcgcccaggccgtgctgaagatcagaagcgccgagggcagaagaaaggccttcaacacctgcctgagccacctgctggtggtgttcctgttctacggcagcgccagctacggctacctgctgcccgccaagaacagcaagcaggaccagggcaagttcatcagcctgttctacagcctggtgacccccatggtgaaccccctgatctacaccctgagaaacatggaggtgaagggcgccctgagaagactgctgggcaagggcagagaggtgggctag

SEQ ID NO: 20332 - DNA, 963 bp, Artificial Sequence
  Description of Artificial Sequence: Synthetic coding sequence
atgatggagatcgccaacgtgagcagccccgaggtgttcgtgctgctgggcttcagcaccagacccagcctggagaccgtgctgttcatcgtggtgctgagcttctacatggtgagcatcctgggcaacggcatcatcatcctggtgagccacaccgacgtgcacctgcacacccccatgtacttcttcctggccaacctgcccttcctggacatgagcttcaccaccagcatcgtgccccagctgctggccaacctgtggggcccccagaagaccatcagctacggcggctgcgtggtgcagttctacatcagccactggctgggcgccaccgagtgcgtgctgctggccaccatgagctacgacagatacgccgccatctgcagacccctgcactacaccgtgatcatgcacccccagctgtgcctgggcctggccctggccagctggctgggcggcctgaccaccagcatggtgggcagcaccctgaccatgctgctgcccctgtgcggcaacaactgcatcgaccacttcttctgcgagatgcccctgatcatgcagctggcctgcgtggacaccagcctgaacgagatggagatgtacctggccagcttcgtgttcgtggtgctgcccctgggcctgatcctggtgagctacggccacatcgccagagccgtgctgaagatcagaagcgccgagggcagaagaaaggccttcaacacctgcagcagccacgtggccgtggtgagcctgttctacggcagcatcatcttcatgtacctgcagcccgccaagagcaccagccacgagcagggcaagttcatcgccctgttctacaccgtggtgacccccgccctgaaccccctgatctacaccctgagaaacaccgaggtgaagagcgccctgagacacatggtgctggagaactgctgcggcagcgccggcaagctggcccagatctag

SEQ ID NO: 20333 - DNA, 927 bp, Artificial Sequence
  Description of Artificial Sequence: Synthetic coding sequence
atgagacagatcaaccagacccaggtgaccgagttcctgctgctgggcctgagcgacggcccccacaccgagcagctgctgttcatcgtgctgctgggcgtgtacctggtgaccgtgctgggcaacctgctgctgatcagcctggtgcacgtggacagccagctgcacacccccatgtacttcttcctgtgcaacctgagcctggccgacctgtgcttcagcaccaacatcgtgccccaggccctggtgcacctgctgagcagaaagaaggtgatcgccttcaccctgtgcgccgccagactgctgttcttcctgatcttcggctgcacccagtgcgccctgctggccgtgatgagctacgacagatacgtggccatctgcaaccccctgagataccccaacatcatgacctggaaggtgtgcgtgcagctggccaccggcagctggaccagcggcatcctggtgagcgtggtggacaccaccttcatcctgagactgccctacagaggcagcaacagcatcgcccacttcttctgcgaggcccccgccctgctgatcctggccagcaccgacacccacgccagcgagatggccatcttcctgatgggcgtggtgatcctgctgatccccgtgttcctgatcctggtgagctacggcagaatcatcgtgaccgtggtgaagatgaagagcaccgtgggcagcctgaaggccttcagcacctgcggcagccacctgatggtggtgatcctgttctacggcagcgccatcatcacctacatgacccccaagagcagcaagcagcaggagaagagcgtgagcgtgttctacgccatcgtgacccccatgctgaaccccctgatctacagcctgagaaacaaggacgtgaaggccgccctgagaaaggtggccaccagaaacttcccctag

SEQ ID NO: 20334 - DNA, 993 bp, Artificial Sequence
  Description of Artificial Sequence: Synthetic coding sequence
atgtgcagcttcttcctgtgccagaccggcaagcaggccaagatcagcatgggcgaggagaaccagaccttcgtgagcaagttcatcttcctgggcctgagccaggacctgcagacccagatcctgctgttcatcctgttcctgatcatctacctgctgaccgtgctgggcaaccagctgatcatcatcctgatcttcctggacagcagactgcacacccccatgtacttcttcctgagaaacctgagcttcgccgacctgtgcttcagcaccagcatcgtgccccaggtgctggtgcacttcctggtgaagagaaagaccatcagcttctacggctgcatgacccagatcatcgtgttcctgctggtgggctgcaccgagtgcgccctgctggccgtgatgagctacgacagatacgtggccgtgtgcaagcccctgtactacagcaccatcatgacccagagagtgtgcctgtggctgagcttcagaagctgggccagcggcgccctggtgagcctggtggacaccagcttcaccttccacctgccctactggggccagaacatcatcaaccactacttctgcgagccccccgccctgctgaagctggccagcatcgacacctacagcaccgagatggccatcttcagcatgggcgtggtgatcctgctggcccccgtgagcctgatcctgggcagctactggaacatcatcagcaccgtgatccagatgcagagcggcgagggcagactgaaggccttcagcacctgcggcagccacctgatcgtggtggtgctgttctacggcagcggcatcttcacctacatgagacccaacagcaagaccaccaaggagctggacaagatgatcagcgtgttctacaccgccgtgacccccatgctgaaccccatcatctacagcctgagaaacaaggacgtgaagggcgccctgagaaagctggtgggcagaaagtgcttcagccacagacagtag

SEQ ID NO: 20335 - DNA, 954 bp, Artificial Sequence
  Description of Artificial Sequence: Synthetic coding sequence
atgggcaccgacaaccagacctgggtgagcgagttcatcctgctgggcctgagcagcgactgggacaccagagtgagcctgttcgtgctgttcctggtgatgtacgtggtgaccgtgctgggcaactgcctgatcgtgctgctgatcagactggacagcagactgcacacccccatgtacttcttcctgaccaacctgagcctggtggacgtgagctacgccaccagcgtggtgccccagctgctggcccacttcctggccgagcacaaggccatccccttccagagctgcgccgcccagctgttcttcagcctggccctgggcggcatcgagttcgtgctgctggccgtgatggcctacgacagatacgtggccgtgtgcgacgccctgagatacagcgccatcatgcacggcggcctgtgcgccagactggccatcaccagctgggtgagcggcttcatcagcagccccgtgcagaccgccatcaccttccagctgcccatgtgcagaaacaagttcatcgaccacatcagctgcgagctgctggccgtggtgagactggcctgcgtggacaccagcagcaacgaggtgaccatcatggtgagcagcatcgtgctgctgatgacccccttctgcctggtgctgctgagctacatccagatcatcagcaccatcctgaagatccagagcagagagggcagaaagaaggccttccacacctgcgccagccacctgaccgtggtggccctgtgctacggcgtggccatcttcacctacatccagccccacagcagccccagcgtgctgcaggagaagctgttcagcgtgttctacgccatcctgacccccatgctgaaccccatgatctacagcctgagaaacaaggaggtgaagggcgcctggcagaagctgctgtggaagttcagcggcctgaccagcaagctggccacctag

SEQ ID NO: 20336 - DNA, 954 bp, Artificial Sequence
  Description of Artificial Sequence: Synthetic coding sequence
atggagatcgacaaccagacctgggtgagagagttcatcctgctgggcctgagcagcgactggtgcacccagatcagcctgttcagcctgttcctggtgacctacctgatgaccgtgctgggcaactgcctgatcgtgctgctgatcagactggacagcagactgcacacccccatgtacttcttcctgaccaacctgagcctggtggacgtgagctacgccaccagcgtggtgccccagctgctggcccacttcctggccgagcacaaggccatccccttccagagctgcgccgcccagctgttcttcagcctggccctgggcggcatcgagttcgtgctgctggccgtgatggcctacgacagacacgtggccgtgagcgacagactgagatacagcgccatcatgcacggcggcctgtgcgccagactggccatcaccagctgggtgagcggcagcatcaacagcctggtgcagaccgccatcaccttccagctgcccatgtgcaccaacaagttcatcgaccacatcagctgcgagctgctggccgtggtgagactggcctgcgtggacaccagcagcaacgaggccgccatcatggtgagcagcatcgtgctgctgatgacccccttctgcctggtgctgctgagctacatcagaatcatcagcaccatcctgaagatccagagcagagagggcagaaagaaggccttccacacctgcgccagccacctgaccgtggtggccctgtgctacggcaccaccatcttcacctacatccagccccacagcggccccagcgtgctgcaggagaagctgatcagcgtgttctacgccatcgtgatgcccctgctgaaccccgtgatctacagcctgagaaacaaggaggtgaagggcgcctggcacaagctgctggagaagttcagcggcctgaccagcaagctgggcacctag

SEQ ID NO: 20337 - DNA, 954 bp, Artificial Sequence
  Description of Artificial Sequence: Synthetic coding sequence
atgggcatggtgagacacaccaacgagagcaacctggccggcttcatcctgctgggcttcagcgactacccccagctgcagaaggtgctgttcgtgctgatcctgatcctgtacctgctgaccatcctgggcaacaccaccatcatcctggtgagcagactggagcccaagctgcacatgcccatgtacttcttcctgagccacctgagcttcctgtacagatgcttcaccagcagcgtgatcccccagctgctggtgaacctgtgggagcccatgaagaccatcgcctacggcggctgcctggtgcacctgtacaacagccacgccctgggcagcaccgagtgcgtgctgcccgccgtgatgagctgcgacagatacgtggccgtgtgcagacccctgcactacaccgtgctgatgcacatccacctgtgcatggccctggccagcatggcctggctgagcggcatcgccaccaccctggtgcagagcaccctgaccctgcagctgcccttctgcggccacagacaggtggaccacttcatctgcgaggtgcccgtgctgatcaagctggcctgcgtgggcaccaccttcaacgaggccgagctgttcgtggccagcatcctgttcctgatcgtgcccgtgagcttcatcctggtgagcagcggctacatcgcccacgccgtgctgagaatcaagagcgccaccagaagacagaaggccttcggcacctgcttcagccacctgaccgtggtgaccatcttctacggcaccatcatcttcatgtacctgcagcccgccaagagcagaagcagagaccagggcaagttcgtgagcctgttctacaccgtggtgaccagaatgctgaaccccctgatctacaccctgagaatcaaggaggtgaagggcgccctgaagaaggtgctggccaaggccctgggcgtgaacatcctgtag

SEQ ID NO: 20338 - DNA, 930 bp, Artificial Sequence
  Description of Artificial Sequence: Synthetic coding sequence
atgggcctgggcaacgagagcagcctgatggacttcatcctgctgggcttcagcgaccaccccagactggaggccgtgctgttcgtgttcgtgctgttcttctacctgctgaccctggtgggcaacttcaccatcatcatcatcagctacctggacccccccctgcacacccccatgtacttcttcctgagcaacctgagcctgctggacatctgcttcaccaccagcctggccccccagaccctggtgaacctgcagagacccaagaagaccatcacctacggcggctgcgtggcccagctgtacatcagcctggccctgggcagcaccgagtgcatcctgctggccgacatggccctggacagatacatcgccgtgtgcaagcccctgcactacgtggtgatcatgaaccccagactgtgccagcagctggccagcatcagctggctgagcggcctggccagcagcctgatccacgccaccttcaccctgcagctgcccctgtgcggcaaccacagactggaccacttcatctgcgaggtgcccgccctgctgaagctggcctgcgtggacaccaccgtgaacgagctggtgctgttcgtggtgagcgtgctgttcgtggtgatcccccccgccctgatcagcatcagctacggcttcatcacccaggccgtgctgagaatcaagagcgtggaggccagacacaaggccttcagcacctgcagcagccacctgaccgtggtgatcatcttctacggcaccatcatctacgtgtacctgcagcccagcgacagctacgcccaggaccagggcaagttcatcagcctgttctacaccatggtgacccccaccctgaaccccatcatctacaccctgagaaacaaggacatgaaggaggccctgagaaagctgctgagcggcaagctgtag

SEQ ID NO: 20339 - DNA, 951 bp, Artificial Sequence
  Description of Artificial Sequence: Synthetic coding sequence
atggaggagaccaacaacagcagcgagaagggcttcctgctgctgggcttcagcgaccagccccagctggagagattcctgttcgccatcatcctgtacttctacgtgctgagcctgctgggcaacaccgccctgatcctggtgtgctgcctggacagcagactgcacacccccatgtacttcttcctgagcaacctgagctgcgtggacatctgcttcaccaccagcgtggccccccagctgctggtgaccatgaacaagaaggacaagaccatgagctacggcggctgcgtggcccagctgtacgtggccatgggcctgggcagcagcgagtgcatcctgctggccgtgatggcctacgacagatacgccgccgtgtgcagacccctgagatacatcgccatcatgcaccccagattctgcgccagcctggccggcggcgcctggctgagcggcctgatcaccagcctgatccagtgcagcctgaccgtgcagctgcccctgtgcggccacagaaccctggaccacatcttctgcgaggtgcccgtgctgatcaagctggcctgcgtggacaccaccttcaacgaggccgagctgttcgtggccagcgtggtgttcctgatcgtgcccgtgctgctgatcctggtgagctacggcttcatcacccaggccgtgctgagaatcaagagcgccgccggcagacagaaggccttcggcacctgcagcagccacctggtggtggtgatcatcttctacggcaccatcatcttcatgtacctgcagcccgccaacagaagaagcaagaaccagggcaagttcgtgagcctgttctacaccatcgtgacccccctgctgaaccccatcatctacaccctgagaaacaaggacgtgaagggcgccctgagaaccctgatcctgggcagcgccgccggccagagccacaaggactag

SEQ ID NO: 20340 - DNA, 951 bp, Artificial Sequence
  Description of Artificial Sequence: Synthetic coding sequence
atggtgaaccagagcagccccatgggcttcctgctgctgggcttcagcgagcaccccgccctggagagaaccctgttcgtggtggtgttcaccagctacctgctgaccctggtgggcaacaccctgatcatcctgctgagcgtgctgtaccccagactgcacagccccatgtacttcttcctgagcgacctgagcttcctggacctgtgcttcaccaccagctgcgtgccccagatgctggtgaacctgtggggccccaagaagaccatcagcttcctgggctgcagcgtgcagctgttcatcttcctgagcctgggcaccaccgagtgcatcctgctgaccgtgatggccttcgacagatacgtggccgtgtgccagcccctgcactacgccaccatcatccaccccagactgtgctggcagctggccagcgtggcctgggtgatgagcctggtgcagagcatcgtgcagacccccagcaccctgcacctgcccttctgcccccaccagcagatcgacgacttcctgtgcgaggtgcccagcctgatcagactgagctgcggcgacaccagctacaacgagatccagctggccgtgagcagcgtgatcttcgtggtggtgcccctgagcctgatcctggccagctacggcgccaccgcccaggccgtgctgagaatcaacagcgccaccgcctggagaaaggccttcggcacctgcagcagccacctgaccgtggtgaccctgttctacagcagcgtgatcgccgtgtacctgcagcccaagaacccctacgcccagggcagaggcaagttcttcggcctgttctacgccgtgggcacccccagcctgaaccccctggtgtacaccctgagaaacaaggagatcaagagagccctgagaagactgctgggcaaggagagagacagcagagagagctggagagccgcctag

SEQ ID NO: 20341 - DNA, 951 bp, Artificial Sequence; identical to SEQ ID NO: 20340
  Description of Artificial Sequence: Synthetic coding sequence

SEQ ID NO: 20342 - DNA, 951 bp, Artificial Sequence; identical to SEQ ID NO: 20340
  Description of Artificial Sequence: Synthetic coding sequence

SEQ ID NO: 20343 - DNA, 951 bp, Artificial Sequence; identical to SEQ ID NO: 20340
  Description of Artificial Sequence: Synthetic coding sequence

SEQ ID NO: 20344 - DNA, 951 bp, Artificial Sequence; identical to SEQ ID NO: 20340
  Description of Artificial Sequence: Synthetic coding sequence

SEQ ID NO: 20345 - DNA, 951 bp, Artificial Sequence; identical to SEQ ID NO: 20340
  Description of Artificial Sequence: Synthetic coding sequence

SEQ ID NO: 20346 - DNA, 951 bp, Artificial Sequence; identical to SEQ ID NO: 20340
  Description of Artificial Sequence: Synthetic coding sequence

SEQ ID NO: 20347 - DNA, 951 bp, Artificial Sequence; identical to SEQ ID NO: 20340
  Description of Artificial Sequence: Synthetic coding sequence

SEQ ID NO: 20348 - DNA, 951 bp, Artificial Sequence; identical to SEQ ID NO: 20340
  Description of Artificial Sequence: Synthetic coding sequence

SEQ ID NO: 20349 - DNA, 951 bp, Artificial Sequence; identical to SEQ ID NO: 20340
  Description of Artificial Sequence: Synthetic coding sequence

SEQ ID NO: 20350 - DNA, 951 bp, Artificial Sequence; identical to SEQ ID NO: 20340
  Description of Artificial Sequence: Synthetic coding sequence

SEQ ID NO: 20351 - DNA, 951 bp, Artificial Sequence; identical to SEQ ID NO: 20340
  Description of Artificial Sequence: Synthetic coding sequence

SEQ ID NO: 20352 - DNA, 951 bp, Artificial Sequence; identical to SEQ ID NO: 20340
  Description of Artificial Sequence: Synthetic coding sequence

SEQ ID NO: 20353 - DNA, 951 bp, Artificial Sequence; identical to SEQ ID NO: 20340
  Description of Artificial Sequence: Synthetic coding sequence

SEQ ID NO: 20354 - DNA, 951 bp, Artificial Sequence; identical to SEQ ID NO: 20340
  Description of Artificial Sequence: Synthetic coding sequence

SEQ ID NO: 20355 - DNA, 951 bp, Artificial Sequence; identical to SEQ ID NO: 20340
  Description of Artificial Sequence: Synthetic coding sequence

SEQ ID NO: 20356 - DNA, 951 bp, Artificial Sequence; identical to SEQ ID NO: 20340
  Description of Artificial Sequence: Synthetic coding sequence

SEQ ID NO: 20357 - DNA, 951 bp, Artificial Sequence; identical to SEQ ID NO: 20340
  Description of Artificial Sequence: Synthetic coding sequence

SEQ ID NO: 20358 - DNA, 951 bp, Artificial Sequence; identical to SEQ ID NO: 20340
  Description of Artificial Sequence: Synthetic coding sequence

SEQ ID NO: 20359 - DNA, 951 bp, Artificial Sequence; identical to SEQ ID NO: 20340
  Description of Artificial Sequence: Synthetic coding sequence

SEQ ID NO: 20360 - DNA, 951 bp, Artificial Sequence; identical to SEQ ID NO: 20340
  Description of Artificial Sequence: Synthetic coding sequence

SEQ ID NO: 20361 - DNA, 951 bp, Artificial Sequence; identical to SEQ ID NO: 20340
  Description of Artificial Sequence: Synthetic coding sequence

SEQ ID NO: 20362 - DNA, 951 bp, Artificial Sequence; identical to SEQ ID NO: 20340
  Description of Artificial Sequence: Synthetic coding sequence

SEQ ID NO: 20363 - DNA, 951 bp, Artificial Sequence; identical to SEQ ID NO: 20340
  Description of Artificial Sequence: Synthetic coding sequence

SEQ ID NO: 20364 - DNA, 951 bp, Artificial Sequence; identical to SEQ ID NO: 20340
  Description of Artificial Sequence: Synthetic coding sequence

SEQ ID NO: 20365 - DNA, 951 bp, Artificial Sequence; identical to SEQ ID NO: 20340
  Description of Artificial Sequence: Synthetic coding sequence

SEQ ID NO: 20366 - DNA, 951 bp, Artificial Sequence; identical to SEQ ID NO: 20340
  Description of Artificial Sequence: Synthetic coding sequence

SEQ ID NO: 20367 - DNA, 951 bp, Artificial Sequence; identical to SEQ ID NO: 20340
  Description of Artificial Sequence: Synthetic coding sequence

SEQ ID NO: 20368 - DNA, 951 bp, Artificial Sequence; identical to SEQ ID NO: 20340
  Description of Artificial Sequence: Synthetic coding sequence

SEQ ID NO: 20369 - DNA, 951 bp, Artificial Sequence; identical to SEQ ID NO: 20340
  Description of Artificial Sequence: Synthetic coding sequence

SEQ ID NO: 20370 - DNA, 951 bp, Artificial Sequence; identical to SEQ ID NO: 20340
  Description of Artificial Sequence: Synthetic coding sequence

SEQ ID NO: 20371 - DNA, 951 bp, Artificial Sequence; identical to SEQ ID NO: 20340
  Description of Artificial Sequence: Synthetic coding sequence

SEQ ID NO: 20372 - DNA, 951 bp, Artificial Sequence; identical to SEQ ID NO: 20340
  Description of Artificial Sequence: Synthetic coding sequence

SEQ ID NO: 20373 - DNA, 951 bp, Artificial Sequence; identical to SEQ ID NO: 20340
  Description of Artificial Sequence: Synthetic coding sequence

SEQ ID NO: 20374 - DNA, 951 bp, Artificial Sequence; identical to SEQ ID NO: 20340
  Description of Artificial Sequence: Synthetic coding sequence

SEQ ID NO: 20375 - DNA, 951 bp, Artificial Sequence; identical to SEQ ID NO: 20340
  Description of Artificial Sequence: Synthetic coding sequence

SEQ ID NO: 20376 - DNA, 951 bp, Artificial Sequence; identical to SEQ ID NO: 20340
  Description of Artificial Sequence: Synthetic coding sequence

SEQ ID NO: 20377 - DNA, 951 bp, Artificial Sequence; identical to SEQ ID NO: 20340
  Description of Artificial Sequence: Synthetic coding sequence

SEQ ID NO: 20378 - DNA, 951 bp, Artificial Sequence; identical to SEQ ID NO: 20340
  Description of Artificial Sequence: Synthetic coding sequence

SEQ ID NO: 20379 - DNA, 951 bp, Artificial Sequence; identical to SEQ ID NO: 20340
  Description of Artificial Sequence: Synthetic coding sequence

SEQ ID NO: 20380 - DNA, 939 bp, Artificial Sequence
  Description of Artificial Sequence: Synthetic coding sequence
atggtgaaccagagcagcacccccggcttcctgctgctgggcttcagcgagcaccccggcctggagagaaccctgttcgtggtggtgctgaccagctacctgctgaccctggtgggcaacaccctgatcatcctgctgagcgccctggaccccaagctgcacagccccatgtacttcttcctgagcaacctgagcttcctggacctgtgcttcaccaccagctgcgtgccccagatgctggtgaacctgtggggccccaagaagaccatcagcttcctggactgcagcgtgcagatcttcatcttcctgagcctgggcaccaccgagtgcatcctgctgaccgtgatggccttcgacagatacgtggccgtgtgccagcccctgcactacgccaccatcatccaccccagactgtgctggcagctggccagcgtggcctgggtgatcggcctggtggagagcgtggtgcagacccccagcaccctgcacctgcccttctgccccgacagacaggtggacgacttcgtgtgcgaggtgcccgccctgatcagactgagctgcgaggacaccagctacaacgagatccaggtggccgtggccagcgtgttcatcctggtggtgcccctgagcctgatcctggtgagctacggcgccatcacctgggccgtgctgagaatcaacagcgccaagggcagaagaaaggccttcggcacctgcagcagccacctgaccgtggtgaccctgttctacagcagcgtgatcgccgtgtacctgcagcccaagaacccctacgcccaggagagaggcaagttcttcggcctgttctacgccgtgggcacccccagcctgaaccccctgatctacaccctgagaaacaaggaggtgaccagagccttcagaagactgctgggcaaggagatgggcctgacccagagctag

SEQ ID NO: 20381 - DNA, 939 bp, Artificial Sequence; identical to SEQ ID NO: 20380
  Description of Artificial Sequence: Synthetic coding sequence

SEQ ID NO: 20382 - DNA, 939 bp, Artificial Sequence; identical to SEQ ID NO: 20380
  Description of Artificial Sequence: Synthetic coding sequence

SEQ ID NO: 20383 - DNA, 939 bp, Artificial Sequence
  Description of Artificial Sequence: Synthetic coding sequence
atgctgatgaagaagaacgccagcttcgaggacttcttcctgctgctgggcttcagcaactggccccacctggaggtggtgctgttcgtggtgatcctgatcttctacctgatcaccctgatcggcaacctgttcatcatcatcctgagctacctggacagccacctgcacacccccatgtacttcttcctgagcaacctgagcttcctggacctgtgctacaccaccagcagcatcccccagctgctggtgaacctgtggggccccgagaagaccatcagctacgccggctgcaccgtgcagctgtacttcgtgctggccctgggcaccgccgagtgcgtgctgctggtggtgatgagctacgacagatacgccgccgtgtgcagacccctgcactacaccgtgctgatgcaccccagattctgcagactgctggccgccgccagctgggtgagcggcttcaccaccagcgccctgcacagcagcttcaccttctggatccccctgtgcagacacagactggtggaccacttcttctgcgaggtgcccgccctgctgagactgagctgcgtggacacccaggccaacgagctgaccctgatggtgatgagcagcatcttcgtgctgatccccctgatcctgatcctgaccagctacggcgccatcgccagagccgtgctgagcatgcagagcaccaccggcctgcagaaggtgctgagaacctgcggcgcccacctgatggtggtgagcctgttcttcatccccgtgatgtgcatgtacctgcagccccccagcgagaacagccaggaccagggcaagttcatcgccctgttctacaccgtggtgacccccagcctgaaccccctgatctacaccttcagaaacaaggacgtgagaggcgccgtgaagagactgatgggctgggagtggggcatgtag

SEQ ID NO: 20384 - DNA, 939 bp, Artificial Sequence
  Description of Artificial Sequence: Synthetic coding sequence
atgatgatcaagaagaacgccagcagcgaggacttcttcatcctgctgggcttcagcaactggccccagctggaggtggtgctgttcgtggtgatcctgatcttctacctgatgaccctgaccggcaacctgttcatcatcatcctgagctacgtggacagccacctgcacacccccatgtacttcttcctgagcaacctgagcttcctggacctgtgccacaccaccagcagcatcccccagctgctggtgaacctgagaggccccgagaagaccatcagctacgccggctgcatggtgcagctgtacttcgtgctggccctgggcatcgccgagtgcgtgctgctggtggtgatgagctacgacagatacgtggccgtgtgcagacccctgcactacaccgtgctgatgcaccccagattctgccacctgctggccgccgccagctgggtgatcggcttcaccatcagcgccctgcacagcagcttcaccttctgggtgcccctgtgcggccacagactggtggaccacttcttctgcgaggtgcccgccctgctgagactgagctgcgtggacacccacgccaacgagctgaccctgatggtgatgagcagcatcttcgtgctgatccccctgatcctgatcctgaccgcctacggcgccatcgccagagccgtgctgagcatgcagagcaccaccggcctgcagaaggtgttcagaacctgcggcgcccacctgatggtggtgagcctgttcttcatccccgtgatgtgcatgtacctgcagccccccagcgagaacagccccgaccagggcaagttcatcgccctgttctacaccgtggtgacccccagcctgaaccccctgatctacaccctgagaaacaagcacgtgaagggcgccgccaagagactgctgggctgggagtggggcaagtag

SEQ ID NO: 20385 - DNA, 939 bp, Artificial Sequence; identical to SEQ ID NO: 20384
  Description of Artificial Sequence: Synthetic coding sequence

SEQ ID NO: 20386 - DNA, 939 bp, Artificial Sequence; identical to SEQ ID NO: 20384
  Description of Artificial Sequence: Synthetic coding sequence

SEQ ID NO: 20387 - DNA, 939 bp, Artificial Sequence; identical to SEQ ID NO: 20384
  Description of Artificial Sequence: Synthetic coding sequence

SEQ ID NO: 20388 - DNA, 939 bp, Artificial Sequence; identical to SEQ ID NO: 20384
  Description of Artificial Sequence: Synthetic coding sequence

SEQ ID NO: 20389 - DNA, 936 bp, Artificial Sequence
  Description of Artificial Sequence: Synthetic coding sequence
atgaacgacgacggcaaggtgaacgccagcagcgagggctacttcatcctggtgggcttcagcaactggccccacctggaggtggtgatcttcgtggtggtgctgatcttctacctgatgaccctgatcggcaacctgttcatcatcatcctgagctacctggacagccacctgcacacccccatgtacttcttcctgagcaacctgagcttcctggacctgtgctacaccaccagcagcatcccccagctgctggtgaacctgtggggccccgagaagaccatcagctacgccggctgcatgatccagctgtacttcgtgctggccctgggcaccaccgagtgcgtgctgctggtggtgatgagctacgacagatacgccgccgtgtgcagacccctgcactacaccgtgctgatgcaccccagattctgccacctgctggccgtggccagctgggtgagcggcttcaccaacagcgccctgcacagcagcttcaccttctgggtgcccctgtgcggccacagacaggtggaccacttcttctgcgaggtgcccgccctgctgagactgagctgcgtggacacccacgtgaacgagctgaccctgatgatcaccagcagcatcttcgtgctgatccccctgatcctgatcctgaccagctacggcgccatcgtgagagccgtgctgagaatgcagagcaccaccggcctgcagaaggtgttcggcacctgcggcgcccacctgatggccgtgagcctgttcttcatccccgccatgtgcatctacctgcagccccccagcggcaacagccaggaccagggcaagttcatcgccctgttctacaccgtggtgacccccagcctgaaccccctgatctacaccctgagaaacaaggtggtgagaggcgccgtgaagagactgatgggctgggagtag

SEQ ID NO: 20390 - DNA, 936 bp, Artificial Sequence; identical to SEQ ID NO: 20389
  Description of Artificial Sequence: Synthetic coding sequence

SEQ ID NO: 20391 - DNA, 936 bp, Artificial Sequence; identical to SEQ ID NO: 20389
  Description of Artificial Sequence: Synthetic coding sequence

SEQ ID NO: 20392 - DNA, 936 bp, Artificial Sequence; identical to SEQ ID NO: 20389
  Description of Artificial Sequence: Synthetic coding sequence

SEQ ID NO: 20393 - DNA, 777 bp, Artificial Sequence
  Description of Artificial Sequence: Synthetic coding sequence
atgaacgacgacggcaaggtgaacgccagcagcgagggctacttcatcctggtgggcttcagcaactggccccacctggaggtggtgatcttcgtggtggtgctgatcttctacctgatgaccctgatcggcaacctgttcatcatcatcctgagctacctggacagccacctgcacacccccatgtacttcttcctgagcaacctgagcttcctggacctgtgctacaccaccagcagcatcccccagctgctggtgaacctgtggggccccgagaagaccatcagctacgccggctgcatgatccagctgtacttcgtgctggccctgggcaccaccgagtgcgtgctgctggtggtgatgagctacgacagatacgccgccgtgtgcagacccctgcactacaccgtgctgatgcaccccagattctgccacctgctggccgtggccagctgggtgagcggcttcaccaacagcgccctgcacagcagcttcaccttctgggtgcccctgtgcggccacagacaggtggaccacttcttctgcgaggtgcccgccctgctgagactgagctgcgtggacacccacgtgaacgagctgaccctgatgatcaccagcagcatcttcgtgctgatccccctgatcctgatcctgaccagctacggcgccatcgtgcaggccgtgctgagaatgcagagcaccaccggcctgcagaaggtgttcggcacctgcggcgcccacctgatggccgtgagcctgttcttcatccccgcctag

SEQ ID NO: 20394 - DNA, 936 bp, Artificial Sequence; identical to SEQ ID NO: 20389
  Description of Artificial Sequence: Synthetic coding sequence

SEQ ID NO: 20395 - DNA, 936 bp, Artificial Sequence; identical to SEQ ID NO: 20389
  Description of Artificial Sequence: Synthetic coding sequence

SEQ ID NO: 20396 - DNA, 951 bp, Artificial Sequence
  Description of Artificial Sequence: Synthetic coding sequence
atgcagggcgagaacttcaccatctggagcatcttcttcctggagggcttcagccagtaccccggcctggaggtggtgctgttcgtgttcagcctggtgatgtacctgaccaccctgctgggcaacagcaccctgatcctgatcaccatcctggacagcagactgaagacccccatgtacctgttcctgggcaacctgagcttcatggacatctgctacaccagcgccagcgtgcccaccctgctggtgaacctgctgagcagccagaagaccatcatcttcagcggctgcgccgtgcagatgtacctgagcctggccatgggcagcaccgagtgcgtgctgctggccgtgatggcctacgacagatacgtggccatctgcaaccccctgagatacagcatcatcatgaacagatgcgtgtgcgccagaatggccaccgtgagctgggtgaccggctgcctgaccgccctgctggagaccagcttcgccctgcagatccccctgtgcggcaacctgatcgaccacttcacctgcgagatcctggccgtgctgaagctggcctgcaccagcagcctgctgatgaacaccatcatgctggtggtgagcatcctgctgctgcccatccccatgctgctggtgtgcatcagctacatcttcatcctgagcaccatcctgagaatcaccagcgccgagggcagaaacaaggccttcagcacctgcggcgcccacctgaccgtggtgatcctgtactacggcgccgccctgagcatgtacctgaagcccagcagcagcaacgcccagaagatcgacaagatcatcagcctgctgtacggcgtgctgacccccatgctgaaccccatcatctacagcctgagaaacaaggaggtgaaggacgccatgaagaagctgctgggcaagatcaccctgcaccagacccacgagcacctgtag

SEQ ID NO: 20397 - DNA, 1038 bp, Artificial Sequence
  Description of Artificial Sequence: Synthetic coding sequence
atgaacatcaccctgtacagcttcctgtacgtgctgagactgaacgagggcaacagcaccggcagaaacatcgacgagagaaagaagatgcagggcgagaacttcaccatctggagcatcttcttcctggagggcttcagccagtaccccggcctggaggtggtgctgttcgtgttcagcctggtgatgtacctgaccaccctgctgggcaacagcaccctgatcctgatcaccatcctggacagcagactgaagacccccatgtacctgttcctgggcaacctgagcttcatggacatctgctacaccagcgccagcgtgcccaccctgctggtgaacctgctgagcagccagaagaccatcatcttcagcggctgcgccgtgcagatgtacctgagcctggccatgggcagcaccgagtgcgtgctgctggccgtgatggcctacgacagatacgtggccatctgcaaccccctgagatacagcatcatcatgaacagatgcgtgtgcgccagaatggccaccgtgagctgggtgaccggctgcctgaccgccctgctggagaccagcttcgccctgcagatccccctgtgcggcaacctgatcgaccacttcacctgcgagatcctggccgtgctgaagctggcctgcaccagcagcctgctgatgaacaccatcatgctggtggtgagcatcctgctgctgcccatccccatgctgctggtgtgcatcagctacatcttcatcctgagcaccatcctgagaatcaccagcgccgagggcagaaacaaggccttcagcacctgcggcgcccacctgaccgtggtgatcctgtactacggcgccgccctgagcatgtacctgaagcccagcagcagcaacgcccagaagatcgacaagatcatcagcctgctgtacggcgtgctgacccccatgctgaaccccatcatctacagcctgagaaacaaggaggtgaaggacgccatgaagaagctgctgggcaagatcaccctgcaccagacccacgagcacctgtag

SEQ ID NO: 20398 - DNA, 939 bp, Artificial Sequence
  Description of Artificial Sequence: Synthetic coding sequence
atggagaagtggaaccacaccagcaacgacttcatcctgctgggcctgctgccccccaaccagaccggcatcttcctgctgtgcctgatcatcctgatcttcttcctggccagcgtgggcaacagcgccatgatccacctgatccacgtggaccccagactgcacacccccatgtacttcctgctgagccagctgagcctgatggacctgatgtacatcagcaccaccgtgcccaagatggcctacaacttcctgagcggccagaagggcatcagcttcctgggctgcggcgtgcagagcttcttcttcctgaccatggcctgcagcgagggcctgctgctgaccagcatggcctacgacagatacctggccatctgccacagcctgtactaccccatcagaatgagcaagatgatgtgcgtgaagatgatcggcggcagctggaccctgggcagcatcaacagcctggcccacaccgtgttcgccctgcacatcccctactgcagaagcagagccatcgaccacttcttctgcgacgtgcccgccatgctgctgctggcctgcaccgacacctgggtgtacgagtacatggtgttcgtgagcaccagcctgttcctgctgttccccttcatcggcatcaccagcagctgcggcagagtgctgttcgccgtgtaccacatgcacagcaaggagggcagaaagaaggccttcaccaccatcagcacccacctgaccgtggtgatcttctactacgcccccttcgtgtacacctacctgagacccagaaacctgagaagccccgccgaggacaagatcctggccgtgttctacaccatcctgacccccatgctgaaccccatcatctacagcctgagaaacaaggaggtgctgggcgccatgagaagagtgttcggcatcttcagcttcctgaaggagtag

SEQ ID NO: 20399 - DNA, 939 bp, Artificial Sequence; identical to SEQ ID NO: 20398
  Description of Artificial Sequence: Synthetic coding sequence

SEQ ID NO: 20400 - DNA, 939 bp, Artificial Sequence
  Description of Artificial Sequence: Synthetic coding sequence
atggagaactacaaccagaccagcaccgacttcatcctgctgggcctgttcccccagagcagaatcggcctgttcgtgttcaccctgatcttcctgatcttcctgatggccctgatcggcaacctgagcatgatcctgctgatcttcctggacatccacctgcacacccccatgtacttcctgctgagccagctgagcctgatcgacctgaactacatcagcaccatcgtgcccaagatggtgtacgacttcctgtacggcaacaagagcatcagcttcaccggctgcggcatccagagcttcttcttcctgaccctggccgtggccgagggcctgctgctgaccagcatggcctacgacagatacgtggccatctgcttccccctgcactaccccatcagaatcagcaagagagtgtgcgtgatgatgatcaccggcagctggatgatcagcagcatcaacagctgcgcccacaccgtgtacgccctgtgcatcccctactgcaagagcagagccatcaaccacttcttctgcgacgtgcccgccatgctgaccctggcctgcaccgacacctgggtgtacgagagcaccgtgttcctgagcagcaccatcttcctggtgctgcccttcaccggcatcgcctgcagctacggcagagtgctgctggccgtgtacagaatgcacagcgccgagggcagaaagaaggcctacagcacctgcagcacccacctgaccgtggtgagcttctactacgcccccttcgcctacacctacgtgagacccagaagcctgagaagccccaccgaggacaagatcctggccgtgttctacaccatcctgacccccatgctgaaccccatcatctacagcctgagaaacaaggaggtgatgggcgccctgacccaggtgatccagaagatcttcagcgtgaagatgtag

SEQ ID NO: 20401 - DNA, 939 bp, Artificial Sequence
  Description of Artificial Sequence: Synthetic coding sequence
atggagaactacaaccagaccagcaccgacttcatcctgctgggcttcttcccccccagcagaatcggcctgttcctgttcatcctgatcgtgttcatcttcctgatggccctgatcggcaacctgagcatgatcctgctgatcttcctggacacccacctgcacacccccatgtacttcctgctgagccagctgagcctgatcgacctgaactacatcagcaccatcgtgcccaagatggccagcgacttcctgagcggcaacaagagcatcagcttcaccggctgcggcatccagagcttcttcttcagcgccctgggcggcgccgaggccctgctgctggccagcatggcctacgacagatacatcgccatctgcttccccctgcactaccccatcagaatgagcaagagaatgtgcgtgctgatgatcaccggcagctggatcatcggcagcatcaacgcctgcgcccacaccgtgtacgtgctgcacatcccctactgccagagcagagccatcaaccacttcttctgcgacgtgcccgccatggtgaccctggcctgcatggacacctgggtgtacgagggcaccgtgttcctgagcaccaccatcttcctggtgttccccttcatcgccatcagctgcagctacggcagagtgctgctggccgtgtaccacatgaagagcgccgagggcagaaagaaggcctacctgacctgcagcacccacctgaccgtggtgaccttctactacgcccccttcgtgtacacctacctgagacccagaagcctgagaagccccaccgaggacaaggtgctggccgtgttctacaccaccctgacccccatgctgaaccccatcatctacagcctgagaaacaaggaggtgatgggcgccctgaccagagtgagccagagaatctgcagcggcaagatgtag

SEQ ID NO: 20402 - DNA, 939 bp, Artificial Sequence
  Description of Artificial Sequence: Synthetic coding sequence
atggagaactacaaccagaccagcaccgacttcatcctgctgggcctgttcccccccagcaagatcggcctgttcctgttcatcctgttcgtgctgatcttcctgatggccctgatcggcaacctgagcatgatcctgctgatcttcctggacacccacctgcacacccccatgtacttcctgctgagccagctgagcctgatcgacctgaactacatcagcaccatcgtgcccaagatggccagcgacttcctgtacggcaacaagagcatcagcttcatcggctgcggcatccagagcttcttcttcatgaccttcgccggcgccgaggccctgctgctgaccagcatggcctacgacagatacgtggccatctgcttccccctgcactaccccatcagaatgagcaagagaatgtacgtgctgatgatcaccggcagctggatgatcggcagcatcaacagctgcgcccacaccgtgtacgccttcagaatcccctactgcaagagcagagccatcaaccacttcttctgcgacgtgcccgccatgctgaccctggcctgcaccgacacctgggtgtacgagtacaccgtgttcctgagcagcaccatcttcctggtgttccccttcaccggcatcgcctgcagctacggctgggtgctgctggccgtgtacagaatgcacagcgccgagggcagaaagaaggcctacagcacctgcagcacccacctgaccgtggtgaccttctactacgcccccttcgcctacacctacctgtgccccagaagcctgagaagcctgaccgaggacaaggtgctggccgtgttctacaccatcctgacccccatgctgaaccccatcatctacagcctgagaaacaaggaggtgatgggcgccctgaccagagtgatccagaacatcttcagcgtgaagatgtag

SEQ ID NO: 20403 - DNA, 939 bp, Artificial Sequence
  Description of Artificial Sequence: Synthetic coding sequence
atggagaactacaaccagaccagcaccgacttcatcctgctgggcctgttcccccccagcagaatcgacctgttcttcttcatcctgatcgtgttcatcttcctgatggccctgatcggcaacctgagcatgatcctgctgatcttcctggacacccacctgcacacccccatgtacttcctgctgagccagctgagcctgatcgacctgaactacatcagcaccatcgtgcccaagatggccagcgacttcctgcacggcaacaagagcatcagcttcaccggctgcggcatccagagcttcttcttcctggccctgggcggcgccgaggccctgctgctggccagcatggcctacgacagatacatcgccatctgcttccccctgcactacctgatcagaatgagcaagagagtgtgcgtgctgatgatcaccggcagctggatcatcggcagcatcaacgcctgcgcccacaccgtgtacgtgctgcacatcccctactgcagaagcagagccatcaaccacttcttctgcgacgtgcccgccatggtgaccctggcctgcatggacacctgggtgtacgagggcaccgtgttcctgagcgccaccatcttcctggtgttccccttcatcggcatcagctgcagctacggccaggtgctgttcgccgtgtaccacatgaagagcgccgagggcagaaagaaggcctacctgacctgcagcacccacctgaccgtggtgaccttctactacgcccccttcgtgtacacctacctgagacccagaagcctgagaagccccaccgaggacaaggtgctggccgtgttctacaccatcctgacccccatgctgaaccccatcatctacagcctgagaaacaaggaggtgatgggcgccctgaccagagtgagccagagaatctgcagcgtgaagatgtag

SEQ ID NO: 20404 - DNA, 1044 bp, Artificial Sequence
  Description of Artificial Sequence: Synthetic coding sequence
atggcctgggagaaccagaccttcaacagcgacttcatcctgctgggcatcttcaaccacagccccccccacaccttcctgttcttcctggtgctgggcatcttcctggtggccttcatgggcaacagcgtgatggtgctgctgatctacctggacacccagctgcacacccccatgtacttcctgctgagccagctgagcctgatggacctgatgctgatctgcaccaccgtgcccaagatggccttcaactacctgagcggcagcaagagcatcagcatggccggctgcgtgacccagatcttcttctacatcagcctgagcggcagcgagtgcttcctgctggccgtgatggcctacgacagatacatcgccatctgccaccccctgagatacaccaacctgatgaaccccaagatctgcggcctgatggccaccttcagctggatcctgggcagcaccgacggcatcatcgacgccgtggccaccttcagcttcagcttctgcggcagcagagagatcgcccacttcttctgcgagttccccagcctgctgatcctgagctgcaacgacaccagcatcttcgaggaggtgatcttcatctgctgcatcgtgatgctggtgttccccgtggccatcatcatcgccagctacgccagagtgatcctggccgtgatccacatgggcagcggcgagggcagatgcaaggccttcaccacctgcagcagccacctgatggtggtgggcatgtactacggcgccgccctgttcatgtacatcagacccaccagcgaccacagccccacccaggacaagatggtgagcgtgttctacaccatcctgacccccatgctgaaccccctgatctacagcctgagaaacaaggaggtgaccagagccttcatgaagatcctgggcaagggcaagagcgagagcgagctgccccacaagctgtacgtgctgctgttcgccaagttcttcttcctgatcagcatcttcttctacgacgtgaagatcctggccctgatcatgtacatcgcctag

SEQ ID NO: 20405 - DNA, 939 bp, Artificial Sequence
  Description of Artificial Sequence: Synthetic coding sequence
atggccagagagaacagcaccttcaacagcgacttcatcctgctgggcatcttcaaccacagccccacccacaccttcctgttcttcctggtgctggccatcttcagcgtggccttcatgggcaacagcgtgatggtgctgctgatctacctggacacccagctgcacacccccatgtacctgctgctgagccagctgagcctgatggacctgatgctgatctgcaccaccgtgcccaagatggccttcaactacctgagcggcagcaagagcatcagcatggccggctgcgccacccagatcttcttctacaccagcctgctgggcagcgagtgcttcctgctggccgtgatggcctacgacagatacaccgccatctgccaccccctgagatacaccaacctgatgagccccaagatctgcggcctgatgaccgccttcagctggatcctgggcagcaccgacggcatcatcgacgtggtggccaccttcagcttcagctactgcggcagcagagagatcgcccacttcttctgcgacttccccagcctgctgatcctgagctgcagcgacaccagcatcttcgagaagatcctgttcatctgctgcatcgtgatgatcgtgttccccgtggccatcatcatcgccagctacgccagagtgatcctggccgtgatccacatgggcagcggcgagggcagaagaaaggccttcaccacctgcagcagccacctgctggtggtgggcatgtactacggcgccgccctgttcatgtacatcagacccaccagcgacagaagccccacccaggacaagatggtgagcgtgttctacaccatcctgacccccatgctgaaccccctgatctacagcctgagaaacaaggaggtgaccagagccttcatgaagatcctgggcaagggcaagagcggcgagtag

SEQ ID NO: 20406 - DNA, 936 bp, Artificial Sequence
  Description of Artificial Sequence: Synthetic coding sequence
atggtgtgggagaaccagaccttcaacagcatcttcatcctgctgggcatcttcaaccacagccccacccacaccttcctgttcagcctggtgctgggcatcttcagcctggccctgatggagaacatcagcatggtgctgctgatctacatcgagaagcagctgcacacccccatgtacttcctgctgagccagctgagcctgatggacctgatgctgatctgcaccaccctgcccaagatgatcttcagctacctgagcggcaagaagagcatcagcctggccggctgcggcacccagatcttcttctacgtgagcctgctgggcgccgagtgcttcctgctggccgtgatggcctacgacagatacgtggccatctgccaccccctgcagtacaccatcctgatgaaccccaagctgtgcgtgttcatgaccgtggccagctggaccctgggcagcctggacggcatcatcgtgctggccgccgtgctgagcttcagctactgcagcagcctggagatccaccacttcttctgcgacgtggccgccctgctgcccctgagctgcaccgagaccagcgccttcgagagactgctggtgatctgctgcgtggtgatgctgatcttccccgtgagcgtgatcatcctgagctacagccacgtgctgagagccgtgatccacatgggcagcggcgagagcagaagaaaggccttcaccacctgcagcagccacctgagcgtggtgggcctgtactacggcgccgccatgttcatgtacatgagacccgccagcaagcacacccccgaccaggacaagatggtgagcgccttctacaccatcctgacccccatgctgaaccccctgatctacagcctgagaaacaaggaggtgttcagagccctgcagaaggtgctgaagaagagaaagctgatctag

SEQ ID NO: 20407 - DNA, 939 bp, Artificial Sequence
  Description of Artificial Sequence: Synthetic coding sequence
atggcctgggagaaccagaccttcaacagcgacttcatcctgctgggcatcttcaaccacagccccacccacaccttcctgttcttcctggtgctggccatcttcagcgtggccttcatgggcaacagcgtgatggtgctgctgatctacctggacacccagctgcacacccccatgtacttcctgctgagccagctgttcctgatggacctgatgctgatctgcagcaccgtgcccaagatggccttcaactacctgagcggcagcaagagcatcagcatggccggctgcgccacccagatcttcttctacgtgagcctgctgggcagcgagtgcttcctgctggccgtgatgagctacgacagatacatcgccatctgccaccccctgagatacaccaacctgatgagacccaagatctgcggcctgatgaccgccttcagctggatcctgggcagcatggacgccatcatcgacgccgtggccaccttcagcttcagctactgcggcagcagagagatcgcccacttcttctgcgacttccccagcctgctgatcctgagctgcaacgacaccagcatcttcgagaaggtgctgttcatctgctgcatcgtgatgatcgtgttccccgtggccatcatcatcgccagctacgccagagtgatcctggccgtgatccacatgggcagcggcgagggcagaagaaaggccttcaccacctgcagcagccacctgatggtggtgggcatgtactacggcgccggcctgttcatgtacatcagacccaccagcgacagaagccccatgcaggacaagctggtgagcgtgttctacaccatcctgacccccatgctgaaccccctgatctacagcctgagaaacaaggaggtgaccagagccctgagaaaggtgctgggcaagggcaagtgcggcgagtag

SEQ ID NO: 20408 - DNA, 939 bp, Artificial Sequence
  Description of Artificial Sequence: Synthetic coding sequence
atggcctgggagaaccagaccttcaacagcgacttcctgctgctgggcatcttcaaccacagccccacccacaccttcctgttcttcctggtgctggccatcttcagcgtggccttcatgggcaacagcatcatggtgctgctgatctacctggacacccagctgcacacccccatgtacttcctgctgagccagctgagcctgatggacctgatgctgatctgcaccaccgtgcccaagatggccttcaactacctgagcggcagcaagagcatcagcatggccggctgcgccacccagatcttcttctacatcagcctgctgggcagcgagtgcttcctgctggccgtgatgagctacgacagatacaccgccatctgccaccccctgagatacaccaacctgatgagacccaagatctgcggcctgatgaccgccttcagctggatcctgggcagcaccgacggcatcatcgacgccgtggccaccttcagcttcagctactgcggcagcagagagatcgcccacttctgctgcgacttccccagcctgctgatcctgagctgcaacgacaccagcatcttcgaggaggtgatcttcatctgctgcatcgtgatgctggtgttccccgtggccatcatcatcaccagctacgccagagtgatcctggccgtgatccacatgggcagcggcgagggcagaagaaaggccttcaccacctgcagcagccacctgatggtggtgggcatgtactacggcgccggcctgttcatgtgcatccagcccaccagccaccacagccccatgcaggacaagatggtgagcgtgttctacaccatcgtgacccccatgctgaaccccctgatctacagcctgagaaacaaggaggtgaccagagccctgatgaagatcctgggcaagggcaagagcggcgactag

SEQ ID NO: 20409 - DNA, 960 bp, Artificial Sequence
  Description of Artificial Sequence: Synthetic coding sequence
atggagaaggccaacgagaccagccccgtgatgggcttcgtgctgctgagactgagcgcccaccccgagctggagaagaccttcttcgtgctgatcctgctgatgtacctggtgatcctgctgggcaacggcgtgctgatcctggtgaccatcctggacagcagactgcacacccccatgtacttcttcctgggcaacctgagcttcctggacatctgcttcaccaccagcagcgtgcccctggtgctggacagcttcctgaccccccaggagaccatcagcttcagcgcctgcgccgtgcagatggccctgagcttcgccatggccggcaccgagtgcctgctgctgagcatgatggccttcgacagatacgtggccatctgcaaccccctgagatacagcgtgatcatgagcaaggccgcctacatgcccatggccgccagcagctgggccatcggcggcgccgccagcgtggtgcacaccagcctggccatccagctgcccttctgcggcgacaacgtgatcaaccacttcacctgcgagatcctggccgtgctgaagctggcctgcgccgacatcagcatcaacgtgatcagcatggaggtgaccaacgtgatcttcctgggcgtgcccgtgctgttcatcagcttcagctacgtgttcatcatcaccaccatcctgagaatccccagcgccgagggcagaaagaaggtgttcagcacctgcagcgcccacctgaccgtggtgatcgtgttctacggcaccctgttcttcatgtacggcaagcccaagagcaaggacagcatgggcgccgacaaggaggacctgagcgacaagctgatccccctgttctacggcgtggtgacccccatgctgaaccccatcatctacagcctgagaaacaaggacgtgaaggccgccgtgagaagactgctgagacccaagggcttcacccagtag

SEQ ID NO: 20410 - DNA, 1110 bp, Artificial Sequence
  Description of Artificial Sequence: Synthetic coding sequence
atgtggcaggagtactacttcctgaacgtgttcttccccctgctgaaggtgtgctgcctgaccatcaacagccacgtggtgatcctgctgccctgggagtgctaccacctgatctggaagatcctgccctacatcggcaccaccgtgggcagcatggaggagtacaacaccagcagcaccgacttcaccttcatgggcctgttcaacagaaaggagaccagcggcctgatcttcgccatcatcagcatcatcttcttcaccgccctgatggccaacggcgtgatgatcttcctgatccagaccgacctgagactgcacacccccatgtacttcctgctgagccacctgagcctgatcgacatgatgtacatcagcaccatcgtgcccaagatgctggtgaactacctgctggaccagagaaccatcagcttcgtgggctgcaccgcccagcacttcctgtacctgaccctggtgggcgccgagttcttcctgctgggcctgatggcctacgacagatacgtggccatctgcaaccccctgagataccccgtgctgatgagcagaagagtgtgctggatgatcatcgccggcagctggttcggcggcagcctggacggcttcctgctgacccccatcaccatgagcttccccttctgcaacagcagagagatcaaccacttcttctgcgaggcccccgccgtgctgaagctggcctgcgccgacaccgccctgtacgagaccgtgatgtacgtgtgctgcgtgctgatgctgctgatccccttcagcgtggtgctggccagctacgccagaatcctgaccaccgtgcagtgcatgagcagcgtggagggcagaaagaaggccttcgccacctgcagcagccacatgaccgtggtgagcctgttctacggcgccgccatgtacacctacatgctgccccacagctaccacaagcccgcccaggacaaggtgctgagcgtgttctacaccatcctgacccccatgctgaaccccctgatctacagcctgagaaacaaggacgtgaccggcgccctgaagagagccctgggcagattcaagggcccccagagagtgagcggcggcgtgttctag

SEQ ID NO: 20411 - DNA, 939 bp, Artificial Sequence
  Description of Artificial Sequence: Synthetic coding sequence
atgagactggccaaccagaccctgggcggcgacttcttcctgctgggcatcttcagccagatcagccaccccggcagactgtgcctgctgatcttcagcatcttcctgatggccgtgagctggaacatcaccctgatcctgctgatccacatcgacagcagcctgcacacccccatgtacttcttcatcaaccagctgagcctgatcgacctgacctacatcagcgtgaccgtgcccaagatgctggtgaaccagctggccaaggacaagaccatcagcgtgctgggctgcggcacccagatgtacttctacctgcagctgggcggcgccgagtgctgcctgctggccgccatggcctacgacagatacgtggccatctgccaccccctgagatacagcgtgctgatgagccacagagtgtgcctgctgctggccagcggctgctggttcgtgggcagcgtggacggcttcatgctgacccccatcgccatgagcttccccttctgcagaagccacgagatccagcacttcttctgcgaggtgcccgccgtgctgaagctgagctgcagcgacaccagcctgtacaagatcttcatgtacctgtgctgcgtgatcatgctgctgatccccgtgaccgtgatcagcgtgagctactactacatcatcctgaccatccacaagatgaacagcgtggagggcagaaagaaggccttcaccacctgcagcagccacatcaccgtggtgagcctgttctacggcgccgccatctacaactacatgctgcccagcagctaccagacccccgagaaggacatgatgagcagcttcttctacaccatcctgacccccgtgctgaaccccatcatctacagcttcagaaacaaggacgtgaccagagccctgaagaagatgctgagcgtgcagaagcccccctactag

SEQ ID NO: 20412 - DNA, 951 bp, Artificial Sequence
  Description of Artificial Sequence: Synthetic coding sequence
atgaccaacaccagcagcagcgacttcaccctgctgggcctgctggtgaacagcgaggccgccggcatcgtgttcaccgtgatcctggccgtgttcctgggcgccgtgaccgccaacctggtgatgatcttcctgatccaggtggacagcagactgcacacccccatgtacttcctgctgagccagctgagcatcatggacaccctgttcatctgcaccaccgtgcccaagctgctggccgacatggtgagcaaggagaagatcatcagcttcgtggcctgcggcatccagatcttcctgtacctgaccatgatcggcagcgagttcttcctgctgggcctgatggcctacgactgctacgtggccgtgtgcaaccccctgagataccccgtgctgatgaacagaaagaagtgcctgctgctggccgccggcgcctggttcggcggcagcctggacggcttcctgctgacccccatcaccatgaacgtgccctactgcggcagcagaagcatcaaccacttcttctgcgagatccccgccgtgctgaagctggcctgcgccgacaccagcctgtacgagaccctgatgtacatctgctgcgtgctgatgctgctgatccccatcagcatcatcagcaccagctacagcctgatcctgctgaccatccacagaatgcccagcgccgagggcagaaagaaggccttcaccacctgcagcagccacctgaccgtggtgagcatcttctacggcgccgccttctacacctacgtgctgccccagagcttccacacccccgagcaggacaaggtggtgagcgccttctacaccatcgtgacccccatgctgaaccccctgatctacagcctgagaaacaaggacgtgatcggcgccttcaagaaggtgttcgcctgctgcagcagcgcccagaaggtggccaccagcgacgcctag

SEQ ID NO: 20413 - DNA, 963 bp, Artificial Sequence
  Description of Artificial Sequence: Synthetic coding sequence
atggagatgagaaacaccacccccgacttcatcctgctgggcctgttcaaccacaccagagcccaccaggtgctgttcatgatgctgctggccaccgtgctgaccagcctgttcagcaacgccctgatgatcctgctgatccactgggaccacagactgcacagacccatgtacttcctgctgagccagctgagcctgatggacatgatgctggtgagcaccaccgtgcccaagatggccgccgactacctgaccggcaacaaggccatcagcagagccggctgcggcgtgcagatcttcttcctgcccaccctgggcggcggcgagtgcttcctgctggccgccatggcctacgacagatacgccgccgtgtgccaccccctgagataccccaccctgatgagctggcagctgtgcctgagaatgaccatgagcagctggctgctgggcgccgccgacggcctgctgcaggccgtggccaccctgagcttcccctactgcggcgcccacgagatcgaccacttcttctgcgaggcccccgtgctggtgagactggcctgcgccgacaccagcgtgttcgagaacgccatgtacatctgctgcgtgctgatgctgctggtgcccttcagcctgatcctgagcagctacggcctgatcctggccgccgtgctgctgatgagaagcaccgaggccagaaagaaggccttcgccacctgcagcagccacgtggccgtggtgggcctgttctacggcgccggcatcttcacctacatgagacccaagagccacagaagcaccaaccacgacaaggtggtgagcgccttctacaccatgttcacccccctgctgaaccccctgatctacagcgtgagaaacagcgaggtgaaggaggccctgaagagatggctgggcacctgcgtgaacctgaagcaccagcagaacgaggcccacagaagcagatag

SEQ ID NO: 20414 - DNA, 975 bp, Artificial Sequence
  Description of Artificial Sequence: Synthetic coding sequence
atgggcatggagggcctgctgcagaacagcaccaacttcgtgctgaccggcctgatcacccaccccgccttccccggcctgctgttcgccatcgtgttcagcatcttcgtggtggccatcaccgccaacctggtgatgatcctgctgatccacatggacagcagactgcacacccccatgtacttcctgctgagccagctgagcatcatggacaccatctacatctgcatcaccgtgcccaagatgctgcaggacctgctgagcaaggacaagaccatcagcttcctgggctgcgccgtgcagatcttcctgtacctgaccctgatcggcggcgagttcttcctgctgggcctgatggcctacgacagatacgtggccgtgtgcaaccccctgagataccccctgctgatgaacagaagagtgtgcctgttcatggtggtgggcagctgggtgggcggcagcctggacggcttcatgctgacccccgtgaccatgagcttccccttctgcagaagcagagagatcaaccacttcttctgcgagatccccgccgtgctgaagctgagctgcaccgacaccagcctgtacgagaccctgatgtacgcctgctgcgtgctgatgctgctgatccccctgagcgtgatcagcgtgagctacacccacatcctgctgaccgtgcacagaatgaacagcgccgagggcagaagaaaggccttcgccacctgcagcagccacatcatggtggtgagcgtgttctacggcgccgccttctacaccaacgtgctgccccacagctaccacacccccgagaaggacaaggtggtgagcgccttctacaccatcctgacccccatgctgaaccccctgatctacagcctgagaaacaaggacgtggccgccgccctgagaaaggtgctgggcagatgcggcagcagccagagcatcagagtggccaccgtgatcagaaagggctag

SEQ ID NO: 20415 - DNA, 954 bp, Artificial Sequence
  Description of Artificial Sequence: Synthetic coding sequence
atggagcagagcaactacagcgtgtacgccgacttcatcctgctgggcctgttcagcaacgccagattcccctggctgctgttcgccctgatcctgctggtgttcctgaccagcatcgccagcaacgtggtgaagatcatcctgatccacatcgacagcagactgcacacccccatgtacttcctgctgagccagctgagcctgagagacatcctgtacatcagcaccatcgtgcccaagatgctggtggaccaggtgatgagccagagagccatcagcttcgccggctgcaccgcccagcacttcctgtacctgaccctggccggcgccgagttcttcctgctgggcctgatgagctacgacagatacgtggccatctgcaaccccctgcactaccccgtgctgatgagcagaaagatctgctggctgatcgtggccgccgcctggctgggcggcagcatcgacggcttcctgctgacccccgtgaccatgcagttccccttctgcgccagcagagagatcaaccacttcttctgcgaggtgcccgccctgctgaagctgagctgcaccgacaccagcgcctacgagaccgccatgtacgtgtgctgcatcatgatgctgctgatccccttcagcgtgatcagcggcagctacaccagaatcctgatcaccgtgtacagaatgagcgaggccgagggcagaggcaaggccgtggccacctgcagcagccacatggtggtggtgagcctgttctacggcgccgccatgtacacctacgtgctgccccacagctaccacacccccgagcaggacaaggccgtgagcgccttctacaccatcctgacccccatgctgaaccccctgatctacagcctgagaaacaaggacgtgaccggcgccctgcagaaggtggtgggcagatgcgtgagcagcggcaaggtgaccaccttctag

SEQ ID NO: 20416 - DNA, 948 bp, Artificial Sequence
  Description of Artificial Sequence: Synthetic coding sequence
atggccaacatcaccagaatggccaaccacaccggcagactggacttcatcctgatgggcctgttcagacagagcaagcaccccgccctgctgagcgtggtgatcttcgtggtgttcctgaaggccctgagcggcaacgccgtgctgatcctgctgatccactgcgacgcccacctgcacagccccatgtacttcttcatcagccagctgagcctgatggacatggcctacatcagcgtgaccgtgcccaagatgctgctggaccaggtgatgggcgtgaacaaggtgagcgcccccgagtgcggcatgcagatgttcctgtacctgaccctggccggcagcgagttcttcctgctggccaccatggcctacgacagatacgtggccatctgccaccccctgagataccccgtgctgatgaaccacagagtgtgcctgttcctggccagcggctgctggttcctgggcagcgtggacggcttcatgctgacccccatcaccatgagcttccccttctgcagaagctgggagatccaccacttcttctgcgaggtgcccgccgtgaccatcctgagctgcagcgacaccagcctgtacgagaccctgatgtacctgtgctgcgtgctgatgctgctgatccccgtgaccatcatcagcagcagctacctgctgatcctgctgaccgtgcacagaatgaacagcgccgagggcagaaagaaggccttcgccacctgcagcagccacctgaccgtggtgatcctgttctacggcgccgccgtgtacacctacatgctgcccagcagctaccacacccccgagaaggacatgatggtgagcgtgttctacaccatcctgacccccgtgctgaaccccctgatctacagcctgagaaacaaggacgtgatgggcgccctgaagaagatgctgaccgtgagattcgtgctgtag

SEQ ID NO: 20417 - DNA, 957 bp, Artificial Sequence
  Description of Artificial Sequence: Synthetic coding sequence
atgtgcagcggcaaccagaccagccagaaccagaccgccagcaccgacttcaccctgaccggcctgttcgccgagagcaagcacgccgccctgctgtacaccgtgaccttcctgctgttcctgatggccctgaccggcaacgccctgctgatcctgctgatccacagcgagcccagactgcacacccccatgtacttcttcatcagccagctggccctgatggacctgatgtacctgtgcgtgaccgtgcccaagatgctggtgggccaggtgaccggcgacgacaccatcagccccagcggctgcggcatccagatgttcttctacctgaccctggccggcgccgaggtgttcctgctggccgccatggcctacgacagatacgccgccgtgtgcagacccctgcactaccccctgctgatgaaccagagagtgtgccagctgctggtgagcgcctgctgggtgctgggcatggtggacggcctgctgctgacccccatcaccatgagcttccccttctgccagagcagaaagatcctgagcttcttctgcgagacccccgccctgctgaagctgagctgcagcgacgtgagcctgtacaagaccctgatgtacctgtgctgcatcctgatgctgctggcccccatcatggtgatcagcagcagctacaccctgatcctgcacctgatccacagaatgaacagcgccgccggccacagaaaggccctggccacctgcagcagccacatgatcatcgtgctgctgctgttcggcgccagcttctacacctacatgctgcccagcagctaccacaccgccgagcaggacatgatggtgagcgccttctacaccatcttcacccccgtgctgaaccccctgatctacagcctgagaaacaaggacgtgaccagagccctgagaagcatgatgcagagcagaatgaaccaggagaagtag

SEQ ID NO: 20418 - DNA, 963 bp, Artificial Sequence
  Description of Artificial Sequence: Synthetic coding sequence
atggagatgagaaacaccacccccgacttcatcctgctgggcctgttcaaccacaccagagcccaccaggtgctgttcatgatggtgctgagcatcgtgctgaccagcctgttcggcaacagcctgatgatcctgctgatccactgggaccacagactgcacacccccatgtacttcctgctgagccagctgagcctgatggacatgatgctggtgagcaccaccgtgcccaagatggccgccgactacctgaccggcagcaaggccatcagcagagccggctgcggcgtgcagatcttcttcctgcccaccctgggcggcggcgagtgcttcctgctggccgccatggcctacgacagatacgccgccgtgtgccaccccctgagataccccaccctgatgagctggcagctgtgcctgagaatgaccatgagctgctggctgctgggcgccgccgacggcctgctgcaggccgtggtgaccctgagcttcccctactgcggcgcccacgagatcgaccacttcttctgcgagacccccgtgctggtgagactggcctgcgccgacaccagcgtgttcgagaacgccatgtacatctgctgcgtgctgatgctgctggtgcccttcagcctgatcctgagcagctacggcctgatcctggccgccgtgctgcacatgagaagcaccgaggccagaaagaaggccttcgccacctgcagcagccacgtggccgtggtgggcctgttctacggcgccgccatcttcacctacatgagacccaagagccacagaagcaccaaccacgacaaggtggtgagcgccttctacaccatgttcacccccctgctgaaccccctgatctacagcgtgaagaacagcgaggtgaagggcgccctgaagagatggctgggcacctgcgtgaacatcaagcaccagcagaacgaggcccacagaagcagatag

SEQ ID NO: 20419 - DNA, 957 bp, Artificial Sequence
  Description of Artificial Sequence: Synthetic coding sequence
atgtgcagcggcaaccagaccagccagaaccagaccgccagcaccgacttcaccctgaccggcctgttcgccgagagcaagcacgccgccctgctgtacaccgtgaccttcctgctgttcctgatggccctgaccggcaacgccctgctgatcctgctgatccacagcgagcccagactgcacacccccatgtacttcttcatcagccagctggccctgatggacctgatgtacctgtgcgtgaccgtgcccaagatgctggtgggccaggtgaccggcgacgacaccatcagccccagcggctgcggcatccagatgttcttccacctgaccctggccggcgccgaggtgttcctgctggccgccatggcctacgacagatacgccgccgtgtgcagacccctgcactaccccctgctgatgaaccagagagtgtgccagctgctggtgagcgcctgctgggtgctgggcatggtggacggcctgctgctgacccccatcaccatgagcttccccttctgccagagcagaaagatcctgagcttcttctgcgagacccccgccctgctgaagctgagctgcagcgacgtgagcctgtacaagatgctgacctacctgtgctgcatcctgatgctgctgacccccatcatggtgatcagcagcagctacaccctgatcctgcacctgatccacagaatgaacagcgccgccggcagaagaaaggccctggccacctgcagcagccacatgatcatcgtgctgctgctgttcggcgccagcttctacacctacatgctgagaagcagctaccacaccgccgagcaggacatgatggtgagcgccttctacaccatcttcacccccgtgctgaaccccctgatctacagcctgagaaacaaggacgtgaccagagccctgagaagcatgatgcagagcagaatgaaccaggagaagtag

SEQ ID NO: 20420 - DNA, 972 bp, Artificial Sequence
  Description of Artificial Sequence: Synthetic coding sequence
atgggcatggagggcctgctgcagaacagcaccaacttcgtgctgaccggcctgatcacccaccccgccttccccggcctgctgttcgccgtggtgttcagcatcttcgtggtggccatcaccgccaacctggtgatgatcctgctgatccacatggacagcagactgcacacccccatgtacttcctgctgagccagctgagcatcatggacaccatctacatctgcatcaccgtgcccaagatgctgcaggacctgctgagcaaggacaagaccatcagcttcctgggctgcgccgtgcagatcttctacctgaccctgatcggcggcgagttcttcctgctgggcctgatggcctacgacagatacgtggccgtgtgcaaccccctgagataccccctgctgatgaacagaagagtgtgcctgttcatggtggtgggcagctgggtgggcggcagcctggacggcttcatgctgacccccgtgaccatgagcttccccttctgcagaagcagagagatcaaccacttcttctgcgagatccccgccgtgctgaagctgagctgcaccgacaccagcctgtacgagaccctgatgtacgcctgctgcgtgctgatgctgctgatccccctgagcgtgatcagcgtgagctacacccacatcctgctgaccgtgcacagaatgaacagcgccgagggcagaagaaaggccttcgccacctgcagcagccacatcatggtggtgagcgtgttctacggcgccgccttctacaccaacgtgctgccccacagctaccacacccccgagaaggacaaggtggtgagcgccttctacaccatcctgacccccatgctgaaccccctgatctacagcctgagaaacaaggacgtggccgccgccctgagaaaggtgctgggcagatgcggcagcagccagagcatcagagtggccaccgtgatcagaaagggctag

SEQ ID NO: 20421 - DNA, 1047 bp, Artificial Sequence
  Description of Artificial Sequence: Synthetic coding sequence
atggacaacatcacctggatggccagccacaccggctggagcgacttcatcctgatgggcctgttcagacagagcaagcaccccatggccaacatcacctggatggccaaccacaccggctggagcgacttcatcctgctgggcctgttcagacagagcaagcaccccgccctgctgtgcgtggtgatcttcgtggtgttcctgatggccctgagcggcaacgccgtgctgatcctgctgatccactgcgacgcccacctgcacacccccatgtacttcttcatcagccagctgagcctgatggacatggcctacatcagcgtgaccgtgcccaagatgctgctggaccaggtgatgggcgtgaacaagatcagcgcccccgagtgcggcatgcagatgttcttctacgtgaccctggccggcagcgagttcttcctgctggccaccatggcctacgacagatacgtggccatctgccaccccctgagataccccgtgctgatgaaccacagagtgtgcctgttcctgagcagcggctgctggttcctgggcagcgtggacggcttcaccttcacccccatcaccatgaccttccccttcagaggcagcagagagatccaccacttcttctgcgaggtgcccgccgtgctgaacctgagctgcagcgacaccagcctgtacgagatcttcatgtacctgtgctgcgtgctgatgctgctgatccccgtggtgatcatcagcagcagctacctgctgatcctgctgaccatccacggcatgaacagcgccgagggcagaaagaaggccttcgccacctgcagcagccacctgaccgtggtgatcctgttctacggcgccgccatctacacctacatgctgcccagcagctaccacacccccgagaaggacatgatggtgagcgtgttctacaccatcctgacccccgtggtgaaccccctgatctacagcctgagaaacaaggacgtgatgggcgccctgaagaagatgctgaccgtggagcccgccttccagaaggccatggagtag

SEQ ID NO: 20422 - DNA, 948 bp, Artificial Sequence
  Description of Artificial Sequence: Synthetic coding sequence
atggccaacatcaccagaatggccaaccacaccggcaagctggacttcatcctgatgggcctgttcagaagaagcaagcaccccgccctgctgagcgtggtgatcttcgtggtgttcctgaaggccctgagcggcaacgccgtgctgatcctgctgatccactgcgacgcccacctgcacagccccatgtacttcttcatcagccagctgagcctgatggacatggcctacatcagcgtgaccgtgcccaagatgctgctggaccaggtgatgggcgtgaacaaggtgagcgcccccgagtgcggcatgcagatgttcctgtacctgaccctggccggcagcgagttcttcctgctggccaccatggcctacgacagatacgtggccatctgccaccccctgagataccccgtgctgatgaaccacagagtgtgcctgttcctggccagcggctgctggttcctgggcagcgtggacggcttcatgctgacccccatcaccatgagcttccccttctgcagaagctgggagatccaccacttcttctgcgaggtgcccgccgtgaccatcctgagctgcagcgacaccagcctgtacgagaccctgatgtacctgtgctgcgtgctgatgctgctgatccccgtgaccatcatcagcagcagctacctgctgatcctgctgaccgtgcacagaatgaacagcgccgagggcagaaagaaggccttcgccacctgcagcagccacctgaccgtggtgatcctgttctacggcgccgccgtgtacacctacatgctgcccagcagctaccacacccccgagaaggacatgatggtgagcgtgttctacaccatcctgacccccgtgctgaaccccctgatctacagcctgagaaacaaggacgtgatgggcgccctgaagaagatgctgaccgtgagattcgtgctgtag

SEQ ID NO: 20423 - DNA, 927 bp, Artificial Sequence
  Description of Artificial Sequence: Synthetic coding sequence
atgaacgagaacaacgagaccctgaccagaggcttcaccctgatgggcctgttcacccacaacaagtgcagcggcttcttcttcggcgtgatctgcgccgtgttcttcatggccatgatcgccaacggcgtgatgatcttcctgatcaacatcgacccccacctgcacacccccatgtacttcctgctgagccacctgagcgtgatcgacaccctgtacatcagcaccatcgtgcccaagatgctggtggactacctgatgggcgagggcaccatcagcttcatcgcctgcaccgcccagtgcttcctgtacatgggcttcatgggcgccgagttcttcctgctgggcctgatggcctacgacagatacgtggccatctgcaaccccctgagataccccgtgctgatcagctggagagtgtgctggatgatcctggccagcagctggttcggcggcgccctggacagcttcctgctgacccccatcaccatgagcctgcccttctgcgccagccaccagatcaaccacttcttctgcgaggcccccaccatgctgagactggcctgcggcgacaagaccacctacgagaccgtgatgtacgtgtgctgcgtggccatgctgctgatccccttcagcgtggtgaccgccagctacaccagaatcctgatcaccgtgcaccagatgaccagcgccgagggcagaaagaaggccttcgccacctgcagcagccacatgatggtggtgaccctgttctacggcgccgccctgtacacctacaccctgccccagagctaccacacccccatcaaggacaaggtgttcagcgccttctacaccatcctgacccccctgctgaaccccctgatctacagcctgagaaacagagacgtgatgggcgccctgaagagagtggtggccagatgctag

SEQ ID NO: 20424 - DNA, 948 bp, Artificial Sequence
  Description of Artificial Sequence: Synthetic coding sequence
atgggcagatgggtgaaccagagctacaccgacggcttcttcctgctgggcatcttcagccacagccagaccgacctggtgctgttcagcgccgtgatggtggtgttcaccgtggccctgtgcggcaacgtgctgctgatcttcctgatctacctggacgccggcctgcacacccccatgtacttcttcctgagccagctgagcctgatggacctgatgctggtgtgcaacatcgtgcccaagatggccgccaacttcctgagcggcagaaagagcatcagcttcgtgggctgcggcatccagatcggcttcttcgtgagcctggtgggcagcgagggcctgctgctgggcctgatggcctacgacagatacgtggccgtgagccaccccctgcactaccccatcctgatgaaccagagagtgtgcctgcagatcaccggcagcagctgggccttcggcatcatcgacggcgtgatccagatggtggccgccatgggcctgccctactgcggcagcagaagcgtggaccacttcttctgcgaggtgcaggccctgctgaagctggcctgcgccgacaccagcctgttcgacaccctgctgttcgcctgctgcgtgttcatgctgctgctgcccttcagcatcatcatggccagctacgcctgcatcctgggcgccgtgctgagaatcagaagcgcccaggcctggaagaaggccctggccacctgcagcagccacctgaccgccgtgaccctgttctacggcgccgccatgttcatgtacctgagacccagaagatacagagcccccagccacgacaaggtggccagcatcttctacaccgtgctgacccccatgctgaaccccctgatctacagcctgagaaacggcgaggtgatgggcgccctgagaaagggcctggacagatgcagaatcggcagccagcactag

SEQ ID NO: 20425 - DNA, 948 bp, Artificial Sequence
  Description of Artificial Sequence: Synthetic coding sequence
atggagacctgggtgaaccagagctacaccgacggcttcttcctgctgggcatcttcagccacagcaccgccgacctggtgctgttcagcgtggtgatggccgtgttcaccgtggccctgtgcggcaacgtgctgctgatcttcctgatctacatggacccccacctgcacacccccatgtacttcttcctgagccagctgagcctgatggacctgatgctggtgtgcaccaacgtgcccaagatggccgccaacttcctgagcggcagaaagagcatcagcttcgtgggctgcggcatccagatcggcctgttcgtgtgcctggtgggcagcgagggcctgctgctgggcctgatggcctacgacagatacgtggccatcagccaccccctgcactaccccatcctgatgaaccagagagtgtgcctgcagatcaccggcagcagctgggccttcggcatcatcgacggcctgatccagatggtggtggtgatgaacttcccctactgcggcctgagaaaggtgaaccacttcttctgcgagatgctgagcctgctgaagctggcctgcgtggacaccagcctgttcgagaaggtgatcttcgcctgctgcgtgttcatgctgctgttccccttcagcatcatcgtggccagctacgcccacatcctgggcaccgtgctgcagatgcacagcgcccaggcctggaagaaggccctggccacctgcagcagccacctgaccgccgtgaccctgttctacggcgccgccatgttcatctacctgagacccagacactacagagcccccagccacgacaaggtggccagcatcttctacaccgtgctgacccccatgctgaaccccctgatctacagcctgagaaacagagaggtgatgggcgccctgagaaagggcctggacagatgcagaatcggcagccagcactag

SEQ ID NO: 20426 - DNA, 963 bp, Artificial Sequence
  Description of Artificial Sequence: Synthetic coding sequence
atggaccagagcaactacagcagcctgcacggcttcatcctgctgggcttcagcaaccaccccaagatggagatgatcctgagcggcgtggtggccatcttctacctgatcaccctggtgggcaacaccgccatcatcctggccagcctgctggacagccagctgcacacccccatgtacttcttcctgagaaacctgagcttcctggacctgtgcttcaccaccagcatcatcccccagatgctggtgaacctgtggggccccgacaagaccatcagctacgtgggctgcatcatccagctgtacgtgtacatgtggctgggcagcgtggagtgcctgctgctggccgtgatgagctacgacagattcaccgccatctgcaagcccctgcactacttcgtggtgatgaacccccacctgtgcctgaagatgatcatcatgatctggagcatcagcctggccaacagcgtggtgctgtgcaccctgaccctgaacctgcccacctgcggcaacaacatcctggaccacttcctgtgcgagctgcccgccctggtgaagatcgcctgcgtggacaccaccaccgtggagatgagcgtgttcgccctgggcatcatcatcgtgctgacccccctgatcctgatcctgatcagctacggctacatcgccaaggccgtgctgagaaccaagagcaaggccagccagagaaaggccatgaacacctgcggcagccacctgaccgtggtgagcatgttctacggcaccatcatctacatgtacctgcagcccggcaacagagccagcaaggaccagggcaagttcctgaccctgttctacaccgtgatcacccccagcctgaaccccctgatctacaccctgagaaacaaggacatgaaggacgccctgaagaagctgatgagattccaccacaagagcaccaagatcaagagaaactgcaagagctag

SEQ ID NO: 20427 - DNA, 963 bp, Artificial Sequence; identical to SEQ ID NO: 20426
  Description of Artificial Sequence: Synthetic coding sequence

SEQ ID NO: 20428 - DNA, 963 bp, Artificial Sequence; identical to SEQ ID NO: 20426
  Description of Artificial Sequence: Synthetic coding sequence

SEQ ID NO: 20429 - DNA, 963 bp, Artificial Sequence; identical to SEQ ID NO: 20426
  Description of Artificial Sequence: Synthetic coding sequence

SEQ ID NO: 20430 - DNA, 963 bp, Artificial Sequence; identical to SEQ ID NO: 20426
  Description of Artificial Sequence: Synthetic coding sequence

SEQ ID NO: 20431 - DNA, 963 bp, Artificial Sequence; identical to SEQ ID NO: 20426
  Description of Artificial Sequence: Synthetic coding sequence

SEQ ID NO: 20432 - DNA, 963 bp, Artificial Sequence; identical to SEQ ID NO: 20426
  Description of Artificial Sequence: Synthetic coding sequence

SEQ ID NO: 20433 - DNA, 963 bp, Artificial Sequence; identical to SEQ ID NO: 20426
  Description of Artificial Sequence: Synthetic coding sequence

SEQ ID NO: 20434 - DNA, 945 bp, Artificial Sequence
  Description of Artificial Sequence: Synthetic coding sequence
atggacggcaccaacggcagcacccagacccacttcatcctgctgggcttcagcgacagaccccacctggagagaatcctgttcgtggtgatcctgatcgcctacctgctgaccctggtgggcaacaccaccatcatcctggtgagcagactggacccccacctgcacacccccatgtacttcttcctggcccacctgagcttcctggacctgagcttcaccaccagcagcatcccccagctgctgtacaacctgaacggctgcgacaagaccatcagctacatgggctgcgccatccagctgttcctgttcctgggcctgggcggcgtggagtgcctgctgctggccgtgatggcctacgacagatgcgtggccatctgcaagcccctgcactacatggtgatcatgaaccccagactgtgcagaggcctggtgagcgtgacctggggctgcggcgtggccaacagcctggccatgagccccgtgaccctgagactgcccagatgcggccaccacgaggtggaccacttcctgagagagatgcccgccctgatcagaatggcctgcgtgagcaccgtggccatcgagggcaccgtgttcgtgctggccgtgggcgtggtgctgagccccctggtgttcatcctgctgagctacagctacatcgtgagagccgtgctgcagatcagaagcgccagcggcagacagaaggccttcggcacctgcggcagccacctgaccgtggtgagcctgttctacggcaacatcatctacatgtacatgcagcccggcgccagcagcagccaggaccagggcatgttcctgatgctgttctacaacatcgtgacccccctgctgaaccccctgatctacaccctgagaaacagagaggtgaagggcgccctgggcagactgctgctgggcaagagagagctgggcaaggagtag

SEQ ID NO: 20435 - DNA, 945 bp, Artificial Sequence; identical to SEQ ID NO: 20434
  Description of Artificial Sequence: Synthetic coding sequence

SEQ ID NO: 20436 - DNA, 936 bp, Artificial Sequence
  Description of Artificial Sequence: Synthetic coding sequence
atgggcagcttcaacaccagcttcgaggacggcttcatcctggtgggcttcagcgactggccccagctggagcccatcctgttcgtgttcatcttcatcttctacagcctgaccctgttcggcaacaccatcatcatcgccctgagctggctggacctgagactgcacacccccatgtacttcttcctgagccacctgagcctgctggacctgtgcttcaccaccagcaccgtgccccagctgctgatcaacctgtgcggcgtggacagaaccatcaccagaggcggctgcgtggcccagctgttcatctacctggccctgggcagcaccgagtgcgtgctgctggtggtgatggccttcgacagatacgccgccgtgtgcagacccctgcactacatggccatcatgcacccccacctgtgccagaccctggccatcgccagctggggcgccggcttcgtgaacagcctgatccagaccggcctggccatggccatgcccctgtgcggccacagactgaaccacttcttctgcgagatgcccgtgttcctgaagctggcctgcgccgacaccgagggcaccgaggccaagatgttcgtggccagagtgatcgtggtggccgtgcccgccgccctgatcctgggcagctacgtgcacatcgcccacgccgtgctgagagtgaagagcaccgccggcagaagaaaggccttcggcacctgcggcagccacctgctggtggtgttcctgttctacggcagcgccatctacacctacctgcagagcatccacaactacagcgagagagagggcaagttcgtggccctgttctacaccatcatcacccccatcctgaaccccctgatctacaccctgagaaacaaggacgtgaagggcgccctgtggaaggtgctgtggagaggcagagacagcggctag

SEQ ID NO: 20437 - DNA, 945 bp, Artificial Sequence
  Description of Artificial Sequence: Synthetic coding sequence
atgggcgacgtgaaccagagcgtggccagcgacttcatcctggtgggcctgttcagccacagcggcagcagacagctgctgttcagcctggtggccgtgatgttcgtgatcggcctgctgggcaacaccgtgctgctgttcctgatcagagtggacagcagactgcacacccccatgtacttcctgctgagccagctgagcctgttcgacatcggctgccccatggtgaccatccccaagatggccagcgacttcctgagaggcgagggcgccaccagctacggcggcggcgccgcccagatcttcttcctgaccctgatgggcgtggccgagggcgtgctgctggtgctgatgagctacgacagatacgtggccgtgtgccagcccctgcagtaccccgtgctgatgagaagacaggtgtgcctgctgatgatgggcagcagctgggtggtgggcgtgctgaacgccagcatccagaccagcatcaccctgcacttcccctactgcgccagcagaatcgtggaccacttcttctgcgaggtgcccgccctgctgaagctgagctgcgccgacacctgcgcctacgagatggccctgagcaccagcggcgtgctgatcctgatgctgcccctgagcctgatcgccaccagctacggccacgtgctgcaggccgtgctgagcatgagaagcgaggaggccagacacaaggccgtgaccacctgcagcagccacatcaccgtggtgggcctgttctacggcgccgccgtgttcatgtacatggtgccctgcgcctaccacagcccccagcaggacaacgtggtgagcctgttctacagcctggtgacccccaccctgaaccccctgatctacagcctgagaaaccccgaggtgtggatggccctggtgaaggtgctgagcagagccggcctgagacagatgtgctag

SEQ ID NO: 20438 - DNA, 948 bp, Artificial Sequence
  Description of Artificial Sequence: Synthetic coding sequence
atgcagcccgagagcggcgccaacggcaccgtgatcgccgagttcatcctgctgggcctgctggaggcccccggcctgcagcccgtggtgttcgtgctgttcctgttcgcctacctggtgaccgtgagaggcaacctgagcatcctggccgccgtgctggtggagcccaagctgcacacccccatgtacttcttcctgggcaacctgagcgtgctggacgtgggctgcatcagcgtgaccgtgcccagcatgctgagcagactgctgagcagaaagagagccgtgccctgcggcgcctgcctgacccagctgttcttcttccacctgttcgtgggcgtggactgcttcctgctgaccgccatggcctacgacagattcctggccatctgcagacccctgacctacagcaccagaatgagccagaccgtgcagagaatgctggtggccgccagctgggcctgcgccttcaccaacgccctgacccacaccgtggccatgagcaccctgaacttctgcggccccaacgtgatcaaccacttctactgcgacctgccccagctgttccagctgagctgcagcagcacccagctgaacgagctgctgctgttcgccgtgggcttcatcatggccggcacccccatggccctgatcgtgatcagctacatccacgtggccgccgccgtgctgagaatcagaagcgtggagggcagaaagaaggccttcagcacctgcggcagccacctgaccgtggtggccatcttctacggcagcggcatcttcaactacatgagactgggcagcaccaagctgagcgacaaggacaaggccgtgggcatcttcaacaccgtgatcaaccccatgctgaaccccatcatctacagcttcagaaaccccgacgtgcagagcgccatctggagaatgctgaccggcagaagaagcctggcctag

SEQ ID NO: 20439 - DNA, 966 bp, Artificial Sequence
  Description of Artificial Sequence: Synthetic coding sequence
atgagcctgcagaagctgatggagcccgaggccggcaccaacagaaccgccgtggccgagttcatcctgctgggcctggtgcagaccgaggagatgcagcccgtggtgttcgtgctgctgctgttcgcctacctggtgaccaccggcggcaacctgagcatcctggccgccgtgctggtggagcccaagctgcacgcccccatgtacttcttcctgggcaacctgagcgtgctggacgtgggctgcatcaccgtgaccgtgcccgccatgctgggcagactgctgagccacaagagcaccatcagctacgacgcctgcctgagccagctgttcttcttccacctgctggccggcatggactgcttcctgctgaccgccatggcctacgacagactgctggccatctgccagcccctgacctacagcaccagaatgagccagaccgtgcagagaatgctggtggccgccagcctggcctgcgccttcaccaacgccctgacccacaccgtggccatgagcaccctgaacttctgcggccccaacgaggtgaaccacttctactgcgacctgccccagctgttccagctgagctgcagcagcacccagctgaacgagctgctgctgttcgccgtgggcttcatcatggccggcacccccctggtgctgatcatcaccgcctacagccacgtggccgccgccgtgctgagaatcagaagcgtggagggcagaaagaaggccttcagcacctgcggcagccacctgaccgtggtgtgcctgttcttcggcagaggcatcttcaactacatgagactgggcagcgaggaggccagcgacaaggacaagggcgtgggcgtgttcaacaccgtgatcaaccccatgctgaaccccctgatctacagcctgagaaaccccgacgtgcagggcgccctgtggcagatcttcctgggcagaagaagcctgacctag

SEQ ID NO: 20440 - DNA, 966 bp, Artificial Sequence
  Description of Artificial Sequence: Synthetic coding sequence
atgagcctgcagaagctgatggagcccgaggccggcaccaacagaaccgccgtggccgagttcatcctgctgggcctggtgcagaccgaggagatgcagcccgtggtgttcgtgctgctgctgttcgcctacctggtgaccaccggcggcaacctgagcatcctggccgccgtgctggtggagcccaagctgcacgcccccatgtacttcttcctgggcaacctgagcgtgctggacgtgggctgcatcaccgtgaccgtgcccgccatgctgggcagactgctgagccacaagagcaccatcagctacgacgcctgcctgagccagctgttcttcttccacctgctggccggcatggactgcttcctgctgaccgccatggcctacgacagactgctggccatctgccagcccctgacctacagcaccagaatgagccagaccgtgcagagaatgctggtggccgccagctgggcctgcgccttcaccaacgccctgacccacaccgtggccatgagcaccctgaacttctgcggccccaacgaggtgaaccacttctactgcgacctgccccagctgttccagctgagctgcagcagcacccagctgaacgagctgctgctgttcgtggccgccgccttcatggccgtggcccccctggtgttcatcagcgtgagctacgcccacgtggtggccgccgtgctgcagatcagaagcgccgagggcagaaagaaggccttcagcacctgcggcagccacctgaccgtggtgggcatcttctacggcaccggcgtgttcagctacatgagactgggcagcgtggagagcagcgacaaggacaagggcgtgggcgtgttcatgaccgtgatcaaccccatgctgaaccccctgatctacagcctgagaaacaccgacgtgcagggcgccctgtgccagctgctggtgggcaagagaagcctgacctag

SEQ ID NO: 20441 - DNA, 1035 bp, Artificial Sequence
  Description of Artificial Sequence: Synthetic coding sequence
atggagctgctgaccaacaacctgaagttcatcaccgaccccttcgtgtgcagactgagacacctgagccccacccccagcgaggagcacatgaagaacaagaacaacgtgaccgagttcatcctgctgggcctgacccagaaccccgagggccagaaggtgctgttcgtgaccttcctgctgatctacatggtgaccatcatgggcaacctgctgatcatcgtgaccatcatggccagccagagcctgggcagccccatgtacttcttcctggccagcctgagcttcatcgacaccgtgtacagcaccgccttcgcccccaagatgatcgtggacctgctgagcgagaagaagaccatcagcttccagggctgcatggcccagctgttcatggaccacctgttcgccggcgccgaggtgatcctgctggtggtgatggcctacgacagatacatggccatctgcaagcccctgcacgagctgatcaccatgaacagaagagtgtgcgtgctgatgctgctggccgcctggatcggcggcttcctgcacagcctggtgcagttcctgttcatctaccagctgcccttctgcggccccaacgtgatcgacaacttcctgtgcgacctgtaccccctgctgaagctggcctgcaccaacacctacgtgaccggcctgagcatgatcgccaacggcggcgccatctgcgccgtgaccttcttcaccatcctgctgagctacggcgtgatcctgcacagcctgaagacccagagcctggagggcaagagaaaggccttctacacctgcgccagccacgtgaccgtggtgatcctgttcttcgtgccctgcatcttcctgtacgccagacccaacagcaccttccccatcgacaagagcatgaccgtggtgctgaccttcatcacccccatgctgaaccccctgatctacaccctgaagaacgccgagatgaagagcgccatgagaaagctgtggagcaagaaggtgagcctggccggcaagtggctgtaccacagctag

SEQ ID NO: 20442 - DNA, 987 bp, Artificial Sequence
  Description of Artificial Sequence: Synthetic coding sequence
atgagacccagcagcaacgtgaccgagttcgtgctgctgggcctgacccaggaccccgacgtgaagaagaccctgttcgtgatgttcctgctgatctacatcgtgaccatggtgggcaacctgctgatctgggtgaccaccatcggcagccccagcctgggcagcctgatgtacttcttcctggcctacctgagcctgatggacgccatctacagcaccgccatgagccccaagctgatgatcgacctgctgtgcgacaagatcgccatcagcctgagcgcctgcatgggccagctgttcatcgagcacctgctgggcggcgccgaggtgttcctgctggtggtgatggcctacgacagatacgtggccatcagcaagcccctgcactacctgaacatcatgaacagactggtgtgcatcctgctgctggtggtggccatgatcggcggcttcgtgcacagcgtggtgcagatcgtgttcctgtacagcctgcccatctgcggccccaacgtgatcgaccacagcgtgtgcgacatgtaccccctgctggagctgctgtgcctggacacctacttcatcggcctgaccgtggtggccaacggcggcatcatctgcatggtgatcttcaccttcctgctgatcagctgcggcgtgatcctgaacttcctgaagacctacagccaggaggagagacacaaggccctgcccacctgcatcagccacatcatcgtggtggccctggtgttcgtgccctgcatcttcatgtacgtgagacccgtgagcaacttccccttcgacaagctgatgaccgtgttctacagcatcatcaccctgatgctgaaccccctgatctacagcctgagacagagcgagatgaagaacgccatgaagaacctgtggtgcgagaagctgagcatcgtgagaaagagagtgagccccaccctgaacatcttcatccccagcagcaaggccaccaacagaagatag

SEQ ID NO: 20443 - DNA, 930 bp, Artificial Sequence
  Description of Artificial Sequence: Synthetic coding sequence
atggagcccagaaagaacgtgaccgacttcgtgctgctgggcttcacccagaaccccaaggagcagaaggtgctgttcgtgatgttcctgctgttctacatcctgaccatggtgggcaacctgctgatcgtggtgaccgtgaccgtgagcgagaccctgggcagccccatgtacttcttcctggccggcctgagcttcatcgacatcatctacagcagcagcatcagccccagactgatcagcggcctgttcttcggcaacaacagcatcagcttccagagctgcatggcccagctgttcatcgagcacatcttcggcggcagcgaggtgttcctgctgctggtgatggcctacgactgctacgtggccatctgcaagcccctgcactacctggtgatcatgagacagtgggtgtgcgtggtgctgctggtggtgagctgggtgggcggcttcctgcacagcgtgttccagctgagcatcatctacggcctgcccttctgcggccccaacgtgatcgaccacttcttctgcgacatgtaccccctgctgaagctggtgtgcaccgacacccacgccatcggcctgctggtggtggccaacggcggcctggcctgcaccatcgtgttcctgctgctgctgatcagctacggcgtgatcctgcacagcctgaagaacctgagccagaagggcagacagaaggccctgagcacctgcagcagccacatgaccgtggtggtgttcttcttcgtgccctgcatcttcatgtacgccagacccgccagaaccttccccatcgacaagagcgtgagcgtgttctacaccgtgatcacccccatgctgaaccccctgatctacaccctgagaaacagcgagatgaccagcgccatgaagaagctgtggagaagagacctgatcagcagcagcacctag

SEQ ID NO: 20444 - DNA, 948 bp, Artificial Sequence
  Description of Artificial Sequence: Synthetic coding sequence
atgagacagaacaacaacatcaccgagttcgtgctgctgggcttcagccaggaccccggcgtgcagaaggccctgttcgtgatgttcctgctgacctacctggtgaccgtggtgggcaacctgctgatcgtggtggacatcatcgccagccccagcctgggcagccccatgtacttcttcctggcctgcctgagcttcatcgacgccgcctacagcaccaccatcagccccaagctgatcgtgggcctgttctgcgacaagaagaccatcagcttccagggctgcatgggccagctgttcatcgaccacttcttcggcggcgccgaggtgttcctgctggtggtgatggcctgcgacagatacgtggccatctgcaagcccctgcactacctgaccatcatgaacagacaggtgtgcttcctgctgctggtggtggccatgatcggcggcttcgtgcacagcgccttccagatcgtggtgtacagcctgcccttctgcggccccaacgtgatcgtgcacttcagctgcgacatgcaccccctgctggagctggcctgcaccgacacctacttcatcggcctgaccgtggtggtgaacagcggcgccatctgcatggtgatcttcaacctgctgctgatcagctacggcgtgatcctgagcagcctgaagacctacagccaggagaagagaggcaaggccctgagcacctgcagcagcggcagcaccgtggtggtgctgttcttcgtgccctgcatcttcatctacgtgagacccgtgagcaacttccccaccgacaagttcatgaccgtgttctacaccatcatcacccacatgctgagccccctgatctacaccctgagaaacagcgagatgagaaacgccatcgagaagctgctgggcaagaagctgaccatcttcatcatcggcggcgtgagcgtgctgatgtag

SEQ ID NO: 20445 - DNA, 930 bp, Artificial Sequence
  Description of Artificial Sequence: Synthetic coding sequence
atggccagcaccagcaacgtgaccgagctgatcttcaccggcctgttccaggaccccgccgtgcagagcgtgtgcttcgtggtgttcctgcccgtgtacctggccaccgtggtgggcaacggcctgatcgtgctgaccgtgagcatcagcaagagcctggacagccccatgtacttcttcctgagctgcctgagcctggtggagatcagctacagcagcaccatcgcccccaagttcatcatcgacctgctggccaagatcaagaccatcagcctggagggctgcctgacccagatcttcttcttccacttcttcggcgtggccgagatcctgctgatcgtggtgatggcctacgactgctacgtggccatctgcaagcccctgcactacatgaacatcatcagcagacagctgtgccacctgctggtggccggcagctggctgggcggcttctgccacagcatcatccagatcctggtgatcatccagctgcccttctgcggccccaacgtgatcgaccactacttctgcgacctgcagcccctgttcaagctggcctgcaccgacaccttcatggagggcgtgatcgtgctggccaacagcggcctgttcagcgtgttcagcttcctgatcctggtgagcagctacatcgtgatcctggtgaacctgagaaaccacagcgccgagggcagacacaaggccctgagcacctgcgccagccacatcaccgtggtgatcctgttcttcggccccgccatcttcctgtacatgagacccagcagcaccttcaccgaggacaagctggtggccgtgttctacaccgtgatcacccccatgctgaaccccatcatctacaccctgagaaacgccgaggtgaagatcgccatcagaagactgtggagcaagaaggagaaccccggcagagagtag

SEQ ID NO: 20446 - DNA, 933 bp, Artificial Sequence
  Description of Artificial Sequence: Synthetic coding sequence
atgcagcagaacaacagcgtgcccgagttcatcctgctgggcctgacccaggaccccctgagacagaagatcgtgttcgtgatcttcctgatcttctacatgggcaccgtggtgggcaacatgctgatcatcgtgaccatcaagagcagcagaaccctgggcagccccatgtacttcttcctgttctacctgagcttcgccgacagctgcttcagcaccagcaccgcccccagactgatcgtggacgccctgagcgagaagaagatcatcacctacaacgagtgcatgacccaggtgttcgccctgcacctgttcggctgcatggagatcttcgtgctgatcctgatggccgtggacagatacgtggccatctgcaagcccctgagataccccaccatcatgagccagcaggtgtgcatcatcctgatcgtgctggcctggatcggcagcctgatccacagcaccgcccagatcatcctggccctgagactgcccttctgcggcccctacctgatcgaccactactgctgcgacctgcagcccctgctgaagctggcctgcatggacacctacatgatcaacctgctgctggtgagcaacagcggcgccatctgcagcagcagcttcatgatcctgatcatcagctacatcgtgatcctgcacagcctgagaaaccacagcgccaagggcaagaagaaggccctgagcgcctgcaccagccacatcatcgtggtgatcctgttcttcggcccctgcatcttcatctacaccagaccccccaccaccttccccatggacaagatggtggccgtgttctacaccatcggcacccccttcctgaaccccctgatctacaccctgagaaacgccgaggtgaagaacgccatgagaaagctgtggcacggcaagatcatcagcgagaacaagggctag

SEQ ID NO: 20447 - DNA, 930 bp, Artificial Sequence
  Description of Artificial Sequence: Synthetic coding sequence
atggagaagaagaagaacgtgaccgagttcatcctgatcggcctgacccagaaccccatcatggagaaggtgaccttcgtggtgttcctggtgctgtacatgatcaccctgagcggcaacctgctgatcgtggtgaccatcaccaccagccaggccctgagcagccccatgtacttcttcctgacccacctgagcctgatcgacaccgtgtacagcagcagcagcgcccccaagctgatcgtggacagcttccaggagaagaagatcatcagcttcaacggctgcatggcccaggcctacgccgagcacatcttcggcgccaccgagatcatcctgctgaccgtgatggcctgcgactgctacgtggccatctgcaagcccctgaactacaccaccatcatgagccacagcctgtgcatcctgctggtggccgtggcctgggtgggcggcttcctgcacgccaccatccagatcctgttcaccgtgtggctgcccttctgcggccccaacgtgatcggccacttcatgtgcgacctgtaccccctgctgaagctggtgtgcatcgacacccacaccctgggcctgttcgtggccgtgaacagcggcttcatctgcctgctgaacttcctgatcctggtggtgagctacgtgatcatcctgagaagcctgaagaacaacagcctggagggcagatgcaaggccctgagcacctgcatcagccacatcatcgtggtggtgctgttcttcgtgccctgcatcttcgtgtacctgagaagcgtgaccaccctgcccatcgacaaggccgtggccgtgttctacaccatggtggtgcccatgctgaaccccgtggtgtacaccctgagaaacgccgaggtgaagagcgccatcagaaagctgtggagaaagaaggtgaccagcgacaacgactag

SEQ ID NO: 20448 - DNA, 930 bp, Artificial Sequence
  Description of Artificial Sequence: Synthetic coding sequence
atggccaacagaaacaacgtgaccgagttcatcctgctgggcctgaccgagaaccccaagatgcagaagatcatcttcgtggtgttcagcgtgatctacatcaacgccatgatcggcaacgtgctgatcgtggtgaccatcaccgccagccccagcctgagaagccccatgtacttcttcctggcctacctgagcttcatcgacgcctgctacagcagcgtgaacacccccaagctgatcaccgacagcctgtacgagaacaagaccatcctgttcaacggctgcatgacccaggtgttcggcgagcacttcttcagaggcgtggaggtgatcctgctgaccgtgatggcctacgaccactacgtggccatctgcaagcccctgcactacaccaccgtgatgaagcagcacgtgtgcagcctgctggtgggcgtgagctgggtgggcggcttcctgcacgccaccatccagatcctgttcatctgccagctgcccttctgcggccccaacgtgatcgaccacttcatgtgcgacctgtacaccctgatcaacctggcctgcaccaacacccacaccctgggcctgttcatcgccgccaacagcggcttcatctgcctgctgaactgcctgctgctgctggtgagctgcgtggtgatcctgtacagcctgaagacccacagcctggaggccagacacgaggccctgagcacctgcgtgagccacatcaccgtggtgatcctgagcttcatcccctgcatcttcgtgtacatgagaccccccgccaccctgcccatcgacaaggccgtggccgtgttctacaccatgatcaccagcatgctgaaccccctgatctacaccctgagaaacgcccagatgaagaacgccatcagaaagctgtgcagcagaaaggccatcagcagcgtgaagtag

SEQ ID NO: 20449 - DNA, 1113 bp, Artificial Sequence
  Description of Artificial Sequence: Synthetic coding sequence
atgttcagcatgaccaccgaggccctgaacaacttcgccctgggctgcaccaacctgctgatgaccatgatcccccagatcgacctgaagcagatcttcctgtgccccaactgcagactgtacatgatccccgtgggcgccttcatcttcagcctgggcaacatgcagaaccagagcttcgtgaccgagttcgtgctgctgggcctgagccagaaccccaacgtgcaggagatcgtgttcgtggtgttcctgttcgtgtacatcgccaccgtgggcggcaacatgctgatcgtggtgaccatcctgagcagccccgccctgctggtgagccccatgtacttcttcctgggcttcctgagcttcctggacgcctgcttcagcagcgtgatcacccccaagatgatcgtggacagcctgtacgtgaccaagaccatcagcttcgagggctgcatgatgcagctgttcgccgagcacttcttcgccggcgtggaggtgatcgtgctgaccgccatggcctacgacagatacgtggccatctgcaagcccctgcactacagcagcatcatgaacagaagactgtgcggcatcctgatgggcgtggcctggaccggcggcctgctgcacagcatgatccagatcctgttcaccttccagctgcccttctgcggccccaacgtgatcaaccacttcatgtgcgacctgtaccccctgctggagctggcctgcaccgacacccacatcttcggcctgatggtggtgatcaacagcggcttcatctgcatcatcaacttcagcctgctgctggtgagctacgccgtgatcctgctgagcctgagaacccacagcagcgagggcagatggaaggccctgagcacctgcggcagccacatcgccgtggtgatcctgttcttcgtgccctgcatcttcgtgtacaccagaccccccagcgccttcagcctggacaagatggccgccatcttctacatcatcctgaaccccctgctgaaccccctgatctacaccttcagaaacaaggaggtgaagcaggccatgagaagaatctggaacagactgatggtggtgagcgacgagaaggagaacatcaagctgtag

SEQ ID NO: 20450 - DNA, 933 bp, Artificial Sequence
  Description of Artificial Sequence: Synthetic coding sequence
atgcagctgaacaacaacgtgaccgagttcatcctgctgggcctgacccaggaccccttctggaagaagatcgtgttcgtgatcttcctgagactgtacctgggcaccctgctgggcaacctgctgatcatcatcagcgtgaagaccagccaggccctgaagaaccccatgttcttcttcctgttctacctgagcctgagcgacacctgcctgagcaccagcatcacccccagaatgatcgtggacgccctgctgaagaagaccaccatcagcttcagcgagtgcatgatccaggtgttcagcagccacgtgttcggctgcctggagatcttcatcctgatcctgaccgccgtggacagatacgtggacatctgcaagcccctgcactacatgaccatcatcagccagtgggtgtgcggcgtgctgatggccgtggcctgggtgggcagctgcgtgcacagcctggtgcagatcttcctggccctgagcctgcccttctgcggccccaacgtgatcaaccactgcttctgcgacctgcagcccctgctgaagcaggcctgcagcgagacctacgtggtgaacctgctgctggtgagcaacagcggcgccatctgcgccgtgagctacgtgatgctgatcttcagctacgtgatcttcctgcacagcctgagaaaccacagcgccgaggtgatcaagaaggccctgagcacctgcgtgagccacatcatcgtggtgatcctgttcttcggcccctgcatcttcatgtacacctgcctggccaccgtgttccccatggacaagatgatcgccgtgttctacaccgtgggcaccagcttcctgaaccccgtgatctacaccctgaagaacaccgaggtgaagagcgccatgagaaagctgtggagcaagaagctgatcaccgacgacaagagatag

SEQ ID NO: 20451 - DNA, 990 bp, Artificial Sequence
  Description of Artificial Sequence: Synthetic coding sequence
atgcagctggtgctgctgctgatgttcctgctggtgttcatcggcaacaccgcccccgccttcagcgtgaccctggagagcatggacatcccccagaacatcaccgagttcttcatgctgggcctgagccagaacagcgaggtgcagagagtgctgttcgtggtgttcctgctgatctacgtggtgaccgtgtgcggcaacatgctgatcgtggtgaccatcaccagcagccccaccctggccagccccgtgtacttcttcctggccaacctgagcttcatcgacaccttctacagcagcagcatggcccccaagctgatcgccgacagcctgtacgagggcagaaccatcagctacgagtgctgcatggcccagctgttcggcgcccacttcctgggcggcgtggagatcatcctgctgaccgtgatggcctacgacagatacgtggccatctgcaagcccctgcacaacaccaccatcatgaccagacacctgtgcgccatgctggtgggcgtggcctggctgggcggcttcctgcacagcctggtgcagctgctgctggtgctgtggctgcccttctgcggccccaacgtgatcaaccacttcgcctgcgacctgtaccccctgctggaggtggcctgcaccaacacctacgtgatcggcctgctggtggtggccaacagcggcctgatctgcctgctgaacttcctgatgctggccgccagctacatcgtgatcctgtacagcctgagaagccacagcgccgacggcagatgcaaggccctgagcacctgcggcgcccacttcatcgtggtggccctgttcttcgtgccctgcatcttcacctacgtgcaccccttcagcaccctgcccatcgacaagaacatggccctgttctacggcatcctgacccccatgctgaaccccctgatctacaccctgagaaacgaggaggtgaagaacgccatgagaaagctgttcacctggtag

SEQ ID NO: 20452 - DNA, 603 bp, Artificial Sequence
  Description of Artificial Sequence: Synthetic coding sequence
atcctgctgaccgtgatggcctacgacagatacgtggccatctgcaagcccctgcacaacaccaccatcatgaccagacacctgtgcgccatgctggtgggcgtggcctggctgggcggcttcctgcacagcctggtgcagctgctgctggtgctgtggctgcccttctgcggccccaacgtgatcaaccacttcgcctgcgacctgtaccccctgctggaggtggcctgcaccaacacctacgtgatcggcctgctggtggtggccaacagcggcctgatctgcctgctgaacttcctgatgctggccgccagctacatcgtgatcctgtacagcctgagaagccacagcgccgacggcagatgcaaggccctgagcacctgcggcgcccacttcatcgtggtggccctgttcttcgtgccctgcatcttcacctacgtgcaccccttcagcaccctgcccatcgacaagaacatggccctgttctacggcatcctgacccccatgctgaaccccctgatctacaccctgagaaacgaggaggtgaagaacaacaccatcaagcacttctggaagcacatcctggaggaggacaagacctag

SEQ ID NO: 20453 - DNA, 981 bp, Artificial Sequence
  Description of Artificial Sequence: Synthetic coding sequence
atgtacgtgagcaactgcaacccctgcgccatccacagaaagatcaactaccccaacaccaagctggacttcgagcaggtgaacaacatcaccgagttcatcctgctgggcctgacccagaacgccgaggcccagaagctgctgttcgccgtgttcaccctgatctacttcctgaccatggtggacaacctgatcatcgtggtgaccatcaccaccagccccgccctggacagccccgtgtacttcttcctgagcttcttcagcttcatcgacggctgcagcagcagcaccatggcccccaagatgatcttcgacctgctgaccgagaagaagaccatcagcttcagcggctgcatgacccagctgttcgtggagcacttcttcggcggcgtggagatcatcctgctggtggtgatggcctacgactgctacgtggccatctgcaagcccctgtactacctgatcaccatgaacagacaggtgtgcggcctgctggtggccatggcctgggtgggcggcttcctgcacgccctgatccagatgctgctgatcgtgtggctgcccttctgcggccccaacgtgatcgaccacttcatctgcgacctgttccccctgctgaagctgagctgcaccgacacccacgtgttcggcctgttcgtggccgccaacagcggcctgatgtgcatgctgatcttcagcatcctgatcaccagctacgtgctgatcctgtgcagccagagaaaggccctgagcacctgcgccttccacatcaccgtggtggtgctgttcttcgtgccctgcatcctggtgtacctgagacccatgatcaccttccccatcgacaaggccgtgagcgtgttctacaccgtggtgacccccatgctgaaccccctgatctacaccctgagaaacaccgaggtgaagaacgccatgaagcagctgtggagccagatcatctggggcaacaacctgtgcgactag

SEQ ID NO: 20454 - DNA, 930 bp, Artificial Sequence
  Description of Artificial Sequence: Synthetic coding sequence
atggagaaccagaacaacgtgaccgagttcatcctgctgggcctgaccgagaacctggagctgtggaagatcttcagcgccgtgttcctggtgatgtacgtggccaccgtgctggagaacctgctgatcgtggtgaccatcatcaccagccagagcctgagaagccccatgtacttcttcctgaccttcctgagcctgctggacgtgatgttcagcagcgtggtggcccccaaggtgatcgtggacaccctgagcaagagcaccaccatcagcctgaagggctgcctgacccagctgttcgtggagcacttcttcggcggcgtgggcatcatcctgctgaccgtgatggcctacgacagatacgtggccatctgcaagcccctgcactacaccatcatcatgagccccagagtgtgctgcctgatggtgggcggcgcctgggtgggcggcttcatgcacgccatgatccagctgctgttcatgtaccagatccccttctgcggccccaacatcatcgaccacttcatctgcgacctgttccagctgctgaccctggcctgcaccgacacccacatcctgggcctgctggtgaccctgaacagcggcatgatgtgcgtggccatcttcctgatcctgatcgccagctacaccgtgatcctgtgcagcctgaagagctacagcagcaagggcagacacaaggccctgagcacctgcagcagccacctgaccgtggtggtgctgttcttcgtgccctgcatcttcctgtacatgagacccgtggtgacccaccccatcgacaaggccatggccgtgagcgacagcatcatcacccccatgctgaaccccctgatctacaccctgagaaacgccgaggtgaagagcgccatgaagaagctgtggatgaagtgggaggccctggccggcaagtag

SEQ ID NO: 20455 - DNA, 933 bp, Artificial Sequence
  Description of Artificial Sequence: Synthetic coding sequence
atggagccccagaacaccacccaggtgagcatgttcgtgctgctgggcttcagccagacccaggagctgcagaagttcctgttcctgctgttcctgctggtgtacgtgaccaccatcgtgggcaacctgctgatcatggtgaccgtgaccttcgactgcagactgcacacccccatgtacttcctgctgagaaacctggccctgatcgacctgtgctacagcaccgtgaccagccccaagatgctggtggacttcctgcacgagaccaagaccatcagctaccagggctgcatggcccagatcttcttcttccacctgctgggcggcggcaccgtgttcttcctgagcgtgatggcctacgacagatacatcgccatcagccagcccctgagatacgtgaccatcatgaacacccagctgtgcgtgggcctggtggtggccgcctgggtgggcggcttcgtgcacagcatcgtgcagctggccctgatcctgcccctgcccttctgcggccccaacatcctggacaacttctactgcgacgtgccccaggtgctgagactggcctgcaccgacaccagcctgctggagttcctgatgatcagcaacagcggcctgctggtgatcatctggttcctgctgctgctgatcagctacaccgtgatcctggtgatgctgagaagccacagcggcaaggccagaagaaaggccgccagcacctgcaccacccacatcatcgtggtgagcatgatcttcatcccctgcatctacatctacacctggcccttcacccccttcctgatggacaaggccgtgagcatcagctacaccgtgatgacccccatgctgaaccccatgatctacaccctgagaaaccaggacatgaaggccgccatgagaagactgggcaagtgcctggtgatctgcagagagtag

SEQ ID NO: 20456 - DNA, 936 bp, Artificial Sequence
  Description of Artificial Sequence: Synthetic coding sequence
atggagatggagaactgcaccagagtgaaggagttcatcttcctgggcctgacccagaacagagaggtgagcctggtgctgttcctgttcctgctgctggtgtacgtgaccaccctgctgggcaacctgctgatcatggtgaccgtgacctgcgagagcagactgcacacccccatgtacttcctgctgcacaacctgagcatcgccgacatctgcttcagcagcatcaccgtgcccaaggtgctggtggacctgctgagcgagagaaagaccatcagcttcaaccactgcttcacccagatgttcctgttccacctgatcggcggcgtggacgtgttcagcctgagcgtgatggccctggacagatacgtggccatcagcaagcccctgcactacgccaccatcatgagcagagaccactgcatcggcctgaccgtggccgcctggctgggcggcttcgtgcacagcatcgtgcagatcagcctgctgctgcccctgcccttctgcggccccaacgtgctggacaccttctactgcgacgtgcacagagtgctgaagctggcccacaccgacatcttcatcctggagctgctgatgatcagcaacaacggcctgctgaccaccctgtggttcttcctgctgctggtgagctacatcgtgatcctgagcctgcccaagagccaggccggcgagggcagaagaaaggccatcagcacctgcaccagccacatcaccgtggtgaccctgcacttcgtgccctgcatctacgtgtacgccagacccttcaccgccctgcccatggacaaggccatcagcgtgaccttcaccgtgatcagccccctgctgaaccccctgatctacaccctgagaaaccacgagatgaagagcgccatgagaagactgaagagaagactggtgcccagcgacagaaagtag

SEQ ID NO: 20457 - DNA, 936 bp, Artificial Sequence
  Description of Artificial Sequence: Synthetic coding sequence
atggagctgggcaacgtgaccagagtgaaggagttcatcttcctgggcctgacccagagccaggaccagagcctggtgctgttcctgttcctgtgcctggtgtacatgaccaccctgctgggcaacctgctgatcatggtgaccgtgacctgcgagagcagactgcacacccccatgtacttcctgctgagaaacctggccatcctggacatctgcttcagcagcaccaccgcccccaaggtgctgctggacctgctgagcaagaagaagaccatcagctacaccagctgcatgacccagatcttcctgttccacctgctgggcggcgccgacatcttcagcctgagcgtgatggccttcgactgctacatggccatcagcaagcccctgcactacgtgaccatcatgagcagaggccagtgcaccgccctgatcagcgccagctggatgggcggcttcgtgcacagcatcgtgcagatcagcctgctgctgcccctgcccttctgcggccccaacgtgctggacaccttctactgcgacgtgccccaggtgctgaagctgacctgcaccgacaccttcgccctggagttcctgatgatcagcaacaacggcctggtgaccaccctgtggttcatcttcctgctggtgagctacaccgtgatcctgatgaccctgagaagccaggccggcggcggcagaagaaaggccatcagcacctgcaccagccacatcaccgtggtgaccctgcacttcgtgccctgcatctacgtgtacgccagacccttcaccgccctgcccaccgagaaggccatcagcgtgaccttcaccgtgatcagccccctgctgaaccccctgatctacaccctgagaaaccaggagatgaagagcgccatgagaagactgaagagaagactggtgcccagcgagagagagtag

SEQ ID NO: 20458 - DNA, 924 bp, Artificial Sequence
  Description of Artificial Sequence: Synthetic coding sequence
atggagaccggcaacctgacctgggtgagcgacttcgtgttcctgggcctgagccagaccagagagctgcagagattcctgttcctgatgttcctgttcgtgtacatcaccaccgtgatgggcaacatcctgatcatcatcaccgtgaccagcgacagccagctgcacacccccatgtacttcctgctgagaaacctggccgtgctggacctgtgcttcagcagcgtgaccgcccccaagatgctggtggacctgctgagcgagaagaagaccatcagctaccagggctgcatgggccagatcttcttcttccacttcctgggcggcgccatggtgttcttcctgagcgtgatggccttcgacagactgatcgccatcagcagacccctgagatacgtgaccgtgatgaacacccagctgtgggtgggcctggtggtggccacctgggtgggcggcttcgtgcacagcatcgtgcagctggccctgatgctgcccctgcccttctgcggccccaacatcctggacaacttctactgcgacgtgccccaggtgctgagactggcctgcaccgacaccagcctgctggagttcctgaagatcagcaacagcggcctgctggacgtggtgtggttcttcctgctgctgatgagctacctgttcatcctggtgatgctgagaagccaccccggcgaggccagaagaaaggccgccagcacctgcaccacccacatcatcgtggtgagcatgatcttcgtgcccagcatctacctgtacgccagacccttcacccccttccccatggacaagctggtgagcatcggccacaccgtgatgacccccatgctgaaccccatgatctacaccctgagaaaccaggacatgcaggccgccgtgagaagactgggcagacacagactggtgtag

SEQ ID NO: 20459 - DNA, 957 bp, Artificial Sequence
  Description of Artificial Sequence: Synthetic coding sequence
atgaaccccgccaaccacagccaggtggccggcttcgtgctgctgggcctgagccaggtgtgggagctgagattcgtgttcttcaccgtgttcagcgccgtgtacttcatgaccgtggtgggcaacctgctgatcgtggtgatcgtgaccagcgacccccacctgcacaccaccatgtacttcctgctgggcaacctgagcttcctggacttctgctacagcagcatcaccgcccccagaatgctggtggacctgctgagcggcaaccccaccatcagcttcggcggctgcctgacccagctgttcttcttccacttcatcggcggcatcaagatcttcctgctgaccgtgatggcctacgacagatacatcgccatcagccagcccctgcactacaccctgatcatgaaccagaccgtgtgcgccctgctgatggccgccagctgggtgggcggcttcatccacagcatcgtgcagatcgccctgaccatccagctgcccttctgcggccccgacaagctggacaacttctactgcgacgtgccccagctgatcaagctggcctgcaccgacaccttcgtgctggagctgctgatggtgagcaacaacggcctggtgaccctgatgtgcttcctggtgctgctgggcagctacaccgccctgctggtgatgctgagaagccacagcagagagggcagaagcaaggccctgagcacctgcgccagccacatcgccgtggtgaccctgatcttcgtgccctgcatctacgtgtacaccagacccttcagaaccttccccatggacaaggccgtgagcgtgctgtacaccatcgtgacccccatgctgaaccccgccatctacaccctgagaaacaaggaggtgatcatggccatgaagaagctgtggagaagaaagaaggaccccatcggccccctggagcacagacccctgcactag

SEQ ID NO: 20460 - DNA, 945 bp, Artificial Sequence
  Description of Artificial Sequence: Synthetic coding sequence
atggaccagatcaaccacaccaacgtgaaggagttcttcttcctggagctgaccagaagcagagagctggagttcttcctgttcgtggtgttcttcgccgtgtacgtggccaccgtgctgggcaacgccctgatcgtggtgaccatcacctgcgagagcagactgcacacccccatgtacttcctgctgagaaacaagagcgtgctggacatcgtgttcagcagcatcaccgtgcccaagttcctggtggacctgctgagcgacagaaagaccatcagctacaacgactgcatggcccagatcttcttcttccacttcgccggcggcgccgacatcttcttcctgagcgtgatggcctacgacagatacctggccatcgccaagcccctgcactacgtgaccatgatgagaaaggaggtgtgggtggccctggtggtggccagctgggtgagcggcggcctgcacagcatcatccaggtgatcctgatgctgcccttccccttctgcggccccaacaccctggacgccttctactgctacgtgctgcaggtggtgaagctggcctgcaccgacaccttcgccctggagctgttcatgatcagcaacaacggcctggtgaccctgctgtggttcctgctgctgctgggcagctacaccgtgatcctggtgatgctgagaagccacagcggcgagggcagaaacaaggccctgagcacctgcaccagccacatgctggtggtgaccctgcacttcgtgccctgcgtgtacatctactgcagacccttcatgaccctgcccatggacaccaccatcagcatcaacaacaccgtgatcacccccatgctgaaccccatcatctacagcctgagaaaccaggagatgaagagcgccatgcagagactgcagagaagactgggccccagcgagagcagaaagtggggctag

SEQ ID NO: 20461 - DNA, 945 bp, Artificial Sequence
  Description of Artificial Sequence: Synthetic coding sequence
atggaccagagaaactacaccagagtgaaggagttcaccttcctgggcatcacccagagcagagagctgagccaggtgctgttcaccttcctgttcctggtgtacatgaccaccctgatgggcaacttcctgatcatggtgaccgtgacctgcgagagccacctgcacacccccatgtacttcctgctgagaaacctgagcatcctggacatctgcttcagcagcatcaccgcccccaaggtgctgatcgacctgctgagcgagaccaagaccatcagcttcagcggctgcgtgacccagatgttcttcttccacctgctgggcggcgccgacgtgttcagcctgagcgtgatggccttcgacagatacatcgccatcagcaagcccctgcactacatgaccatcatgagcagaggcagatgcaccggcctgatcgtggccagctgggtgggcggcttcgtgcacagcatcgcccagatcagcctgctgctgcccctgcccttctgcggccccaacgtgctggacaccttctactgcgacgtgccccaggtgctgaagctggcctgcaccgacaccttcaccctggagctgctgatgatcagcaacaacggcctggtgagctggttcgtgttcttcttcctgctgatcagctacaccgtgatcctgatgatgctgagaagccacaccggcgagggcagaagaaaggccatcagcacctgcaccagccacatcaccgtggtgaccctgcacttcgtgccctgcatctacgtgtacgccagacccttcaccgccctgcccaccgacaccgccatcagcgtgaccttcaccgtgatcagccccctgctgaaccccatcatctacaccctgagaaaccaggagatgaagctggccatgagaaagctgaagagaagactgggccagagcgagagaatcctgatccagtag

SEQ ID NO: 20462 - DNA, 942 bp, Artificial Sequence
  Description of Artificial Sequence: Synthetic coding sequence
atggacagcctgaaccagaccagagtgaccgagttcgtgttcctgggcctgaccgacaacagagtgctggagatgctgttcttcatggccttcagcgccatctacatgctgaccctgagcggcaacatcctgatcatcatcgccaccgtgttcacccccagcctgcacacccccatgtacttcttcctgagcaacctgagcttcatcgacatctgccacagcagcgtgaccgtgcccaagatgctggagggcctgctgctggagagaaagaccatcagcttcgacaactgcatcacccagctgttcttcctgcacctgttcgcctgcgccgagatcttcctgctgatcatcgtggcctacgacagatacgtggccatctgcacccccctgcactaccccaacgtgatgaacatgagagtgtgcatccagctggtgttcgccctgtggctgggcggcaccgtgcacagcctgggccagaccttcctgaccatcagactgccctactgcggccccaacatcatcgacagctacttctgcgacgtgcccctggtgatcaagctggcctgcaccgacacctacctgaccggcatcctgatcgtgaccaacagcggcaccatcagcctgagctgcttcctggccgtggtgaccagctacatggtgatcctggtgagcctgagaaagcacagcgccgagggcagacagaaggccctgagcacctgcagcgcccacttcatggtggtggccctgttcttcggcccctgcatcttcatctacaccagacccgacaccagcttcagcatcgacaaggtggtgagcgtgttctacaccgtggtgacccccctgctgaaccccttcatctacaccctgagaaacgaggaggtgaagagcgccatgaagcagctgagacagagacaggtgttcttcaccaagagctacacctag

SEQ ID NO: 20463 - DNA, 939 bp, Artificial Sequence
  Description of Artificial Sequence: Synthetic coding sequence
atgaacggcatgaaccacagcgtggtgagcgagttcgtgttcatgggcctgaccaacagcagagagatccagctgctgctgttcgtgttcagcctgctgttctacttcgccagcatgatgggcaacctggtgatcgtgttcaccgtgaccatggacgcccacctgcacagccccatgtacttcctgctggccaacctgagcatcatcgacatggccttctgcagcatcaccgcccccaagatgatctgcgacatcttcaagaagcacaaggccatcagcttcagaggctgcatcacccagatcttcttcagccacgccctgggcggcaccgagatggtgctgctgatcgccatggccttcgacagatacatggccatctgcaagcccctgcactacctgaccatcatgagccccagaatgtgcctgtacttcctggccaccagcagcatcatcggcctgatccacagcctggtgcagctggtgttcgtggtggacctgcccttctgcggccccaacatcttcgacagcttctactgcgacctgcccagactgctgagactggcctgcaccaacacccaggagctggagttcatggtgaccgtgaacagcggcctgatcagcgtgggcagcttcgtgctgctggtgatcagctacatcttcatcctgttcaccgtgtggaagcacagcagcggcggcctggccaaggccctgagcaccctgagcgcccacgtgaccgtggtgatcctgttcttcggccccctgatgttcttctacacctggcccagccccaccagccacctggacaagtacctggccatcttcgacgccttcatcacccccttcctgaaccccgtgatctacaccttcagaaacaaggacatgaaggtggccatgagaagactgtgcagcagactggcccacttcaccaagatcctgtag

SEQ ID NO: 20464 - DNA, 939 bp, Artificial Sequence
  Description of Artificial Sequence: Synthetic coding sequence
atggacggcgagaaccacagcgtggtgagcgagttcctgttcctgggcctgacccacagctgggagatccagctgctgctgctggtgttcagcagcgtgctgtacgtggccagcatcaccggcaacatcctgatcgtgttcagcgtgaccaccgacccccacctgcacagccccatgtacttcctgctggccagcctgagcttcatcgacctgggcgcctgcagcgtgaccagccccaagatgatctacgacctgttcagaaagagaaaggtgatcagcttcggcggctgcatcgcccagatcttcttcatccacgtggtgggcggcgtggagatggtgctgctgatcgccatggccttcgacagatacgtggccctgtgcaagcccctgcactacctgaccatcatgagccccagaatgtgcctgagcttcctggccgtggcctggaccctgggcgtgagccacagcctgttccagctggccttcctggtgaacctggccttctgcggccccaacgtgctggacagcttctactgcgacctgcccagactgctgagactggcctgcaccgacacctacagactgcagttcatggtgaccgtgaacagcggcttcatctgcgtgggcaccttcttcatcctgctgatcagctacgtgttcatcctgttcaccgtgtggaagcacagcagcggcggcagcagcaaggccctgagcaccctgagcgcccacagcaccgtggtgctgctgttcttcggcccccccatgttcgtgtacaccagaccccaccccaacagccagatggacaagttcctggccatcttcgacgccgtgctgacccccttcctgaaccccgtggtgtacaccttcagaaacaaggagatgaaggccgccatcaagagagtgtgcaagcagctggtgatctacaagagaatcagctag

SEQ ID NO: 20465 - DNA, 918 bp, Artificial Sequence
  Description of Artificial Sequence: Synthetic coding sequence
atggtgaccgagttcatcttcctgggcctgagcgacagccagggcctgcagaccttcctgttcatgctgttcttcgtgttctacggcggcatcgtgttcggcaacctgctgatcgtgatcaccgtggtgagcgacagccacctgcacagccccatgtacttcctgctggccaacctgagcctgatcgacctgagcctgagcagcgtgaccgcccccaagatgatcaccgacttcttcagccagagaaaggtgatcagcttcaagggctgcctggtgcagatcttcctgctgcacttcttcggcggcagcgagatggtgatcctgatcgccatgggcttcgacagatacatcgccatctgcaagcccctgcactacaccaccatcatgtgcggcaacgcctgcgtgggcatcatggccgtggcctggggcatcggcttcctgcacagcgtgagccagctggccttcgccgtgcacctgcccttctgcggccccaacgaggtggacagcttctactgcgacctgcccagagtgatcaagctggcctgcaccgacacctacagactggacatcatggtgatcgccaacagcggcgtgctgaccgtgtgcagcttcgtgctgctgatcatcagctacaccatcatcctgatgaccatccagcacagacccctggacaagagcagcaaggccctgagcaccctgaccgcccacatcaccgtggtgctgctgttcttcggcccctgcgtgttcatctacgcctggcccttccccatcaagagcctggacaagttcctggccgtgttctacagcgtgatcacccccctgctgaaccccatcatctacaccctgagaaacaaggacatgaagaccgccatcagacagctgagaaagtgggacgcccacagcagcgtgaagttctag

SEQ ID NO: 20466 - DNA, 885 bp, Artificial Sequence
  Description of Artificial Sequence: Synthetic coding sequence
agccccggccccgtgttcagctaccccccccccagcctgctgttcatcatccccgtgaagctgggcctggagcacttcttccacatcaaggtgaccgccgaggccatcagctggaacgagagcaccagcgagaccaacaacagcatggtgaccgagttcatcttcctgggcctgagcgacagccagggcctgcagaccttcctgttcatgctgttcttcgtgttctacggcggcatcgtgttcggcaacctgctgatcgtgatcaccgtggtgagcgacagccacctgcacagccccatgtacttcctgctggccaacctgagcctgatcgacctgagcctgagcagcgtgaccgcccccaagatgatcaccgacttcttcagccagagaaaggtgatcagcttcaagggctgcctggtgcagatcttcctgctgcacttcttcggcggcagcgagatggtgatcctgatcgccatgggcttcgacagatacatcgccatctgcaagcccctgcactacaccaccatcatgtgcggcaacgcctgcgtgggcatcatggccgtggcctggggcatcggcttcctgcacagcgtgagccagctggccttcgccgtgcacctgcccttctgcggccccaacgaggtggacagcttctactgcgacctgcccagagtgatcaagctggcctgcaccgacacctacagactggacatcatggtgatcgccaacagcggcgtgctgaccgtgtgcagcttcgtgctgctgatcatcagctacaccatcatcctgatgaccatccagcacagacccctggacaagagcagcaaggccctgagcaccctgaccgcccacatcaccgtggtgctgctgttcttcggcccctag

SEQ ID NO: 20467 - DNA, 939 bp, Artificial Sequence
  Description of Artificial Sequence: Synthetic coding sequence
atggacggcgagaaccacagcgtggtgagcgagttcctgttcctgggcctgacccacagctgggagatccagctgctgctgctggtgttcagcagcgtgctgtacgtggccagcatcaccggcaacatcttcatcgtgttcagcgtgaccaccgacccccacctgcacagccccatgtacttcctgctggccagcctgagcttcatcgacctgggcgcctgcagcgtgaccagccccaagatgatctacgacctgttcagaaagagaaaggtgatcagcttcggcggctgcatcgcccagatcttcttcatccacgtgatcggcggcgtggagatggtgctgctgatcgccatggccttcgacagatacgtggccctgtgcaagcccctgcactacctgaccatcatgagccccagaatgtgcctgagcttcctggccgtggcctggaccctgggcgtgagccacagcctgttccagctggccttcctggtgaacctggccttctgcggccccaacgtgctggacagcttctactgcgacctgcccagactgctgagactggcctgcaccgacacctacagactgcagttcatggtgaccgtgaacagcggcttcatctgcgtgggcaccttcttcatcctgctgatcagctacgtgttcatcctgttcaccgtgtggaagcacagcagcggcggcagcagcaaggccctgagcaccctgagcgcccacagcaccgtggtgctgctgttcttcggcccccccatgttcgtgtacaccagaccccaccccaacagccagatggacaagttcctggccatcttcgacgccgtgctgacccccttcctgaaccccgtggtgtacaccttcagaaacaaggagatgaaggccgccatcaagagagtgtgcaagcagctggtgatctacaagaagatcagctag

SEQ ID NO: 20468 - DNA, 939 bp, Artificial Sequence; identical to SEQ ID NO: 20464
  Description of Artificial Sequence: Synthetic coding sequence

SEQ ID NO: 20469 - DNA, 939 bp, Artificial Sequence; identical to SEQ ID NO: 20464
  Description of Artificial Sequence: Synthetic coding sequence

SEQ ID NO: 20470 - DNA, 918 bp, Artificial Sequence
  Description of Artificial Sequence: Synthetic coding sequence
atggtgaccgagttcatcttcctgggcctgagcgacagccaggagctgcagaccttcctgttcatgctgttcttcgtgttctacggcggcatcgtgttcggcaacctgctgatcgtgatcaccgtggtgagcgacagccacctgcacagccccatgtacttcctgctggccaacctgagcctgatcgacctgagcctgagcagcgtgaccgcccccaagatgatcaccgacttcttcagccagagaaaggtgatcagcttcaagggctgcctggtgcagatcttcctgctgcacttcttcggcggcagcgagatggtgatcctgatcgccatgggcttcgacagatacatcgccatctgcaagcccctgcactacaccaccatcatgtgcggcaacgcctgcgtgggcatcatggccgtggcctggggcatcggcttcctgcacagcgtgagccagctggccttcgccgtgcacctgcccttctgcggccccaacgaggtggacagcttctactgcgacctgcccagagtgatcaagctggcctgcaccgacacctacagactggacatcatggtgatcgccaacagcggcgtgctgaccgtgtgcagcttcgtgctgctgatcatcagctacaccatcatcctgatgaccatccagcactgccccctggacaagagcagcaaggccctgagcaccctgaccgcccacatcaccgtggtgctgctgttcttcggcccctgcgtgttcatctacgcctggcccttccccatcaagagcctggacaagttcctggccgtgttctacagcgtgatcacccccctgctgaaccccatcatctacaccctgagaaacaaggacatgaagaccgccatcagaagactgagaaagtgggacgcccacagcagcgtgaagttctag

SEQ ID NO: 20471 - DNA, 918 bp, Artificial Sequence
  Description of Artificial Sequence: Synthetic coding sequence
atggtgaccgagttcatcttcctgggcctgagcgacagccaggagctgcagaccttcctgttcatgctgttcttcgtgttctacggcggcatcgtgttcggcaacctgctgatcgtgatcaccgtggtgagcgacagccacctgcacagccccatgtacttcctgctggccaacctgagcctgatcgacctgagcctgagcagcgtgaccgcccccaagatgatcaccgacttcttcagccagagaaaggtgatcagcttcaagggctgcctggtgcagatcttcctgctgcacttcttcggcggcagcgagatggtgatcctgatcgccatgggcttcgacagatacatcgccatctgcaagcccctgcactacaccaccatcatgtgcggcaacgcctgcgtgggcatcatggccgtgacctggggcatcggcttcctgcacagcgtgagccagctggccttcgccgtgcacctgctgttctgcggccccaacgaggtggacagcttctactgcgacctgcccagagtgatcaagctggcctgcaccgacacctacagactggacatcatggtgatcgccaacagcggcgtgctgaccgtgtgcagcttcgtgctgctgatcatcagctacaccatcatcctgatgaccatccagcacagacccctggacaagagcagcaaggccctgagcaccctgaccgcccacatcaccgtggtgctgctgttcttcggcccctgcgtgttcatctacgcctggcccttccccatcaagagcctggacaagttcctggccgtgttctacagcgtgatcacccccctgctgaaccccatcatctacaccctgagaaacaaggacatgaagaccgccatcagacagctgagaaagtgggacgcccacagcagcgtgaagttctag

SEQ ID NO: 20472 - DNA, 939 bp, Artificial Sequence
  Description of Artificial Sequence: Synthetic coding sequence
atggacgaggccaaccacagcgtggtgagcgagttcgtgttcctgggcctgagcgacagcagaaagatccagctgctgctgttcctgttcttcagcgtgttctacgtgagcagcctgatgggcaacctgctgatcgtgctgaccgtgaccagcgaccccagactgcagagccccatgtacttcctgctggccaacctgagcatcatcaacctggtgttctgcagcagcaccgcccccaagatgatctacgacctgttcagaaagcacaagaccatcagcttcggcggctgcgtggtgcagatcttcttcatccacgccgtgggcggcaccgagatggtgctgctgatcgccatggccttcgacagatacgtggccatctgcaagcccctgcactacctgaccatcatgaacccccagagatgcatcctgttcctggtgatcagctggatcatcggcatcatccacagcgtgatccagctggccttcgtggtggacctgctgttctgcggccccaacgagctggacagcttcttctgcgacctgcccagattcatcaagctggcctgcatcgagacctacaccctgggcttcatggtgaccgccaacagcggcttcatcagcctggccagcttcctgatcctgatcatcagctacatcttcatcctggtgaccgtgcagaagaagagcagcggcggcatcttcaaggccttcagcatgctgagcgcccacgtgatcgtggtggtgctggtgttcggccccctgatcttcttctacatcttccccttccccaccagccacctggacaagttcctggccatcttcgacgccgtgatcacccccgtgctgaaccccgtgatctacaccttcagaaacaaggagatgatggtggccatgagaagaagatgcagccagttcgtgaactacagcaagatcttctag

SEQ ID NO: 20473 - DNA, 936 bp, Artificial Sequence
  Description of Artificial Sequence: Synthetic coding sequence
atggcccacaccaacgagagcatggtgagcgagttcgtgctgctgggcctgagcaacagctggggcctgcagctgttcttcttcgccatcttcagcatcgtgtacgtgaccagcgtgctgggcaacgtgctgatcatcgtgatcatcagcttcgacagccacctgaacagccccatgtacttcctgctgagcaacctgagcttcatcgacatctgccagagcaacttcgccacccccaagatgctggtggacttcttcatcgagagaaagaccatcagcttcgagggctgcatggcccagatcttcgtgctgcacagcttcgtgggcagcgagatgatgctgctggtggccatggcctacgacagattcatcgccatctgcaagcccctgcactacagcaccatcatgaacagaagactgtgcgtgatcttcgtgagcatcagctgggccgtgggcgtgctgcacagcgtgagccacctggccttcaccgtggacctgcccttctgcggccccaacgaggtggacagcttcttctgcgacctgcccctggtgatcgagctggcctgcatggacacctacgagatggagatcatgaccctgaccaacagcggcctgatcagcctgagctgcttcctggccctgatcatcagctacaccatcatcctgatcggcgtgagatgcagaagcagcagcggcagcagcaaggccctgagcaccctgaccgcccacatcaccgtggtgatcctgttcttcggcccctgcatctacttctacatctggcccttcagcagactgcccgtggacaagttcctgagcgtgttctacaccgtgtgcacccccctgctgaaccccatcatctacagcctgagaaacgaggacgtgaaggccgccatgtggaagctgagaaacagacacgtgaacagctggaagaactag

SEQ ID NO: 20474 - DNA, 915 bp, Artificial Sequence
  Description of Artificial Sequence: Synthetic coding sequence
atggagagagccaaccacagcgtggtgagcgagttcatcctgctgggcctgagcaagagccagaacctgcagatcctgttcttcctgggcttcagcgtggtgttcgtgggcatcgtgctgggcaacctgctgatcctggtgaccgtgaccttcgacagcctgctgcacacccccatgtacttcctgctgagcaacctgagctgcatcgacatgatcctggccagcttcgccacccccaagatgatcgtggacttcctgagagagagaaagaccatcagctggtggggctgctacagccagatgttcttcatgcacctgctgggcggcagcgagatgatgctgctggtggccatggccatcgacagatacgtggccatctgcaagcccctgcactacatgaccatcatgagccccagagtgctgaccggcctgctgctgagcagctacgccgtgggcttcgtgcacagcagcagccagatggccttcatgctgaccctgcccttctgcggccccaacgtgatcgacagcttcttctgcgacctgcccctggtgatcaagctggcctgcaaggacacctacatcctgcagctgctggtgatcgccgacagcggcctgctgagcctggtgtgcttcctgctgctgctggtgagctacggcgtgatcatcttcagcgtgagatacagagccgccagcagaagcagcaaggccttcagcaccctgagcgcccacatcaccgtggtgaccctgttcttcgccccctgcgtgttcatctacgtgtggcccttcagcagatacagcgtggacaagatcctgagcgtgttctacaccatcttcacccccctgctgaaccccatcatctacaccctgagaaaccaggaggtgaaggccgccatcaagaagagactgtgcatctag

SEQ ID NO: 20475 - DNA, 933 bp, Artificial Sequence
  Description of Artificial Sequence: Synthetic coding sequence
atggacccccagaactacagcctggtgagcgagttcgtgctgcacggcctgtgcaccagcagacacctgcagaacttcttcttcatcttcttcttcggcgtgtacgtggccatcatgctgggcaacctgctgatcctggtgaccgtgatcagcgacccctgcctgcacagcagccccatgtacttcctgctgggcaacctggccttcctggacatgtggctggccagcttcgccacccccaagatgatcagagacttcctgagcgaccagaagctgatcagcttcggcggctgcatggcccagatcttcttcctgcacttcaccggcggcgccgagatggtgctgctggtgagcatggcctacgacagatacgtggccatctgcaagcccctgcactacatgaccctgatgagctggcagacctgcatcagactggtgctggccagctgggtggtgggcttcgtgcacagcatcagccaggtggccttcaccgtgaacctgccctactgcggccccaacgaggtggacagcttcttctgcgacctgcccctggtgatcaagctggcctgcatggacacctacgtgctgggcatcatcatgatcagcgacagcggcctgctgagcctgagctgcttcctgctgctgctgatcagctacaccgtgatcctgctggccatcagacagagagccgccggcagcaccagcaaggccctgagcacctgcagcgcccacatcatggtggtgaccctgttcttcggcccctgcatcttcgtgtacgtgagacccttcagcagattcagcgtggacaagctgctgagcgtgttctacaccatcttcacccccctgctgaaccccatcatctacaccctgagaaacgaggagatgaaggccgccatgaagaagctgcagaacagaagagtgaccttccagtag

SEQ ID NO: 20476 - DNA, 1047 bp, Artificial Sequence
  Description of Artificial Sequence: Synthetic coding sequence
atgctgaccagcctgaccgacctgtgcttcagccccatccaggtggccgagatcaagagcctgcccaagagcatgaacgagaccaaccacagcagagtgaccgagttcgtgctgctgggcctgagcagcagcagagagctgcagcccttcctgttcctgaccttcagcctgctgtacctggccatcctgctgggcaacttcctgatcatcctgaccgtgaccagcgacagcagactgcacacccccatgtacttcctgctggccaacctgagcttcatcgacgtgtgcgtggccagcttcgccacccccaagatgatcgccgacttcctggtggagagaaagaccatcagcttcgacgcctgcctggcccagatcttcttcgtgcacctgttcaccggcagcgagatggtgctgctggtgagcatggcctacgacagatacgtggccatctgcaagcccctgcactacatgaccgtgatgagcagaagagtgtgcgtggtgctggtgctgatcagctggttcgtgggcttcatccacaccaccagccagctggccttcaccgtgaacctgcccttctgcggccccaacaaggtggacagcttcttctgcgacctgcccctggtgaccaagctggcctgcatcgacacctacgtggtgagcctgctgatcgtggccgacagcggcttcctgagcctgagcagcttcctgctgctggtggtgagctacaccgtgatcctggtgaccgtgagaaacagaagcagcgccagcatggccaaggccagaagcaccctgaccgcccacatcaccgtggtgaccctgttcttcggcccctgcatcttcatctacgtgtggcccttcagcagctacagcgtggacaaggtgctggccgtgttctacaccatcttcaccctgatcctgaaccccgtgatctacaccctgagaaacaaggaggtgaaggccgccatgagcaagctgaagagcagatacctgaagcccagccaggtgagcgtggtgatcagaaacgtgctgttcctggagaccaagtag

SEQ ID NO: 20477 - DNA, 1032 bp, Artificial Sequence
  Description of Artificial Sequence: Synthetic coding sequence
atggccctgtacttcagcctgatcctgcacggcatgagcgacctgttcttcctgagcaccggccaccccagagccagctgcagaatggaggccatgaagctgctgaaccagagccaggtgagcgagttcatcctgctgggcctgaccagcagccaggacgtggagttcctgctgttcgccctgttcagcgtgatctacgtggtgaccgtgctgggcaacctgctgatcatcgtgaccgtgttcaacacccccaacctgaacacccccatgtacttcctgctgggcaacctgagcttcgtggacatgaccctggccagcttcgccacccccaaggtgatcctgaacctgctgaagaagcagaaggtgatcagcttcgccggctgcttcacccagatcttcctgctgcacctgctgggcggcgtggagatggtgctgctggtgagcatggccttcgacagatacgtggccatctgcaagcccctgcactacatgaccatcatgaacaagaaggtgtgcgtgctgctggtggtgaccagctggctgctgggcctgctgcacagcggcttccagatccccttcgccgtgaacctgcccttctgcggccccaacgtggtggacagcatcttctgcgacctgcccctggtgaccaagctggcctgcatcgacatctacttcgtgcaggtggtgatcgtggccaacagcggcatcatcagcctgagctgcttcatcatcctgctgatcagctacagcctgatcctgatcaccatcaagaaccacagccccaccggccagagcaaggccagaagcaccctgaccgcccacatcaccgtggtgatcctgttcttcggcccctgcatcttcatctacatctggcccttcggcaaccacagcgtggacaagttcctggccgtgttctacaccatcatcacccccatcctgaaccccatcatctacaccctgagaaacaaggagatgaagatcagcatgaagaagctgtggagagccttcgtgaacagcagagaggacacctag

SEQ ID NO: 20478 - DNA, 945 bp, Artificial Sequence
  Description of Artificial Sequence: Synthetic coding sequence
atggacgtgggcaacaagagcaccatgagcgagttcgtgctgctgggcctgagcaacagctgggagctgcagatgttcttcttcatggtgttcagcctgctgtacgtggccaccatggtgggcaacagcctgatcgtgatcaccgtgatcgtggacccccacctgcacagccccatgtacttcctgctgaccaacctgagcatcatcgacatgagcctggccagcttcgccacccccaagatgatcaccgactacctgaccggccacaagaccatcagcttcgacggctgcctgacccagatcttcttcctgcacctgttcaccggcaccgagatcatcctgctgatggccatgagcttcgacagatacatcgccatctgcaagcccctgcactacgccagcgtgatcagcccccaggtgtgcgtggccctggtggtggccagctggatcatgggcgtgatgcacagcatgagccaggtgatcttcgccctgaccctgcccttctgcggcccctacgaggtggacagcttcttctgcgacctgcccgtggtgttccagctggcctgcgtggacacctacgtgctgggcctgttcatgatcagcaccagcggcatcatcgccctgagctgcttcatcgtgctgttcaacagctacgtgatcgtgctggtgaccgtgaagcaccacagcagcagaggcagcagcaaggccctgagcacctgcaccgcccacttcatcgtggtgttcctgttcttcggcccctgcatcttcatctacatgtggcccctgagcagcttcctgaccgacaagatcctgagcgtgttctacaccatcttcacccccaccctgaaccccatcatctacaccctgagaaaccaggaggtgaagatcgccatgagaaagctgaagaacagattcctgaacttcaacaaggccatgcccagctag

SEQ ID NO: 20479 - DNA, 972 bp, Artificial Sequence
  Description of Artificial Sequence: Synthetic coding sequence
atggacaagagcaacagcagcgtggtgagcgagttcgtgctgctgggcctgtgcagcagccagaagctgcagctgttctacttctgcttcttcagcgtgctgtacaccgtgatcgtgctgggcaacctgctgatcatcctgaccgtgaccagcgacaccagcctgcacagccccatgtacttcctgctgggcaacctgagcttcgtggacatctgccaggccagcttcgccacccccaagatgatcgccgacttcctgagcgcccacgagaccatcagcttcagcggctgcatcgcccagatcttcttcatccacctgttcaccggcggcgagatggtgctgctggtgagcatggcctacgacagatacgtggccatctgcaagcccctgtactacgtggtgatcatgagcagaagaacctgcaccgtgctggtgatgatcagctgggccgtgagcctggtgcacaccctgagccagctgagcttcaccgtgaacctgcccttctgcggccccaacgtggtggacagcttcttctgcgacctgcccagagtgaccaagctggcctgcctggacagctacatcatcgagatcctgatcgtggtgaacagcggcatcctgagcctgagcaccttcagcctgctggtgagcagctacatcatcatcctggtgaccgtgtggctgaagagcagcgccgccatggccaaggccttcagcaccctggccagccacatcgccgtggtgatcctgttcttcggcccctgcatcttcatctacgtgtggcccttcaccatcagccccctggacaagttcctggccatcttctacaccgtgttcacccccgtgctgaaccccatcatctacaccctgagaaacagagacatgaaggccgccgtgagaaagatcgtgaaccactacctgagacccagaagaatcagcgagatgagcctggtggtgagaaccagcttccactag

SEQ ID NO: 20480 - DNA, 939 bp, Artificial Sequence
  Description of Artificial Sequence: Synthetic coding sequence
atggacctgaagaacggcagcctggtgaccgagttcatcctgctgggcttcttcggcagatgggagctgcagatcttcttcttcgtgaccttcagcctgatctacggcgccaccgtgatgggcaacatcctgatcatggtgaccgtgacctgcagaagcaccctgcacagccccctgtacttcctgctgggcaacctgagcttcctggacatgtgcctgagcaccgccaccacccccaagatgatcatcgacctgctgaccgaccacaagaccatcagcgtgtggggctgcgtgacccagatgttcttcatgcacttcttcggcggcgccgagatgaccctgctgatcatcatggccttcgacagatacgtggccatctgcaagcccctgcactacagaaccatcatgagccacaagctgctgaagggcttcgccatcctgagctggatcatcggcttcctgcacagcatcagccagatcgtgctgaccatgaacctgcccttctgcggccacaacgtgatcaacaacatcttctgcgacctgcccctggtgatcaagctggcctgcatcgagacctacaccctggagctgttcgtgatcgccgacagcggcctgctgagcttcacctgcttcatcctgctgctggtgagctacatcgtgatcctggtgagcgtgcccaagaagagcagccacggcctgagcaaggccctgagcaccctgagcgcccacatcatcgtggtgaccctgttcttcggcccctgcatcttcatctacgtgtggcccttcagcagcctggccagcaacaagaccctggccgtgttctacaccgtgatcacccccctgctgaaccccagcatctacaccctgagaaacaagaagatgcaggaggccatcagaaagctgagattccagtacgtgagcagcgcccagaacttctag

SEQ ID NO: 20481 - DNA, 942 bp, Artificial Sequence
  Description of Artificial Sequence: Synthetic coding sequence
atggagaccgccaactacaccaaggtgaccgagttcgtgctgaccggcctgagccagaccagagaggtgcagctggtgctgttcgtgatcttcctgagcttctacctgttcatcctgcccggcaacatcctgatcatctgcaccatcagactggacccccacctgaccagccccatgtacttcctgctggccaacctggccctgctggacatctggtacagcagcatcaccgcccccaagatgctgatcgacttcttcgtggagagaaagatcatcagcttcggcggctgcatcgcccagctgttcttcctgcacttcgtgggcgccagcgagatgttcctgctgaccgtgatggcctacgacagatacgccgccatctgcagacccctgcactacgccaccatcatgaacagaagactgtgctgcatcctggtggccctgagctggatgggcggcttcatccacagcatcatccaggtggccctgatcgtgagactgcccttctgcggccccaacgagctggacagctacttctgcgacatcacccaggtggtgagaatcgcctgcgccaacaccttccccgaggagctggtgatgatctgcagcagcggcctgatcagcgtggtgtgcttcatcgccctgctgatgagctacgccttcctgctggccctgctgaagaagcacagcggcagcggcgagaacaccaacagagccatgagcacctgctacagccacatcaccatcgtggtgctgatgttcggccccagcatctacatctacgccagacccttcgacagcttcagcctggacaaggtggtgagcgtgttccacaccgtgatcttccccctgctgaaccccatcatctacaccctgagaaacaaggaggtgaaggccgccatgagaaaggtggtgaccaagtacatcctgtgcgaggagaagtag

SEQ ID NO: 20482 - DNA, 942 bp, Artificial Sequence
  Description of Artificial Sequence: Synthetic coding sequence
atggagaccgccaactacaccaaggtgaccgagttcgtgctgaccggcctgagccagacccccgaggtgcagctggtgctgttcgtgatcttcctgagcttctacctgttcatcctgcccggcaacatcctgatcatctgcaccatcagcctggacccccacctgaccagccccatgtacttcctgctggccaacctggccttcctggacatctggtacagcagcatcaccgcccccgagatgctgatcgacttcttcgtggagagaaagatcatcagcttcgacggctgcatcgcccagctgttcttcctgcacttcgccggcgccagcgagatgttcctgctgaccgtgatggccttcgacctgtacaccgccatctgcagacccctgcactacgccaccatcatgaaccagagactgtgctgcatcctggtggccctgagctggagaggcggcttcatccacagcatcatccaggtggccctgatcgtgagactgcccttctgcggccccaacgagctggacagctacttctgcgacatcacccaggtggtgagaatcgcctgcgccaacaccttccccgaggagctggtgatgatctgcagcagcggcctgatcagcgtggtgtgcctgatcgccctgctgatgagctacgccttcctgctggccctgttcaagaagctgagcggcagcggcgagaacaccaacagagccatgagcacctgctacagccacatcaccatcgtggtgctgatgttcggccccagcatctacatctacgccagacccttcgacagcttcagcctggacaaggtggtgagcgtgttcaacaccctgatcttccccctgagaaaccccatcatctacaccctgagaaacaaggaggtgaaggccgccatgagaaagctggtgaccaagtacatcctgtgcaaggagaagtag

SEQ ID NO: 20483 - DNA, 924 bp, Artificial Sequence
  Description of Artificial Sequence: Synthetic coding sequence
atggagagcgagaacagaaccgtgatcagagagttcatcctgctgggcctgacccagagccaggacatccagctgctggtgttcgtgctggtgctgatcttctacttcatcatcctgcccggcaacttcctgatcatcttcaccatcaagagcgaccccggcctgaccgcccccctgtacttcttcctgggcaacctggccttcctggacgccagctacagcttcatcgtggcccccagaatgctggtggacttcctgagcgccaagaagatcatcagctacagaggctgcatcacccagctgttcttcctgcacttcctgggcggcggcgagggcctgctgctggtggtgatggccttcgacagatacatcgccatctgcagacccctgcactaccccaccgtgatgaaccccagaacctgctacgccatgatgctggccctgtggctgggcggcttcgtgcacagcatcatccaggtggtgctgatcctgagactgcccttctgcggccccaaccagctggacaacttcttctgcgacgtgccccaggtgatcaagctggcctgcaccgacaccttcgtggtggagctgctgatggtgttcaacagcggcctgatgaccctgctgtgcttcctgggcctgctggccagctacgccgtgatcctgtgcagaatcagaggcagcagcagcgaggccaagaacaaggccatgagcacctgcatcacccacatcatcgtgatcttcttcatgttcggccccggcatcttcatctacaccagacccttcagagccttccccgccgacaaggtggtgagcctgttccacaccgtgatcttccccctgctgaaccccgtgatctacaccctgagaaaccaggaggtgaaggccagcatgaagaaggtgttcaacaagcacatcgcctag

SEQ ID NO: 20484 - DNA, 66 bp, Artificial Sequence
  Description of Artificial Sequence: Synthetic coding sequence
atggagagcgagaacagaaccgtgatcagagagttcatcctgctgggcctgacccagagccagtag

SEQ ID NO: 20485 - DNA, 441 bp, Artificial Sequence
  Description of Artificial Sequence: Synthetic coding sequence
atggagagcgagaacagaaccgtgatcagagagttcatcctgctgggcctgacccagagccaggacatccagctgctggtgttcgtgctggtgctgatcttctacttcatcatcctgcccggcaacttcctgatcatcttcaccatcaagagcgaccccggcctgaccgcccccctgtacttcttcctgggcaacctggccttcctggacgccagctacagcttcatcgtggcccccagaatgctggtggacttcctgagcgccaagaagatcatcagctacagaggctgcatcacccagctgttcttcctgcacttcctgggcggcggcgagggcctgctgctggtggtgatggccttcgacagatacatcgccatctgcagacccctgcactaccccaccgtgatgaaccccagaacctgctacgccatgatgctgtag

SEQ ID NO: 20486 - DNA, 951 bp, Artificial Sequence
  Description of Artificial Sequence: Synthetic coding sequence
atgaagatcgccaacaacaccgtggtgaccgagttcatcctgctgggcctgacccagagccaggacatccagctgctggtgttcgtgctgatcctgatcttctacctgatcatcctgcccggcaacttcctgatcatcttcaccatcagaagcgaccccggcctgaccgcccccctgtacctgttcctgggcaacctggccttcctggacgccagctacagcttcatcgtggcccccagaatgctggtggacttcctgagcgagaagaaggtgatcagctacagaggctgcatcacccagctgttcttcctgcacttcctgggcggcggcgagggcctgctgctggtggtgatggccttcgacagatacatcgccatctgcagacccctgcactgcagcaccgtgatgaaccccagagcctgctacgccatgatgctggccctgtggctgggcggcttcgtgcacagcatcatccaggtggtgctgatcctgagactgcccttctgcggccccaaccagctggacaacttcttctgcgacgtgagacaggtgatcaagctggcctgcaccgacatgttcgtggtggagctgctgatggtgttcaacagcggcctgatgaccctgctgtgcttcctgggcctgctggccagctacgccgtgatcctgtgccacgtgagaagagccgccagcgagggcaagaacaaggccatgagcacctgcaccaccagagtgatcatcatcctgctgatgttcggccccgccatcttcatctacatgtgccccttcagagccctgcccgccgacaagatggtgagcctgttccacaccgtgatcttccccctgatgaaccccatgatctacaccctgagaaaccaggaggtgaagaccagcatgaagagactgctgagcagacacgtggtgtgccaggtggacttcatcatcagaaactag

SEQ ID NO: 20487 - DNA, 927 bp, Artificial Sequence
  Description of Artificial Sequence: Synthetic coding sequence
atggagacccagaacctgaccgtggtgaccgagttcatcctgctgggcctgacccagagccaggacgcccagctgctggtgttcgtgctggtgctgatcttctacctgatcatcctgcccggcaacttcctgatcatcttcaccatcaagagcgaccccggcctgaccgcccccctgtacttcttcctgggcaacctggccctgctggacgccagctacagcttcatcgtggtgcccagaatgctggtggacttcctgagcgagaagaaggtgatcagctacagaagctgcatcacccagctgttcttcctgcacttcctgggcgccggcgagatgttcctgctggtggtgatggccttcgacagatacatcgccatctgcagacccctgcactacagcaccatcatgaaccccagagcctgctacgccctgagcctggtgctgtggctgggcggcttcatccacagcatcgtgcaggtggccctgatcctgcacctgcccttctgcggccccaaccagctggacaacttcttctgcgacgtgccccaggtgatcaagctggcctgcaccaacaccttcgtggtggagctgctgatggtgagcaacagcggcctgctgagcctgctgtgcttcctgggcctgctggccagctacgccgtgatcctgtgcagaatcagagagcacagcagcgagggcaagagcaaggccatcagcacctgcaccacccacatcatcatcatcttcctgatgttcggccccgccatcttcatctacacctgccccttccaggccttccccgccgacaaggtggtgagcctgttccacaccgtgatcttccccctgatgaaccccgtgatctacaccctgagaaaccaggaggtgaaggccagcatgagaaagctgctgagccagcacatgttctgctag

SEQ ID NO: 20488 - DNA, 939 bp, Artificial Sequence
  Description of Artificial Sequence: Synthetic coding sequence
atggagaagagcaacaacagcaccctgttcatcctgctgggcttcagccagaacaagaacatcgaggtgctgtgcttcgtgctgttcctgttctgctacatcgccatctggatgggcaacctgctgatcatgatcagcatcacctgcacccagctgatccaccagcccatgtacttcttcctgaactacctgagcctgagcgacctgtgctacaccagcaccgtgacccccaagctgatggtggacctgctggccgagagaaagaccatcagctacaacaactgcatgatccagctgttcaccacccacttcttcggcggcatcgagatcttcatcctgaccggcatggcctacgacagatacgtggccatctgcaagcccctgcactacaccatcatcatgagcagacagaagtgcaacaccatcatcatcgtgtgctgcaccggcggcttcatccacagcgccagccagttcctgctgaccatcttcgtgcccttctgcggccccaacgagatcgaccactacttctgcgacgtgtaccccctgctgaagctggcctgcagcaacatccacatgatcggcctgctggtgatcgccaacagcggcctgatcgccctggtgaccttcgtggtgctgctgctgagctacgtgttcatcctgtacaccatcagagcctacagcgccgagagaagaagcaaggccctggccacctgcagcagccacgtgatcgtggtggtgctgttcttcgcccccgccctgttcatctacatcagacccgtgaccaccttcagcgaggacaaggtgttcgccctgttctacaccatcatcgcccccatgttcaaccccctgatctacaccctgagaaacaccgagatgaagaacgccatgagaaaggtgtggtgctgccagatcctgctgaagagaaaccagctgttctag

SEQ ID NO: 20489 - DNA, 942 bp, Artificial Sequence
  Description of Artificial Sequence: Synthetic coding sequence
atgaagaaggagcaggacagcaacgtgaccgagttcgtgctgctgggcctgagcagcagctgggagctgcagctgttcctgttcctgctgttcctgttcttctacatcgccatcgtgctgggcaacctgctgatcgtggtgaccgtgcaggcccacgcccacctgctgcagagccccatgtactacttcctgggccacctgagcttcatcgacctgtgcctgagctgcgtgaccgtgcccaagatgctgggcgacttcctgcagcagggcaagagcatcagcttcagcggctgcctggcccagatctacttcctgcacttcctgggcgccagcgagatgttcctgctgaccgtgatggcctacgacagatacgtggccatctgcaaccccctgagatacctgaccgtgatgaacccccagctgtgcctgtggctggtgctggcctgctggtgcggcggcttcatccacagcatcatgcaggtgatcctggtgatccagctgcccttctgcggccccaacgagctggacaacttctactgcgacgtgccccaggtgatcaagctggcctgcatggacacctacgtggtggaggtgctggtgatcgccaacagcggcctgctgagcctggtgtgcttcctggtgctgctgttcagctacgccatcatcctgatcaccctgagaacccacttctgccagggccagaacaaggtgttcagcacctgcgccagccacctgaccgtggtgagcctgatcttcgtgccctgcgtgttcatctacctgagacccttctgcagcttcagcgtggacaagatcttcagcctgttctacaccgtgatcacccccatgctgaaccccctgatctacaccctgagaaacaccgacatgaagaccgccatgaagaagctgagaatcaagccctgcggcatccccctgccctgctag

SEQ ID NO: 20490 - DNA, 930 bp, Artificial Sequence
  Description of Artificial Sequence: Synthetic coding sequence
atgggcgccaagaacaacgtgaccgagttcgtgctgttcggcctgttcgagagcagagagatgcagcacacctgcttcgtggtgttcttcctgttccacgtgctgaccgtgctgggcaacctgctggtgatcatcaccatcaacgccagaaagaccctgaagagccccatgtacttcttcctgagccagctgagcttcgccgacatctgctaccccagcaccaccatccccaagatgatcgccgacaccttcgtggagcacaagatcatcagcttcaacggctgcatgacccagctgttcagcgcccacttcttcggcggcaccgagatcttcctgctgaccgccatggcctacgacagatacgtggccatctgcagacccctgcactacaccgccatcatggactgcagaaagtgcggcctgctggccggcgccagctggctggccggcttcctgcacagcatcctgcagaccctgctgaccgtgcagctgcccttctgcggccccaacgagatcgacaacttcttctgcgacgtgcaccccctgctgaagctggcctgcgccgacacctacatggtgggcctgatcgtggtggccaacagcggcatgatcagcctggccagcttcttcatcctgatcatcagctacgtgatcatcctgctgaacctgagaagccagagcagcgaggacagaagaaaggccgtgagcacctgcggcagccacgtgatcaccgtgctgctggtgctgatgccccccatgttcatgtacatcagacccagcaccaccctggccgccgacaagctgatcatcctgttcaacatcgtgatgccccccctgctgaaccccctgatctacaccctgagaaacaacgacgtgaagaacgccatgagaaagctgttcagagtgaagagaagcctgggcgagaagtag

SEQ ID NO: 20491 - DNA, 936 bp, Artificial Sequence
  Description of Artificial Sequence: Synthetic coding sequence
atggagaagatcaacaacgtgaccgagttcatcttctggggcctgagccagagccccgagatcgagaaggtgtgcttcgtggtgttcagcttcttctacatcatcatcctgctgggcaacctgctgatcatgctgaccgtgtgcctgagcaacctgttcaagagccccatgtacttcttcctgagcttcctgagcttcgtggacatctgctacagcagcgtgaccgcccccaagatgatcgtggacctgctggccaaggacaagaccatcagctacgtgggctgcatgctgcagctgttcggcgtgcacttcttcggctgcaccgagatcttcatcctgaccgtgatggcctacgacagatacgtggccatctgcaagcccctgcactacatgaccatcatgaacagagagacctgcaacaagatgctgctgggcacctgggtgggcggcttcctgcacagcatcatccaggtggccctggtggtgcagctgcccttctgcggccccaacgagatcgaccactacttctgcgacgtgcaccccgtgctgaagctggcctgcaccgagacctacatcgtgggcgtggtggtgaccgccaacagcggcaccatcgccctgggcagcttcgtgatcctgctgatcagctacagcatcatcctggtgagcctgagaaagcagagcgccgagggcagaagaaaggccctgagcacctgcggcagccacatcgccatggtggtgatcttcttcggcccctgcaccttcatgtacatgagacccgacaccaccttcagcgaggacaagatggtggccgtgttctacaccatcatcacccccatgctgaaccccctgatctacaccctgagaaacgccgaggtgaagaacgccatgaagaagctgtggggcagaaacgtgttcctggaggccaagggcaagtag

SEQ ID NO: 20492 - DNA, 918 bp, Artificial Sequence
  Description of Artificial Sequence: Synthetic coding sequence
atggtggccaccaacaacgtgaccgagatcatcttcgtgggcttcagccagaactggagcgagcagagagtgatcagcgtgatgttcctgctgatgtacaccgccgtggtgctgggcaacggcctgatcgtggtgaccatcctggccagcaaggtgctgaccagccccatgtacttcttcctgagctacctgagcttcgtggagatctgctactgcagcgtgatggcccccaagctgatcttcgacagcttcatcaagagaaaggtgatcagcctgaagggctgcctgacccagatgttcagcctgcacttcttcggcggcaccgaggccttcctgctgatggtgatggcctacgacagatacgtggccatctgcaagcccctgcactacatggccatcatgaaccagagaatgtgcggcctgctggtgagaatcgcctggggcggcggcctgctgcacagcgtgggccagaccttcctgatcttccagctgcccttctgcggccccaacatcatggaccactacttctgcgacgtgcaccccgtgctggagctggcctgcgccgacaccttcttcatcagcctgctgatcatcaccaacggcggcagcatcagcgtggtgagcttcttcgtgctgatggccagctacctgatcatcctgcacttcctgagaagccacaacctggagggccagcacaaggccctgagcacctgcgccagccacgtgaccgtggtggacctgttcttcatcccctgcagcctggtgtacatcagaccctgcgtgaccctgcccgccgacaagatcgtggccgtgttctacaccgtggtgacccccctgctgaaccccgtgatctacagcttcagaaacgccgaggtgaagaacgccatgagaagattcatcggcggcaaggtgatctag

SEQ ID NO: 20493 - DNA, 912 bp, Artificial Sequence
  Description of Artificial Sequence: Synthetic coding sequence
atgaccgagttcatcttcctggtgctgagccccaaccaggaggtgcagagagtgtgcttcgtgatcttcctgttcctgtacaccgccatcgtgctgggcaacttcctgatcgtgctgaccgtgatgaccagcagaagcctgggcagccccatgtacttcttcctgagctacctgagcttcatggagatctgctacagcagcgccaccgcccccaagctgatcagcgacctgctggccgagagaaaggtgatcagctggtggggctgcatggcccagctgttcttcctgcacttcttcggcggcaccgagatcttcctgctgaccgtgatggcctacgaccactacgtggccatctgcaagcccctgagctacaccaccatcatgaactggcaggtgtgcaccgtgctggtgggcatcgcctgggtgggcggcttcatgcacagcttcgcccagatcctgctgatcttccacctgctgttctgcggccccaacgtgatcaaccactacttctgcgacctggtgcccctgctgaagctggcctgcagcgacaccttcctgatcggcctgctgatcgtggccaacggcggcaccctgagcgtgatcagcttcggcgtgctgctggccagctacatggtgatcctgctgcacctgagaacctggagcagcgagggctggtgcaaggccctgagcacctgcggcagccacttcgccgtggtgatcctgttcttcggcccctgcgtgttcaacagcctgagacccagcaccaccctgcccatcgacaagatggtggccgtgttctacaccgtgatcaccgccatcctgaaccccgtgatctacagcctgagaaacgccgagatgagaaaggccatgaagagactgtggatcagaaccctgagactgaacgagaagtag

SEQ ID NO: 20494 - DNA, 948 bp, Artificial Sequence
  Description of Artificial Sequence: Synthetic coding sequence
atgagcatcaccaaggcctggaacagcagcagcgtgaccatgttcatcctgctgggcttcaccgaccaccccgagctgcaggccctgctgttcgtgaccttcctgggcatctacctgaccaccctggcctggaacctggccctgatcttcctgatcagaggcgacacccacctgcacacccccatgtacttcttcctgagcaacctgagcttcatcgacatctgctacagcagcgccgtggcccccaacatgctgaccgacttcttctgggagcagaagaccatcagcttcgtgggctgcgccgcccagttcttcttcttcgtgggcatgggcctgagcgagtgcctgctgctgaccgccatggcctacgacagatacgccgccatcagcagccccctgctgtaccccaccatcatgacccagggcctgtgcaccagaatggtggtgggcgcctacgtgggcggcttcctgagcagcctgatccaggccagcagcatcttcagactgcacttctgcggccccaacatcatcaaccacttcttctgcgacctgccccccgtgctggccctgagctgcagcgacaccttcctgagccaggtggtgaacttcctggtggtggtgaccgtgggcggcaccagcttcctgcagctgctgatcagctacggctacatcgtgagcgccgtgctgaagatccccagcgccgagggcagatggaaggcctgcaacacctgcgccagccacctgatggtggtgaccctgctgttcggcaccgccctgttcgtgtacctgagacccagcagcagctacctgctgggcagagacaaggtggtgagcgtgttctacagcctggtgatccccatgctgaaccccctgatctacagcctgagaaacaaggagatcaaggacgccctgtggaaggtgctggagagaaagaaggtgttcagctag

SEQ ID NO: 20495 - DNA, 975 bp, Artificial Sequence
  Description of Artificial Sequence: Synthetic coding sequence
atggccgtgggcagaaacaacaccatcgtgaccaagttcatcctgctgggcctgagcgaccacccccagatgaagatcttcctgttcatgctgttcctgggcctgtacctgctgaccctggcctggaacctgagcctgatcgccctgatcaagatggacagccacctgcacatgcccatgtacttcttcctgagcaacctgagcttcctggacatctgctacgtgagcagcaccgcccccaagatgctgagcgacatcatcaccgagcagaagaccatcagcttcgtgggctgcgccacccagtacttcgtgttctgcggcatgggcctgaccgagtgcttcctgctggccgccatggcctacgacagatacgccgccatctgcaaccccctgctgtacaccgtgctgatcagccacaccctgtgcctgaagatggtggtgggcgcctacgtgggcggcttcctgagcagcttcatcgagacctacagcgtgtaccagcacgacttctgcggcccctacatgatcaaccacttcttctgcgacctgccccccgtgctggccctgagctgcagcgacaccttcaccagcgaggtggtgaccttcatcgtgagcgtggtggtgggcatcgtgagcgtgctggtggtgctgatcagctacggctacatcgtggccgccgtggtgaagatcagcagcgccaccggcagaaccaaggccttcagcacctgcgccagccacctgaccgccgtgaccctgttctacggcagcggcttcttcatgtacatgagacccagcagcagctacagcctgaacagagacaaggtggtgagcatcttctacgccctggtgatccccgtggtgaaccccatcatctacagcttcagaaacaaggagatcaagaacgccatgagaaaggccatggagagagaccccggcatcagccacggcggccccttcatcttcatgaccctgggctag

SEQ ID NO: 20496 - DNA, 930 bp, Artificial Sequence
  Description of Artificial Sequence: Synthetic coding sequence
atggacatcagcgagggcaacaagaccctggtgaccgagttcgtgctgaccggcctgaccgacagaccctggctgcacgtgctgttcttcgtggtgttcctggtggtgtacctgatcaccatggtgggcaacctgggcctgatcgtgctgatctggaacgacccccacctgcacatgcccatgtacctgttcctgggcggcctggccttcagcgacgcctgcaccagcaccagcatcacccccagaatgctggtgaacttcctggacaagaccgccatgatcagcctggccgagtgcatcacccagttctacttcttcgccagcagcgccaccaccgagtgcttcctgctggtgatgatggcctacgacagatacgtggccatctgcaaccccctgctgtaccccgtgatgatgagcaacaagctgagcgcccagctgctgagcatcagctacgtgatcggcttcctgcaccccctggtgcacgtgagcctgctgctgagactgaccttctgcagattcaacatcatccactacttctactgcgagatcctgcagctgttcaagatcagctgcaacggccccagcatcaacgccctgatgatcttcatcttcggcgccttcatccagatccccaccctgatgaccatcatcatcagctacaccagagtgctgttcgacatcctgaagaagaagagcgagaagggcagaagcaaggccttcagcacctgcggcgcccacctgctgagcgtgagcctgtactacggcaccctgatcttcatgtacgtgagacccgccagcggcctggccgaggaccaggacaaggtgtacagcctgttctacaccatcatcatccccctgctgaaccccttcatctacagcctgagaaacaagaaggtgatgcacgccctgagaagagtgatcagaaagtag

SEQ ID NO: 20497 - DNA, 930 bp, Artificial Sequence
  Description of Artificial Sequence: Synthetic coding sequence
atgaccctgggcaacagcaccgaggtgaccgagttctacctgctgggcttcggcgcccagcacgagttctggtgcatcctgttcatcgtgttcctgctgatctacgtgaccagcatcatgggcaacagcggcatcatcctgctgatcaacaccgacagcagattccagaccctgacctacttcttcctgcagcacctggccttcgtggacatctgctacaccagcgccatcacccccaagatgctgcagagcttcaccgaggagaagaacctgatgctgttccagggctgcgtgatccagttcctggtgtacgccaccttcgccaccagcgactgctacctgctggccatgatggccgtggacccctacgtggccatctgcaagcccctgcactacaccgtgatcatgagcagaaccgtgtgcatcagactggtggccggcagctacatcatgggcagcatcaacgccagcgtgcagaccggcttcacctgcagcctgagcttctgcaagagcaacagcatcaaccacttcttctgcgacgtgccccccatcctggccctgagctgcagcaacgtggacatcaacatcatgctgctggtggtgttcgtgggcagcaacctgatcttcaccggcctggtggtgatcttcagctacatctacatcatggccaccatcctgaagatgagcagcagcgccggcagaaagaagagcttcagcacctgcgccagccacctgaccgccgtgaccatcttctacggcaccctgagctacatgtacctgcagagccacagcaacaacagccaggagaacatgaaggtggccttcatcttctacggcaccgtgatccccatgctgaaccccctgatctacagcctgagaaacaaggaggtgaaggaggccctgaaggtgatcggcaagaagctgttctag

SEQ ID NO: 20498 - DNA, 936 bp, Artificial Sequence
  Description of Artificial Sequence: Synthetic coding sequence
atgaccggcggcggcaacatcaccgagatcacctacttcatcctgctgggcttcagcgacttccccagaatcatcaaggtgctgttcaccatcttcctggtgatctacatcaccagcctggcctggaacctgagcctgatcgtgctgatcagaatggacagccacctgcacacccccatgtacttcttcctgagcaacctgagcttcatcgacgtgtgctacatcagcagcaccgtgcccaagatgctgagcaacctgctgcaggagcagcagaccatcaccttcgtgggctgcatcatccagtacttcatcttcagcaccatgggcctgagcgagagctgcctgatgaccgccatggcctacgacagatacgccgccatctgcaaccccctgctgtacagcagcatcatgagccccaccctgtgcgtgtggatggtgctgggcgcctacatgaccggcctgaccgccagcctgttccagatcggcgccctgctgcagctgcacttctgcggcagcaacgtgatcagacacttcttctgcgacatgccccagctgctgatcctgagctgcaccgacaccttcttcgtgcaggtgatgaccgccatcctgaccatgttcttcggcatcgccagcgccctggtgatcatgatcagctacggctacatcggcatcagcatcatgaagatcaccagcgccaagggcagaagcaaggccttcaacacctgcgccagccacctgaccgccgtgagcctgttctacaccagcggcatcttcgtgtacctgagcagcagcagcggcggcagcagcagcttcgacagattcgccagcgtgttctacaccgtggtgatccccatgctgaaccccctgatctacagcctgagaaacaaggagatcaaggacgccctgaagagactgcagaagagaaagtgctgctag

SEQ ID NO: 20499 - DNA, 951 bp, Artificial Sequence
  Description of Artificial Sequence: Synthetic coding sequence
atgagactgatgaaggaggtgagaggcagaaaccagaccgaggtgaccgagttcctgctgctgggcctgagcgacaaccccgacctgcagggcgtgctgttcgccctgttcctgctgatctacatggccaacatggtgggcaacctgggcatgatcgtgctgatcaagatcgacctgtgcctgcacacccccatgtacttcttcctgagcagcctgagcttcgtggacgccagctacagcagcagcgtgacccccaagatgctggtgaacctgatggccgagaacaaggccatcagcttccacggctgcgccgcccagttctacttcttcggcagcttcctgggcaccgagtgcttcctgctggccatgatggcctacgacagatacgccgccatctggaaccccctgctgtaccccgtgctggtgagcggcagaatctgcttcctgctgatcgccaccagcttcctggccggctgcggcaacgccgccatccacaccggcatgaccttcagactgagcttctgcggcagcaacagaatcaaccacttctactgcgacaccccccccctgctgaagctgagctgcagcgacacccacttcaacggcatcgtgatcatggccttcagcagcttcatcgtgatcagctgcgtgatgatcgtgctgatcagctacctgtgcatcttcatcgccgtgctgaagatgcccagcctggagggcagacacaaggccttcagcacctgcgccagctacctgatggccgtgaccatcttcttcggcaccatcctgttcatgtacctgagacccaccagcagctacagcatggagcaggacaaggtggtgagcgtgttctacaccgtgatcatccccgtgctgaaccccctgatctacagcctgaagaacaaggacgtgaagaaggccctgaagaagatcctgtggaagcacatcctgtag

SEQ ID NO: 20500 - DNA, 954 bp, Artificial Sequence
  Description of Artificial Sequence: Synthetic coding sequence
atgatgagactgatgaaggaggtgagaggcagaaaccagaccgaggtgaccgagttcctgctgctgggcctgagcgacaaccccgacctgcagggcgtgctgttcgccctgttcctgctgatctacatggccaacatggtgggcaacctgggcatgatcgtgctgatcaagatcgacctgtgcctgcacacccccatgtacttcttcctgagcagcctgagcttcgtggacgccagctacagcagcagcgtgacccccaagatgctggtgaacctgatggccgagaacaaggccatcagcttccacggctgcgccgcccagttctacttcttcggcagcttcctgggcaccgagtgcttcctgctggccatgatggcctacgacagatacgccgccatctggaaccccctgctgtaccccgtgctggtgagcggcagaatctgcttcctgctgatcgccaccagcttcctggccggctgcggcaacgccgccatccacaccggcatgaccttcagactgagcttctgcggcagcaacagaatcaaccacttctactgcgacaccccccccctgctgaagctgagctgcagcgacacccacttcaacggcatcgtgatcatggccttcagcagcttcatcgtgatcagctgcgtgatgatcgtgctgatcagctacctgtgcatcttcatcgccgtgctgaagatgcccagcctggagggcagacacaaggccttcagcacctgcgccagctacctgatggccgtgaccatcttcttcggcaccatcctgttcatgtacctgagacccaccagcagctacagcatggagcaggacaaggtggtgagcgtgttctacaccgtgatcatccccgtgctgaaccccctgatctacagcctgaagaacaaggacgtgaagaaggccctgaagaagatcctgtggaagcacatcctgtag

SEQ ID NO: 20501 - DNA, 933 bp, Artificial Sequence
  Description of Artificial Sequence: Synthetic coding sequence
atggacaaggagaacagcagcatggtgaccgagttcatcttcatgggcatcacccaggacccccagatggagatcatcttcttcgtggtgttcctgatcgtgtacctggtgaacgtggtgggcaacatcggcatgatcatcctgatcaccaccgacacccagctgcacacccccatgtacttcttcctgtgcaacctgagcttcgtggacctgggctacagcagcgccatcgcccccagaatgctggccgacttcctgaccaaccacaaggtgatcagcttcagcagctgcgccacccagttcgccttcttcgtgggcttcgtggacgccgagtgctacgtgctggccgccatggcctacggcagattcgtggccatctgcagacccctgcactacagcaccttcatgagcaagcaggtgtgcctggccctgatgctgggcagctacctggccggcctggtgagcctggtggcccacaccaccctgaccttcagcctgagctactgcggcagcaacatcatcaaccacttcttctgcgagatcccccccctgctggccctgagctgcagcgacacctacatcagcgagatcctgctgttcagcctgtgcggcttcatcgagttcagcaccatcctgatcatcttcatcagctacaccttcatcctggtggccatcatcagaatgagaagcgccgagggcagactgaaggccttcagcacctgcggcagccacctgaccggcatcaccctgttctacggcaccgtgatgttcatgtacctgagacccaccagcagctacagcctggaccaggacaagtgggccagcgtgttctacaccgtgatcatccccatgctgaaccccctgatctacagcctgagaaacaaggacgtgaaggccgccttcaagaagctgatcggcaagaagagccagtag

SEQ ID NO: 20502 - DNA, 975 bp, Artificial Sequence
  Description of Artificial Sequence: Synthetic coding sequence
atgctggagagcaactacaccatgcccaccgagttcctgttcgtgggcttcaccgactacctgcccctgagagtgaccctgttcctggtgttcctgctggtgtacaccctgaccatggtgggcaacatcctgctgatcatcctggtgaacatcaacagcagcctgcagatccccatgtactacttcctgagcaacctgagcttcctggacatcagctgcagcaccgccatcacccccaagatgctggccaacttcctggccagcagaaagagcatcagcccctacggctgcgccctgcagatgttcttcttcgccagcttcgccgacgccgagtgcctgatcctggccgccatggcctacgacagatacgccgccatctgcaaccccctgctgtacaccaccctgatgagcagaagagtgtgcgtgtgcttcatcgtgctggcctacttcagcggcagcaccaccagcctggtgcacgtgtgcctgaccttcagactgagcttctgcggcagcaacatcgtgaaccacttcttctgcgacatcccccccctgctggccctgagctgcaccgacacccagatcaaccagctgctgctgttcgccctgtgcagcttcatccagaccagcaccttcgtggtgatcttcatcagctacttctgcatcctgatcaccgtgctgagcatcaagagcagcggcggcagaagcaagaccttcagcacctgcgccagccacctgatcgccgtgaccctgttctacggcgccctgctgttcatgtacctgcagcccaccaccagctacagcctggacaccgacaaggtggtggccgtgttctacaccgtggtgttccccatgttcaaccccatcatctacagcttcagaaacaaggacgtgaagaacgccctgaagaagctgctggagagaatcggctacagcaacgagtggtacctgaacagactgagaatcgtgaacatctag

SEQ ID NO: 20503 - DNA, 1089 bp, Artificial Sequence
  Description of Artificial Sequence: Synthetic coding sequence
atgaccgagttccacctgcagagccagatgcccagcatcagactgatcttcagaagactgagcctgggcagaatcaagcccagccagagccccagatgcagcaccagcttcatggtggtgcccagcttcagcatcgccgagcactggagaagaatgaagggcgccaacctgagccagggcatggagttcgagctgctgggcctgaccaccgacccccagctgcagagactgctgttcgtggtgttcctgggcatgtacaccgccaccctgctgggcaacctggtgatgttcctgctgatccacgtgagcgccaccctgcacacccccatgtacagcctgctgaagagcctgagcttcctggacttctgctacagcagcaccgtggtgccccagaccctggtgaacttcctggccaagagaaaggtgatcagctacttcggctgcatgacccagatgttcttctacgccggcttcgccaccagcgagtgctacctgatcgccgccatggcctacgacagatacgccgccatctgcaaccccctgctgtacagcaccatcatgagccccgaggtgtgcgccagcctgatcgtgggcagctacagcgccggcttcctgaacagcctgatccacaccggctgcatcttcagcctgaagttctgcggcgcccacgtggtgacccacttcttctgcgacggcccccccatcctgagcctgagctgcgtggacaccagcctgtgcgagatcctgctgttcatcttcgccggcttcaacctgctgagctgcaccctgaccatcctgatcagctacttcctgatcctgaacaccatcctgaagatgagcagcgcccagggcagattcaaggccttcagcacctgcgccagccacctgaccgccatctgcctgttcttcggcaccaccctgttcatgtacctgagacccagaagcagctacagcctgacccaggacagaaccgtggccgtgatctacaccgtggtgatccccgtgctgaaccccctgatgtacagcctgagaaacaaggacgtgaagaaggccctgatcaaggtgtggggcagaaagaccatggagtag

SEQ ID NO: 20504 - DNA, 945 bp, Artificial Sequence
  Description of Artificial Sequence: Synthetic coding sequence
atggagaacaacaccgaggtgaccgagttcatcctggtgggcctgaccgacgaccccgagctgcagatccccctgttcatcgtgttcctgttcatctacctgatcaccctggtgggcaacctgggcatgatcgagctgatcctgctggacagctgcctgcacacccccatgtacttcttcctgagcaacctgagcctggtggacttcggctacagcagcgccgtgacccccaaggtgatggtgggcttcctgaccggcgacaagttcatcctgtacaacgcctgcgccacccagttcttcttcttcgtggccttcatcaccgccgagagcttcctgctggccagcatggcctacgacagatacgccgccctgtgcaagcccctgcactacaccaccaccatgaccaccaacgtgtgcgcctgcctggccatcggcagctacatctgcggcttcctgaacgccagcatccacaccggcaacaccttcagactgagcttctgcagaagcaacgtggtggagcacttcttctgcgacgccccccccctgctgaccctgagctgcagcgacaactacatcagcgagatggtgatcttcttcgtggtgggcttcaacgacctgttcagcatcctggtgatcctgatcagctacctgttcatcttcatcaccatcatgaagatgagaagccccgagggcagacagaaggccttcagcacctgcgccagccacctgaccgccgtgagcatcttctacggcaccggcatcttcatgtacctgagacccaacagcagccacttcatgggcaccgacaagatggccagcgtgttctacgccatcgtgatccccatgctgaaccccctggtgtacagcctgagaaacaaggaggtgaagagcgccttcaagaagaccgtgggcaaggccaaggccagcatcggcttcatcttctag

SEQ ID NO: 20505 - DNA, 945 bp, Artificial Sequence
  Description of Artificial Sequence: Synthetic coding sequence
atggagaacaacaccgaggtgagcgagttcatcctgctgggcctgaccaacgcccccgagctgcaggtgcccctgttcatcatgttcaccctgatctacctgatcaccctgaccggcaacctgggcatgatcatcctgatcctgctggacagccacctgcacacccccatgtacttcttcctgagcaacctgagcctggccggcatcggctacagcagcgccgtgacccccaaggtgctgaccggcctgctgatcgaggacaaggccatcagctacagcgcctgcgccgcccagatgttcttctgcgccgtgttcgccaccgtggagaactacctgctgagcagcatggcctacgacagatacgccgccgtgtgcaaccccctgcactacaccaccaccatgaccaccagagtgtgcgcctgcctggccatcggctgctacgtgatcggcttcctgaacgccagcatccagatcggcgacaccttcagactgagcttctgcatgagcaacgtgatccaccacttcttctgcgacaagcccgccgtgatcaccctgacctgcagcgagaagcacatcagcgagctgatcctggtgctgatcagcagcttcaacgtgttcttcgccctgctggtgaccctgatcagctacctgttcatcctgatcaccatcctgaagagacacaccggcaagggctaccagaagcccctgagcacctgcggcagccacctgatcgccatcttcctgttctacatcaccgtgatcatcatgtacatcagacccagcagcagccacagcatggacaccgacaagatcgccagcgtgttctacaccatgatcatccccatgctgagccccatcgtgtacaccctgagaaacaaggacgtgaagaacgccttcatgaaggtggtggagaaggccaagtacagcctggacagcgtgttctag

SEQ ID NO: 20506 - DNA, 930 bp, Artificial Sequence
  Description of Artificial Sequence: Synthetic coding sequence
atggagaactgcaccgaggtgaccaagttcatcctgctgggcctgaccagcgtgcccgagctgcagatccccctgttcatcctgttcaccttcatctacctgctgaccctgtgcggcaacctgggcatgatgctgctgatcctgatggacagctgcctgcacacccccatgtacttcttcctgagcaacctgagcctggtggacttcggctacagcagcgccgtgacccccaaggtgatggccggcttcctgagaggcgacaaggtgatcagctacaacgcctgcgccgtgcagatgttcttcttcgtggccctggccaccgtggagaactacctgctggccagcatggcctacgacagatacgccgccgtgtgcaagcccctgcactacaccaccaccatgaccgccagcgtgggcgcctgcctggccctgggcagctacgtgtgcggcttcctgaacgccagcttccacatcggcggcatcttcagcctgagcttctgcaagagcaacctggtgcaccacttcttctgcgacgtgcccgccgtgatggccctgagctgcagcgacaagcacaccagcgaggtgatcctggtgttcatgagcagcttcaacatcttcttcgtgctgctggtgatcttcatcagctacctgttcatcttcatcaccatcctgaagatgcacagcgccaagggccaccagaaggccctgagcacctgcgccagccacttcaccgccgtgagcgtgttctacggcaccgtgatcttcatctacctgcagcccagcagcagccacagcatggacaccgacaagatggccagcgtgttctacgccatgatcatccccatgctgaaccccgtggtgtacagcctgagaaacagagaggtgcagaacgccttcaagaaggtgctgagaagacagaagttcctgtag

SEQ ID NO: 20507 - DNA, 945 bp, Artificial Sequence
  Description of Artificial Sequence: Synthetic coding sequence
atggagaacaagaccgaggtgacccagttcatcctgctgggcctgaccaacgacagcgagctgcaggtgcccctgttcatcaccttccccttcatctacatcatcaccctggtgggcaacctgggcatcatcgtgctgatcttctgggacagctgcctgcacaaccccatgtacttcttcctgagcaacctgagcctggtggacttctgctacagcagcgccgtgacccccatcgtgatggccggcttcctgatcgaggacaaggtgatcagctacaacgcctgcgccgcccagatgtacatcttcgtggccttcgccaccgtggagaactacctgctggccagcatggcctacgacagatacgccgccgtgtgcaagcccctgcactacaccaccaccatgaccaccaccgtgtgcgccagactggccatcggcagctacctgtgcggcttcctgaacgccagcatccacaccggcgacaccttcagcctgagcttctgcaagagcaacgaggtgcaccacttcttctgcgacatccccgccgtgatggtgctgagctgcagcgacagacacatcagcgagctggtgctgatctacgtggtgagcttcaacatcttcatcgccctgctggtgatcctgatcagctacaccttcatcttcatcaccatcctgaagatgcacagcgccagcgtgtaccagaagcccctgagcacctgcgccagccacttcatcgccgtgggcatcttctacggcaccatcatcttcatgtacctgcagcccagcagcagccacagcatggacaccgacaagatggcccccgtgttctacaccatggtgatccccatgctgaaccccctggtgtacagcctgagaaacaaggaggtgaagagcgccttcaagaaggtggtggagaaggccaagctgagcgtgggctggagcgtgtag

SEQ ID NO: 20508 - DNA, 963 bp, Artificial Sequence
  Description of Artificial Sequence: Synthetic coding sequence
atgaacagcgagaacctgaccagagccgccgtggcccccgccgagttcgtgctgctgggcatcaccaacagatgggacctgagagtggccctgttcctgacctgcctgcccgtgtacctggtgagcctgctgggcaacatgggcatggccctgctgatcagaatggacgccagactgcacacccccatgtacttcttcctggccaacctgagcctgctggacgcctgctacagcagcgccatcggccccaagatgctggtggacctgctgctgcccagagccaccatcccctacaccgcctgcgccctgcagatgttcgtgttcgccggcctggccgacaccgagtgctgcctgctggccgccatggcctacgacagatacgtggccatcagaaaccccctgctgtacaccaccgccatgagccagagactgtgcctggccctgctgggcgccagcggcctgggcggcgccgtgagcgccttcgtgcacaccaccctgaccttcagactgagcttctgcagaagcagaaagatcaacagcttcttctgcgacatcccccccctgctggccatcagctgcagcgacaccagcctgaacgagctgctgctgttcgccatctgcggcttcatccagaccgccaccgtgctggccatcaccgtgagctacggcttcatcgccggcgccgtgatccacatgagaagcgtggagggcagcagaagagccgccagcaccggcggcagccacctgaccgccgtggccatgatgtacggcaccctgatcttcatgtacctgagacccagcagcagctacgccctggacaccgacaagatggccagcgtgttctacaccctggtgatccccagcctgaaccccctgatctacagcctgagaaacaaggaggtgaaggaggccctgagacagacctggagcagattccactgccccggccagggcagccagtag

SEQ ID NO: 20509 - DNA, 945 bp, Artificial Sequence
  Description of Artificial Sequence: Synthetic coding sequence
atgatggccagcgagagaaaccagagcagcacccccaccttcatcctgctgggcttcagcgagtaccccgagatccaggtgcccctgttcctggtgttcctgttcgtgtacaccgtgaccgtggtgggcaacctgggcatgatcatcatcatcagactgaacagcaagctgcacaccatcatgtgcttcttcctgagccacctgagcctgaccgacttctgcttcagcaccgtggtgacccccaagctgctggagaacctggtggtggagtacagaaccatcagcttcagcggctgcatcatgcagttctgcttcgcctgcatcttcggcgtgaccgagaccttcatgctggccgccatggcctacgacagattcgtggccgtgtgcaagcccctgctgtacaccaccatcatgagccagaagctgtgcgccctgctggtggccggcagctacacctggggcatcgtgtgcagcctgatcctgacctacttcctgctggacctgagcttctgcgagagcaccttcatcaacaacttcatctgcgaccacagcgtgatcgtgagcgccagctacagcgacccctacatcagccagagactgtgcttcatcatcgccatcttcaacgaggtgagcagcctgatcatcatcctgaccagctacatgctgatcttcaccaccatcatgaagatgagaagcgccagcggcagacagaagaccttcagcacctgcgccagccacctgaccgccatcaccatcttccacggcaccatcctgttcctgtactgcgtgcccaaccccaagaccagcagcctgatcgtgaccgtggccagcgtgttctacaccgtggccatccccatgctgaaccccctgatctacagcctgagaaacaaggacatcaacaacatgttcgagaagctggtggtgaccaagctgatctaccactag

SEQ ID NO: 20510 - DNA, 945 bp, Artificial Sequence
  Description of Artificial Sequence: Synthetic coding sequence
atgatgatggtgctgagaaacctgagcatggagcccaccttcgccctgctgggcttcaccgactaccccaagctgcagatccccctgttcctggtgttcctgctgatgtacgtgatcaccgtggtgggcaacctgggcatgatcatcatcatcaagatcaaccccaagttccacacccccatgtacttcttcctgagccacctgagcttcgtggacttctgctacagcagcatcgtgacccccaagctgctggagaacctggtgatggccgacaagagcatcttctacttcagctgcatgatgcagtacttcctgagctgcaccgccgtggtgaccgagagcttcctgctggccgtgatggcctacgacagattcgtggccatctgcaaccccctgctgtacaccgtggccatgagccagagactgtgcgccctgctggtggccggcagctacctgtggggcatgttcggccccctggtgctgctgtgctacgccctgagactgaacttcagcggccccaacgtgatcaaccacttcttctgcgagtacaccgccctgatcagcgtgagcggcagcgacatcctgatcccccacctgctgctgttcagcttcgccaccttcaacgagatgtgcaccctgctgatcatcctgaccagctacgtgttcatcttcgtgaccgtgctgaagatcagaagcgtgagcggcagacacaaggccttcagcacctgggccagccacctgaccagcatcaccatcttccacggcaccatcctgttcctgtactgcgtgcccaacagcaagaacagcagacagaccgtgaaggtggccagcgtgttctacaccgtggtgaaccccatgctgaaccccctgatctacagcctgagaaacaaggacgtgaaggacgccttctggaagctgatccacacccaggtgcccttccactag

SEQ ID NO: 20511 - DNA, 987 bp, Artificial Sequence
  Description of Artificial Sequence: Synthetic coding sequence
atgttcctgaccgagagaaacaccaccagcgaggccaccttcaccctgctgggcttcagcgactacctggagctgcagatccccctgttcttcgtgttcctggccgtgtacggcttcagcgtggtgggcaacctgggcatgatcgtgatcatcaagatcaaccccaagctgcacacccccatgtacttcttcctgaaccacctgagcttcgtggacttctgctacagcagcatcatcgcccccatgatgctggtgaacctggtggtggaggacagaaccatcagcttcagcggctgcctggtgcagttcttcttcttctgcaccttcgtggtgaccgagctgatcctgttcgccgtgatggcctacgaccacttcgtggccatctgcaaccccctgctgtacaccgtggccatcagccagaagctgtgcgccatgctggtggtggtgctgtacgcctggggcgtggcctgcagcctgaccctggcctgcagcgccctgaagctgagcttccacggcttcaacaccatcaaccacttcttctgcgagctgagcagcctgatcagcctgagctaccccgacagctacctgagccagctgctgctgttcaccgtggccaccttcaacgagatcagcaccctgctgatcatcctgaccagctacgccttcatcatcgtgaccaccctgaagatgcccagcgccagcggccacagaaaggtgttcagcacctgcgccagccacctgaccgccatcaccatcttccacggcaccatcctgttcctgtactgcgtgcccaacagcaagaacagcagacacaccgtgaaggtggccagcgtgttctacaccgtggtgatccccctgctgaaccccctgatctacagcctgagaaacaaggacgtgaaggacgccatcagaaagatcatcaacaccaagtacttccacatcaagcacagacactggtaccccttcaacttcgtgatcgagcagtag

SEQ ID NO: 20512 - DNA, 942 bp, Artificial Sequence
  Description of Artificial Sequence: Synthetic coding sequence
atgctgctgaccgacagaaacaccagcggcaccaccttcaccctgctgggcttcagcgactaccccgagctgcaggtgcccctgttcctggtgttcctggccatctacaacgtgaccgtgctgggcaacatcggcctgatcgtgatcatcaagatcaaccccaagctgcacacccccatgtacttcttcctgagccagctgagcttcgtggacttctgctacagcagcatcatcgcccccaagatgctggtgaacctggtggtgaaggacagaaccatcagcttcctgggctgcgtggtgcagttcttcttcttctgcaccttcgtggtgaccgagagcttcctgctggccgtgatggcctacgacagattcgtggccatctgcaaccccctgctgtacaccgtgaacatgagccagaagctgtgcgtgctgctggtggtgggcagctacgcctggggcgtgagctgcagcctggagctgacctgcagcgccctgaagctgtgcttccacggcttcaacaccatcaaccacttcttctgcgagttcagcagcctgctgagcctgagctgcagcgacacctacatcaaccagtggctgctgttcttcctggccaccttcaacgagatcagcaccctgctgatcgtgctgaccagctacgccttcatcgtggtgaccatcctgaagatgagaagcgtgagcggcagaagaaaggccttcagcacctgcgccagccacctgaccgccatcaccatcttccacggcaccatcctgttcctgtactgcgtgcccaacagcaagaacagcagacacaccgtgaaggtggccagcgtgttctacaccgtggtgatccccatgctgaaccccctgatctacagcctgagaaacaaggacgtgaaggacaccgtgaccgagatcctggacaccaaggtgttcagctactag

SEQ ID NO: 20513 - DNA, 945 bp, Artificial Sequence
  Description of Artificial Sequence: Synthetic coding sequence
atgaccagaaagaactacaccagcctgaccgagttcgtgctgctgggcctggccgacaccctggagctgcagatcatcctgttcctgttcttcctggtgatctacaccctgaccgtgctgggcaacctgggcatgatcctgctgatcagaatcgacagccagctgcacacccccatgtacttcttcctggccaacctgagcttcgtggacgtgtgcaacagcaccaccatcacccccaagatgctggccgacctgctgagcgagaagaagaccatcagcttcgccggctgcttcctgcagatgtacttcttcatcagcctggccaccaccgagtgcatcctgttcggcctgatggcctacgacagatacgccgccatctgcagacccctgctgtacagcctgatcatgagcagaaccgtgtacctgaagatggccgccggcgccttcgccgccggcctgctgaacttcatggtgaacaccagccacgtgagcagcctgagcttctgcgacagcaacgtgatccaccacttcttctgcgacagcccccccctgttcaagctgagctgcagcgacaccatcctgaaggagagcatcagcagcatcctggccggcgtgaacatcgtgggcaccctgctggtgatcctgagcagctacagctacgtgctgttcagcatcttcagcatgcacagcggcgagggcagacacagagccttcagcacctgcgccagccacctgaccgccatcatcctgttctacgccacctgcatctacacctacctgagacccagcagcagctacagcctgaaccaggacaaggtggccagcgtgttctacaccgtggtgatccccatgctgaaccccctgatctacagcctgagaagcaaggaggtgaagaaggccctggccaacgtgatcagcagaaagagaaccagcagcttcctgtag

SEQ ID NO: 20514 - DNA, 933 bp, Artificial Sequence
  Description of Artificial Sequence: Synthetic coding sequence
atggaggaggagaacgccaccctgctgaccgagttcgtgctgaccggcttcctgtaccagccccagtggaagatccccctgttcctggccttcctggtgatctacctgatcaccatcatgggcaacctgggcctgatcgccgtgatctggaaggacccccacctgcacatccccatgtacctgctgctgggcaacctggccttcgtggacgccctgctgagcagcagcgtgaccctgaagatgctgatcaacttcctggccaagagcaagatgatcagcctgagcgagtgcaagatccagctgttcagcttcgccatcagcgtgaccaccgagtgcttcctgctggccaccatggcctacgacagatacgtggccatctgcaagcccctgctgtaccccgccatcatgaccaacggcctgtgcatcagactgctgatcctgagctacgtgggcggcctgctgcacgccctgatccacgagggcttcctgttcagactgaccttctgcaacagcaacatcatccagcacttctactgcgacatcatccccctgctgaagatcagctacaccgacagcagcatcaacttcctgatggtgttcatcttcgccggcagcatccaggtgttcaccatcggcaccgtgctgatcagctacatcttcgtgctgtacaccatcctgaagaagaagagcgtgaagggcatgagaaaggccttcagcacctgcggcgcccacctgctgagcgtgagcctgtactacggccccctggccttcatgtacatgggcagcgccagcccccaggccgacgaccaggacatgatggagagcctgttctacaccgtgatcgtgcccctgctgaaccccatgatctacagcctgagaaacaagcaggtgatcgccagcttcaccaagatgttcaagagaaacgacgtgtag

SEQ ID NO: 20515 - DNA, 945 bp, Artificial Sequence
  Description of Artificial Sequence: Synthetic coding sequence
atgagcaacgaggacatggagcaggacaacaccaccctgctgaccgagttcgtgctgaccggcctgacctaccagcccgagtggaagatgcccctgttcctggtgttcctggtgatctacctgatcaccatcgtgtggaacctgggcctgatcgccctgatctggaacgacccccagctgcacatccccatgtacttcttcctgggcagcctggccttcgtggacgcctggatcagcagcaccgtgacccccaagatgctggtgaacttcctggccaagaacagaatgatcagcctgagcgagtgcatgatccagttcttcagcttcgccttcggcggcaccaccgagtgcttcctgctggccaccatggcctacgacagatacgtggccatctgcaagcccctgctgtaccccgtgatcatgaacaacagcctgtgcatcagactgctggccttcagcttcctgggcggcttcctgcacgccctgatccacgaggtgctgatcttcagactgaccttctgcaacagcaacatcatccaccacttctactgcgacatcatccccctgttcatgatcagctgcaccgaccccagcatcaacttcctgatggtgttcatcctgagcggcagcatccaggtgttcaccatcgtgaccgtgctgaacagctacaccttcgccctgttcaccatcctgaagaagaagagcgtgagaggcgtgagaaaggccttcagcacctgcggcgcccacctgctgagcgtgagcctgtactacggccccctgatcttcatgtacctgagacccgccagcccccaggccgacgaccaggacatgatcgacagcgtgttctacaccatcatcatccccctgctgaaccccatcatctacagcctgagaaacaagcaggtgatcgacagcttcaccaagatggtgaagagaaacgtgtag

SEQ ID NO: 20516 - DNA, 945 bp, Artificial Sequence
  Description of Artificial Sequence: Synthetic coding sequence
atggagttcaccgacagaaactacaccctggtgaccgagttcatcctgctgggcttccccaccagacccgagctgcagatcgtgctgttcctgatgttcctgaccctgtacgccatcatcctgatcggcaacatcggcctgatgctgctgatcagaatcgacccccacctgcagacccccatgtacttcttcctgagcaacctgagcttcgtggacctgtgctacttcagcgacatcgtgcccaagatgctggtgaacttcctgagcgagaacaagagcatcagctactacggctgcgccctgcagttctacttcttctgcaccttcgccgacaccgagagcttcatcctggccgccatggcctacgacagatacgtggccatctgcaaccccctgctgtacaccgtggtgatgagcagaggcatctgcatgagactgatcgtgctgagctacctgggcggcaacatgagcagcctggtgcacaccagcttcgccttcatcctgaagtactgcgacaagaacgtgatcaaccacttcttctgcgacctgccccccctgctgaagctgagctgcaccgacaccaccatcaacgagtggctgctgagcacctacggcagcagcgtggagatcatctgcttcatcatcatcatcatcagctacttcttcatcctgctgagcgtgctgaagatcagaagcttcagcggcagaaagaagaccttcagcacctgcgccagccacctgaccagcgtgaccatctaccagggcaccctgctgttcatctacagcagacccagctacctgtacagccccaacaccgacaagatcatcagcgtgttctacaccatcttcatccccgtgctgaaccccctgatctacagcctgagaaacaaggacgtgaaggacgccgccgagaaggtgctgagaagcaaggtggacagcagctag

SEQ ID NO: 20517 - DNA, 939 bp, Artificial Sequence
  Description of Artificial Sequence: Synthetic coding sequence
atggccgacgacaacttcaccgtggtgaccgagttcatcctgctgggcctgaccgaccacgccgagctgaaggccgtgctgttcgtggtgttcctggtgatctacgccatcaccctgctgagaaacctgggcatgatcctgctgatccagatcaccagcaagctgcacacccccatgtacttcctgctgagctgcctgagcttcgtggacgcctgctacagcagcgccatcgcccccaagatgctggtgaacctgctggtggtgaaggccaccatcagcttcagcgcctgcatggtgcagcacctgtgcttcggcgtgttcatcaccaccgagggcttcctgctgagcgtgatggcctacgacagatacgtggccatcgtgagccccctgctgtacaccgtggccatgagcgacagaaagtgcgtggagctggtgaccggcagctggatcggcggcatcgtgaacaccctgatccacaccatcagcctgagaagactgagcttctgcagactgaacgccgtgagccacttcttctgcgacatccccagcctgctgaagctgagctgcagcgacaccagcatgaacgagctgctgctgctgaccttcagcggcgtgatcgccatggccaccttcctgaccgtgatcatcagctacatcttcatcgccttcgccagcctgagaatccacagcgccagcggcagacagcaggccttcagcacctgcgccagccacctgaccgccgtgaccatcttctacggcaccctgatcttcagctacatccagcccagcagccagtacttcgtggagcaggagaaggtggtgagcatgttctacaccctgggcatccccatgctgaacctgctgatccacagcctgagaaacaaggacgtgaaggaggccgtgaagagagccatcgagatgaagcacttcctgtgctag

SEQ ID NO: 20518 - DNA, 927 bp, Artificial Sequence
  Description of Artificial Sequence: Synthetic coding sequence
atggccgaggagaaccacaccatgaagaacgagttcatcctgaccggcttcaccgaccaccccgagctgaagaccctgctgttcgtggtgttcttcgccatctacctgatcaccgtggtgggcaacatcagcctggtggccctgatcttcacccacagaagactgcacacccccatgtacatcttcctgggcaacctggccctggtggacagctgctgcgcctgcgccatcacccccaagatgctggagaacttcttcagcgagaacaagagaatcagcctgtacgagtgcgccgtgcagttctacttcctgtgcaccgtggagaccgccgactgcttcctgctggccgccatggcctacgacagatacgtggccatctgcaaccccctgcagtaccacatcatgatgagcaagaagctgtgcatccagatgaccaccggcgccttcatcgccggcaacctgcacagcatgatccacgtgggcctggtgttcagactggtgttctgcggcagcaaccacatcaaccacttctactgcgacatcctgcccctgtacagactgagctgcgtggacccctacatcaacgagctggtgctgttcatcttcagcggcagcgtgcaggtgttcaccatcggcagcgtgctgatcagctacctgtacatcctgctgaccatcttcaagatgaagagcaaggagggcagagccaaggccttcagcacctgcgccagccacttcctgagcgtgagcctgttctacggcagcctgttcttcatgtacgtgagacccaacctgctggaggagggcgacaaggacatccccgccgccatcctgttcaccatcgtggtgcccctgctgaaccccttcatctacagcctgagaaacagagaggtgatcagcgtgctgagaaagatcctgatgaagaagtag

SEQ ID NO: 20519 - DNA, 951 bp, Artificial Sequence
  Description of Artificial Sequence: Synthetic coding sequence
atggtggaggagaaccacaccatgaagaacgagttcatcctgaccggcttcaccgaccaccccgagctgaagaccctgctgttcgtggtgttcttcgccatctacctgatcaccgtggtgggcaacatcagcctggtggccctgatcttcacccactgcagactgcacacccccatgtacatcttcctgggcaacctggccctggtggacagctgctgcgcctgcgccatcacccccaagatgctggagaacttcttcagcgagggcaagagaatcagcctgtacgagtgcgccgtgcagttctacttcctgtgcaccgtggagaccgccgactgcttcctgctggccgccgtggcctacgacagatacgtggccatctgcaaccccctgcagtaccacatcatgatgagcaagaagctgtgcatccagatgaccaccggcgccttcatcgccggcaacctgcacagcatgatccacgtgggcctggtgttcagactggtgttctgcggcctgaaccacatcaaccacttctactgcgacaccctgcccctgtacagactgagctgcgtggaccccttcatcaacgagctggtgctgttcatcttcagcggcagcgtgcaggtgttcaccatcggcagcgtgctgatcagctacctgtacatcctgctgaccatcttcagaatgaagagcaaggagggcagagccaaggccttcagcacctgcgccagccacttcagcagcgtgagcctgttctacggcagcatcttcttcctgtacatcagacccaacctgctggaggagggcggcaacgacatccccgccgccatcctgttcaccatcgtggtgcccctgctgaaccccttcatctacagcctgagaaacaaggaggtgatcagcgtgctgagaaagatcctgctgaagatcaagagccagggcagcgtgaacaagtag

SEQ ID NO: 20520 - DNA, 966 bp, Artificial Sequence
  Description of Artificial Sequence: Synthetic coding sequence
atggccagagagaaccacagcctggccgccgagttcatcctgatcggcttcaccaactaccccgagctgaagaccctgctgttcgtggtgttcagcgccatctacctggtgaccatggtgggcaacctgggcctggtggccctgatctacgtggagagaagactgctgacccccatgtacatcttcctgggcaacctggccctgatggacagctgctgcagctgcgccgtgacccccaagatgctggagaacttcttcagcgaggacagaatcatcagcctgtacgagtgcatggcccagttctacttcctgtgcctggccgagaccaccgactgcttcctgctggccaccatggcctacgacagatacgtggccatctgccaccccctgcagtaccacaccatgatgagcaagaccctgtgcatcagaatgaccaccggcgccttcaaggccggcaacctgcacagcatgatccacgtgggcctgctgctgagactgaccttctgcagaagcaacaagatccaccacttcttctgcgacatcctgcccctgtacagactgagctgcaccgaccccagcatcaacgagctgatgatctacatcttcagcatccccatccagatcttcaccatcgccaccgtgctgatcagctacctgtgcatcctgctgaccgtgttcaagatgaagagcaaggagggcagaggcaaggccttcagcacctgcgccagccacttcctgagcgtgagcatcttctacatctgcctgctgatgtacatcggccccagcgaggagggcgacaaggacacccccgtggccatcttctacgccatcgtgatccccctgctgaaccccttcatctacagcctgagaaacaaggaggtgatcaacgtgctgaagaagatcatgagaaactacaacatcctgaagcagacctgcagcatcgccaacctgttcctgatctactag

SEQ ID NO: 20521 - DNA, 936 bp, Artificial Sequence
  Description of Artificial Sequence: Synthetic coding sequence
atgggcaaggagaactgcaccaccgtggccgagttcatcctgctgggcctgagcgacgtgcccgagctgagagtgtgcctgttcctgctgttcctgctgatctacggcgtgaccctgctggccaacctgggcatgatcgccctgatccaggtgagcagcagactgcacacccccatgtacttcttcctgagccacctgagcagcgtggacttctgctacagcagcatcatcgtgcccaagatgctggccaacatcttcaacaaggacaaggccatcagcttcctgggctgcatggtgcagttctacctgttctgcacctgcgtggtgaccgaggtgttcctgctggccgtgatggcctacgacagattcgtggccatctgcaaccccctgctgtacaccgtgaccatgagctggaaggtgagagtggagctggccagctgctgctacttctgcggcaccgtgtgcagcctgatccacctgtgcctggccctgagaatccccttctacagaagcaacgtgatcaaccacttcttctgcgacctgccccccgtgctgagcctggcctgcagcgacatcaccgtgaacgagaccctgctgttcctggtggccaccctgaacgagagcgtgaccatcatgatcatcctgaccagctacctgctgatcctgaccaccatcctgaagatgggcagcgccgagggcagacacaaggccttcagcacctgcgccagccacctgaccgccatcaccgtgttccacggcaccgtgctgagcatctactgcagacccagcagcggcaacagcggcgacgccgacaaggtggccaccgtgttctacaccgtggtgatccccatgctgaacagcgtgatctacagcctgagaaacaaggacgtgaaggaggccctgagaaaggtgatgggcagcaagatccacagctag

SEQ ID NO: 20522 - DNA, 936 bp, Artificial Sequence
  Description of Artificial Sequence: Synthetic coding sequence
atgggcaaggagaactgcaccaccgtggccgagttcatcctgctgggcctgagcgacgtgcccgagctgagagtgtgcctgttcctgctgttcctgctgatctacggcgtgaccctgctggccaacctgggcatgaccgccctgatccaggtgagcagcagactgcacacccccgtgtacttcttcctgagccacctgagcttcgtggacttctgctacagcagcatcatcgtgcccaagatgctggccaacatcttcaacaaggacaaggccatcagcttcctgggctgcatggtgcagttctacctgttctgcacctgcggcgtgaccgaggtgttcctgctggccgtgatggcctacgacagattcgtggccatctgcaaccccctgctgtacatggtgaccatgagccagaagctgagagtggagctgaccagctgctgctacttctgcggcaccgtgtgcagcctgatccacagcagcctggccctgagaatcctgttctacagaagcaacgtgatcaaccacttcttctgcgacctgccccccctgctgagcctggcctgcagcgacgtgaccgtgaacgagaccctgctgttcctggtggccaccctgaacgagagcgtgaccatcatgatcatcctgaccagctacctgctgatcctgaccaccatcctgaagatccacagcgccgagagcagacacaaggccttcagcacctgcgccagccacctgaccgccatcaccgtgagccacggcaccatcctgtacatctactgcagacccagcagcggcaacagcggcgacgtggacaaggtggccaccgtgttctacaccgtggtgatccccatgctgaaccccctgatctacagcctgagaaacaaggacgtgaacaaggccctgagaaaggtgatgggcagcaagatccacagctag

SEQ ID NO: 20523 - DNA, 948 bp, Artificial Sequence
  Description of Artificial Sequence: Synthetic coding sequence
atgttcagccccaaccacaccatcgtgaccgagttcatcctgctgggcctgaccgacgaccccgtgctggagaagatcctgttcggcgtgttcctggccatctacctgatcaccctggccggcaacctgtgcatgatcctgctgatcagaaccaacagccacctgcagacccccatgtacttcttcctgggccacctgagcttcgtggacatctgctacagcagcaacgtgacccccaacatgctgcacaacttcctgagcgagcagaagaccatcagctacgccggctgcttcacccagtgcctgctgttcatcgccctggtgatcaccgagttctacatcctggccagcatggccctggacagatacgtggccatctgcagccccctgcactacagcagcagaatgagcaagaacatctgcgtgtgcctggtgaccatcccctacatgtacggcttcctgagcggcttcagccagagcctgctgaccttccacctgagcttctgcggcagcctggagatcaaccacttctactgcgccgacccccccctgatcatgctggcctgcagcgacaccagagtgaagaagatggccatgttcgtggtggccggcttcaacctgagcagcagcctgttcatcatcctgctgagctacctgttcatcttcgccgccatcttcagaatcagaagcgccgagggcagacacaaggccttcagcacctgcgccagccacctgaccatcgtgaccctgttctacggcaccctgttctgcatgtacgtgagaccccccagcgagaagagcgtggaggagagcaagatcaccgccgtgttctacaccttcctgagccccatgctgaaccccctgatctacagcctgagaaacaccgacgtgatcctggccatgcagcagatgatcagaggcaagagcttccacaagatcgccgtgtag

SEQ ID NO: 20524 - DNA, 948 bp, Artificial Sequence
  Description of Artificial Sequence: Synthetic coding sequence
atgctgagccccaaccacaccatcgtgaccgagttcatcctgctgggcctgaccgacgaccccgtgctggagaagatcctgttcggcgtgttcctggccatctacctgatcaccctggccggcaacctgtgcatgatcctgctgatcagaaccaacagccagctgcagacccccatgtacttcttcctgggccacctgagcttcgtggacatctgctacagcagcaacgtgacccccaacatgctgcacaacttcctgagcgagcagaagaccatcagctacgccggctgcttcacccagtgcctgctgttcatcgccctggtgatcaccgagttctacttcctggccagcatggccctggacagatacgtggccatctgcagccccctgcactacagcagcagaatgagcaagaacatctgcatcagcctggtgaccgtgccctacatgtacggcttcctgaacggcctgagccagaccctgctgaccttccacctgagcttctgcggcagcctggagatcaaccacttctactgcgccgacccccccctgatcatgctggcctgcagcgacaccagagtgaagaagatggccatgttcgtggtggccggcttcaccctgagcagcagcctgttcatcatcctgctgagctacctgttcatcttcgccgccatcttcagaatcagaagcgccgagggcagacacaaggccttcagcacctgcgccagccacctgaccatcgtgaccctgttctacggcaccctgttctgcatgtacgtgagaccccccagcgagaagagcgtggaggagagcaagatcatcgccgtgttctacaccttcctgagccccatgctgaaccccctgatctacagcctgagaaacagagacgtgatcctggccatccagcagatgatcagaggcaagagcttctgcaagatcgccgtgtag

SEQ ID NO: 20525 - DNA, 918 bp, Artificial Sequence
  Description of Artificial Sequence: Synthetic coding sequence
atgagcaacaccaacggcagcgccatcaccgagttcatcctgctgggcctgaccgactgccccgagctgcagagcctgctgttcgtgctgttcctggtggtgtacctggtgaccctgctgggcaacctgggcatgatcatgctgatgagactggacagcagactgcacacccccatgtacttcttcctgaccaacctggccttcgtggacctgtgctacaccagcaacgccaccccccagatgagcaccaacatcgtgagcgagaagaccatcagcttcgccggctgcttcacccagtgctacatcttcatcgccctgctgctgaccgagttctacatgctggccgccatggcctacgacagatacgtggccatctacgaccccctgagatacagcgtgaagaccagcagaagagtgtgcatctgcctggccaccttcccctacgtgtacggcttcagcgacggcctgttccaggccatcctgaccttcagactgaccttctgcagaagcagcgtgatcaaccacttctactgcgccgacccccccctgatcaagctgagctgcagcgacacctacgtgaaggagcacgccatgttcatcagcgccggcttcaacctgagcagcagcctgaccatcgtgctggtgagctacgccttcatcctggccgccatcctgagaatcaagagcgccgagggcagacacaaggccttcagcacctgcggcagccacatgatggccgtgaccctgttctacggcaccctgttctgcatgtacatcagaccccccaccgacaagaccgtggaggagagcaagatcatcgccgtgttctacaccttcgtgagccccgtgctgaaccccctgatctacagcctgagaaacaaggacgtgaagcaggccctgaagaacgtgctgagatag

SEQ ID NO: 20526 - DNA, 924 bp, Artificial Sequence
  Description of Artificial Sequence: Synthetic coding sequence
atgctgaacttcaccgacgtgaccgagttcatcctgctgggcctgaccagcagaagagagtggcaggtgctgttcttcatcatcttcctggtggtgtacatcatcaccatggtgggcaacatcggcatgatggtgctgatcaaggtgagcccccagctgaacaaccccatgtacttcttcctgagccacctgagcttcgtggacgtgtggttcagcagcaacgtgacccccaagatgctggagaacctgctgagcgacaagaagaccatcacctacgccggctgcctggtgcagtgcttcttcttcatcgccctggtgcacgtggagatcttcatcctggccgccatggccttcgacagatacatggccatcggcaaccccctgctgtacggcagcaagatgagcagagtggtgtgcatcagactgatcaccttcccctacatctacggcttcctgaccagcctggccgccaccctgtggacctacggcctgtacttctgcggcaagatcgagatcaaccacttctactgcgccgacccccccctgatcaagatggcctgcgccggcaccttcgtgaaggagtacaccatgatcatcctggccggcatcaacttcacctacagcctgaccgtgatcatcatcagctacctgttcatcctgatcgccatcctgagaatgagaagcgccgagggcagacagaaggccttcagcacctgcggcagccacctgaccgccgtgatcatcttctacggcaccctgatcttcatgtacctgagaagacccaccgaggagagcgtggagcagggcaagatggtggccgtgttctacaccaccgtgatccccatgctgaaccccatgatctacagcctgagaaacaaggacgtgaagaaggccatgatgaaggtgatcagcagaagctgctag

SEQ ID NO: 20527 - DNA, 936 bp, Artificial Sequence
  Description of Artificial Sequence: Synthetic coding sequence
atgagaagaaactgcaccctggtgaccgagttcatcctgctgggcctgaccagcagaagagagctgcagatcctgctgttcaccctgttcctggccatctacatggtgaccgtggccggcaacctgggcatgatcgtgctgatccaggccaacgcctggctgcacatgcccatgtacttcttcctgagccacctgagcttcgtggacctgtgcttcagcagcaacgtgacccccaagatgctggagatcttcctgagcgagaagaagagcatcagctaccccgcctgcctggtgcagtgctacctgttcatcgccctggtgcacgtggagatctacatcctggccgtgatggccttcgacagatacatggccatctgcaaccccctgctgtacggcagcagaatgagcaagagcgtgtgcagcttcctgatcaccgtgccctacgtgtacggcgccctgaccggcctgatggagaccatgtggacctacaacctggccttctgcggccccaacgagatcaaccacttctactgcgccgacccccccctgatcaagctggcctgcagcgacacctacaacaaggagctgagcatgttcatcgtggccggctggaacctgagcttcagcctgttcatcatctgcatcagctacctgtacatcttccccgccatcctgaagatcagaagcaccgagggcagacagaaggccttcagcacctgcggcagccacctgaccgccgtgaccatcttctacgccaccctgttcttcatgtacctgagaccccccagcaaggagagcgtggagcagggcaagatggtggccgtgttctacaccaccgtgatccccatgctgaacctgatcatctacagcctgagaaacaagaacgtgaaggaggccctgatcaaggagctgagcatgaagatctacttcagctag

SEQ ID NO: 20528 - DNA, 933 bp, Artificial Sequence
  Description of Artificial Sequence: Synthetic coding sequence
atgcccaacttcaccgacgtgaccgagttcaccctgctgggcctgacctgcagacaggagctgcaggtgctgttcttcgtggtgttcctggccgtgtacatgatcaccctgctgggcaacatcggcatgatcatcctgatcagcatcagcccccagctgcagagccccatgtacttcttcctgagccacctgagcttcgccgacgtgtgcttcagcagcaacgtgacccccaagatgctggagaacctgctgagcgagaccaagaccatcagctacgtgggctgcctggtgcagtgctacttcttcatcgccgtggtgcacgtggaggtgtacatcctggccgtgatggccttcgacagatacatggccggctgcaaccccctgctgtacggcagcaagatgagcagaaccgtgtgcgtgagactgatcagcgtgccctacgtgtacggcttcagcgtgagcctgatctgcaccctgtggacctacggcctgtacttctgcggcaacttcgagatcaaccacttctactgcgccgacccccccctgatccagatcgcctgcggcagagtgcacatcaaggagatcaccatgatcgtgatcgccggcatcaacttcacctacagcctgagcgtggtgctgatcagctacaccctgatcgtggtggccgtgctgagaatgagaagcgccgacggcagaagaaaggccttcagcacctgcggcagccacctgaccgccgtgagcatgttctacggcacccccatcttcatgtacctgagaagacccaccgaggagagcgtggagcagggcaagatggtggccgtgttctacaccaccgtgatccccatgctgaaccccatgatctacagcctgagaaacaaggacgtgaaggaggccgtgaacaaggccatcaccaagacctacgtgagacagtag

SEQ ID NO: 20529 - DNA, 969 bp, Artificial Sequence
  Description of Artificial Sequence: Synthetic coding sequence
atgaacagcctgaaggacggcaaccacaccgccctgaccggcttcatcctgctgggcctgaccgacgaccccatcctgagagtgatcctgttcatgatcatcctgagcggcaacctgagcatcatcatcctgatcagaatcagcagccagctgcaccaccccatgtacttcttcctgagccacctggccttcgccgacatggcctacagcagcagcgtgacccccaacatgctggtgaacttcctggtggagagaaacaccgtgagctacctgggctgcgccatccagctgggcagcgccgccttcttcgccaccgtggagtgcgtgctgctggccgccatggcctacgacagattcgtggccatctgcagccccctgctgtacagcaccaagatgagcacccaggtgagcgtgcagctgctgctggtggtgtacatcgccggcttcctgatcgccgtgagctacaccaccagcttctacttcctgctgttctgcggccccaaccaggtgaaccacttcttctgcgacttcgcccccctgctggagctgagctgcagcgacatcagcgtgagcaccgtggtgctgagcttcagcagcggcagcatcatcgtggtgaccgtgtgcgtgatcgccgtgtgctacatctacatcctgatcaccatcctgaagatgagaagcaccgagggccaccacaaggccttcagcacctgcaccagccacctgaccgtggtgaccctgttctacggcaccatcaccttcatctacgtgatgcccaacttcagctacagcaccgaccagaacaaggtggtgagcgtgctgtacaccgtggtgatccccatgctgaaccccctgatctacagcctgagaaacaaggagatcaagggcgccctgaagagagagctggtgagaaagatcctgagccacgacgcctgctacttcagcagaaccagcaacaacgacatcacctag

SEQ ID NO: 20530 - DNA, 936 bp, Artificial Sequence
  Description of Artificial Sequence: Synthetic coding sequence
atgggcaccggcaacgacaccaccgtggtggagttcaccctgctgggcctgagcgaggacaccaccgtgtgcgccatcctgttcctggtgttcctgggcatctacgtggtgaccctgatgggcaacatcagcatcatcgtgctgatcagaagaagccaccacctgcacacccccatgtacatcttcctgtgccacctggccttcgtggacatcggctacagcagcagcgtgacccccgtgatgctgatgagcttcctgagaaaggagaccagcctgcccgtggccggctgcgtggcccagctgtgcagcgtggtgaccttcggcaccgccgagtgcttcctgctggccgccatggcctacgacagatacgtggccatctgcagccccctgctgtacagcacctgcatgagccccggcgtgtgcatcatcctggtgggcatgagctacctgggcggctgcgtgaacgcctggaccttcatcggctgcctgctgagactgagcttctgcggccccaacaaggtgaaccacttcttctgcgactacagccccctgctgaagctggcctgcagccacgacttcaccttcgagatcatccccgccatcagcagcggcagcatcatcgtggccaccgtgtgcgtgatcgccatcagctacatctacatcctgatcaccatcctgaagatgcacagcaccaagggcagacacaaggccttcagcacctgcaccagccacctgaccgccgtgaccctgttctacggcaccatcaccttcatctacgtgatgcccaagagcagctacagcaccgaccagaacaaggtggtgagcgtgttctacaccgtggtgatccccatgctgaaccccctgatctacagcctgagaaacaaggagatcaagggcgccctgaagagagagctgagaatcaagatcttcagctag

SEQ ID NO: 20531 - DNA, 975 bp, Artificial Sequence
  Description of Artificial Sequence: Synthetic coding sequence
atggccgaggtgaacatcatctacgtgaccgtgttcatcctgaagggcatcaccaacagacccgagctgcaggccccctgcttcggcgtgttcctggtgatctacctggtgaccgtgctgggcaacctgggcctgatcaccctgatcaagatcgacaccagactgcacacccccatgtactacttcctgagccacctggccttcgtggacctgtgctacagcagcgccatcacccccaagatgatggtgaacttcgtggtggagagaaacaccatccccttccacgcctgcgccacccagctgggctgcttcctgaccttcatgatcaccgagtgcttcctgctggccagcatggcctacgactgctacgtggccatctgcagccccctgcactacagcaccctgatgagcagaagagtgtgcatccagctggtggccgtgccctacatctacagcttcctggtggccctgttccacaccgtgatcaccttcagactgacctactgcggccccaacctgatcaaccacttctactgcgacgacctgcccttcctggccctgagctgcagcgacacccacatgaaggagatcctgatcttcgccttcgccggcttcgacatgatcagcagcagcagcatcgtgctgaccagctacatcttcatcatcgccgccatcctgagaatcagaagcacccagggccagcacaaggccatcagcacctgcggcagccacatggtgaccgtgaccatcttctacggcaccctgatcttcatgtacctgcagcccaagagcaaccacagcctggacaccgacaagatggccagcgtgttctacaccgtggtgatccccatgctgaaccccctgatctacagcctgagaaacaaggaggtgaaggacgccagcaagaaggccctggacaagggctgcgagaacctgcagatcctgaccttcctgaagatcagaaagctgtactag

SEQ ID NO: 20532 - DNA, 981 bp, Artificial Sequence
  Description of Artificial Sequence: Synthetic coding sequence
atgagcggcctgcccagcgacatggacctgtacaagctgcagctgaacaacttcaccgaggtgaccatgttcatcctgatcagcttcaccgaggagttcgacgtgcaggtgttcctgttcctgctgttcctggccatctacctgttcaccctgatcggcaacctgggcctggtggtgcccatcatcggcgacttctggctgcacagccccatgtactacttcctgggcgtgctgagcttcctggacgtgtgctacagcaccgtggtgacccccaagatgctggtgaacttcctggccaagaacaagagcatcagcttcctgggctgcgccacccagatgttcctggcctgcaccttcggcaccaccgagtgcttcctgctggccgccatggcctacgacagatacgtggccatctacaaccccctgctgtacagcgtgagcatgagccccagagtgtacgtgcccctgatcaccgccagctacgtggccagcatcctgcacgccaccatccacaccgtggccaccttcagcctgagcttctgcggcagcaacgagatcagacacgtgttctgcaacatgccccccctgctggccatcagctgcagcgacacccacgtgatccagctgctgttcttctacttcgtgggcagcatcgagatcgtgaccatcctgatcgtgctgatcagctacggcttcatcctgctggccatcctgaagatgcagagcgccgagggcagaagaaaggtgttcagcacctgcggcgcccacctgaccggcgtgaccatctaccacggcaccatcctgttcatgtacgtgagacccagcagcagctacaccagcgacaacgacatgatcgtgagcatcttctacaccatcgtgatccccatgctgaaccccatcatctacagcctgagaaacaaggacgtgaaggaggccatcaagagactgctggtgagaaactggttcatcaacaagctgtag

SEQ ID NO: 20533 - DNA, 1080 bp, Artificial Sequence
  Description of Artificial Sequence: Synthetic coding sequence
atgagctacagcatctacaagagcaccgtgaacatccccctgagccacggcgtggtgcacagcttctgccacaacatgaactgcaacttcatgcacatcttcaagttcgtgctggacttcaacatgaagaacgtgaccgaggtgaccctgttcgtgctgaagggcttcaccgacaacctggagctgcagaccatcttcttcttcctgttcctggccatctacctgttcaccctgatgggcaacctgggcctgatcctggtggtgatcagagacagccagctgcacaagcccatgtactacttcctgagcatgctgagcagcgtggacgcctgctacagcagcgtgatcacccccaacatgctggtggacttcaccaccaagaacaaggtgatcagcttcctgggctgcgtggcccaggtgttcctggcctgcagcttcggcaccaccgagtgcttcctgctggccgccatggcctacgacagatacgtggccatctacaaccccctgctgtacagcgtgagcatgagccccagagtgtacatgcccctgatcaacgccagctacgtggccggcatcctgcacgccaccatccacaccgtggccaccttcagcctgagcttctgcggcgccaacgagatcagaagagtgttctgcgacatcccccccctgctggccatcagctacagcgacacccacaccaaccagctgctgctgttctacttcgtgggcagcatcgagctggtgaccatcctgatcgtgctgatcagctacggcctgatcctgctggccatcctgaagatgtacagcgccgagggcagaagaaaggtgttcagcacctgcggcgcccacctgaccggcgtgagcatctactacggcaccatcctgttcatgtacgtgagacccagcagcagctacgccagcgaccacgacatgatcgtgagcatcttctacaccatcgtgatccccctgctgaaccccgtgatctacagcctgagaaacaaggacgtgaaggacagcatgaagaagatgttcggcaagaaccaggtgatcaacaaggtgtacttccacaccaagaagtag

SEQ ID NO: 20534 - DNA, 1023 bp, Artificial Sequence
  Description of Artificial Sequence: Synthetic coding sequence
atggacagcaccttcaccggctacaacctgtacaacctgcaggtgaagaccgagatggacaagctgagcagcggcctggacatctacagaaaccccctgaagaacaagaccgaggtgaccatgttcatcctgaccggcttcaccgacgacttcgagctgcaggtgttcctgttcctgctgttcttcgccatctacctgttcaccctgatcggcaacctgggcctggtggtgctggtgatcgaggacagctggctgcacaaccccatgtactacttcctgagcgtgctgagcttcctggacgcctgctacagcaccgtggtgacccccaagatgctggtgaacttcctggccaagaacaagagcatcagcttcatcggctgcgccacccagatgctgctgttcgtgaccttcggcaccaccgagtgcttcctgctggccgccatggcctacgaccactacgtggccatctacaaccccctgctgtacagcgtgagcatgagccccagagtgtacgtgcccctgatcaccgccagctacgtggccggcatcctgcacgccaccatccacatcgtggccaccttcagcctgagcttctgcggcagcaacgagatcagacacgtgttctgcgacatgccccccctgctggccatcagctgcagcgacacccacaccaaccagctgctgctgttctacttcgtgggcagcatcgagatcgtgaccatcctgatcgtgctgatcagctgcgacttcatcctgctgagcatcctgaagatgcacagcgccaagggcagacagaaggccttcagcacctgcggcagccacctgaccggcgtgaccatctaccacggcaccatcctggtgagctacatgagacccagcagcagctacgccagcgaccacgacatcatcgtgagcatcttctacaccatcgtgatccccaagctgaaccccatcatctacagcctgagaaacaaggaggtgaagaaggccgtgaagaagatgctgaagctggtgtacaagtag

SEQ ID NO: 20535 - DNA, 966 bp, Artificial Sequence
  Description of Artificial Sequence: Synthetic coding sequence
atggagagaaagaaccagaccgccatcaccgagttcatcatcctgggcttcagcaacctgaacgagctgcagttcctgctgttcaccatcttcttcctgacctacttctgcaccctgggcggcaacatcctgatcatcctgaccaccgtgaccgacccccacctgcacacccccatgtactacttcctgggcaacctggccttcatcgacatctgctacaccaccagcaacgtgccccagatgatggtgcacctgctgagcaagaagaagagcatcagctacgtgggctgcgtggtgcagctgttcgccttcgtgttcttcgtgggcagcgagtgcctgctgctggccgccatggcctacgacagatacatcgccatctgcaaccccctgagatacagcgtgatcctgagcaaggtgctgtgcaaccagctggccgccagctgctgggccgccggcttcctgaacagcgtggtgcacaccgtgctgaccttctgcctgcccttctgcggcaacaaccagatcaactacttcttctgcgacatcccccccctgctgatcctgagctgcggcaacaccagcgtgaacgagctggccctgctgagcaccggcgtgttcatcggctggacccccttcctgtgcatcgtgctgagctacatctgcatcatcagcaccatcctgagaatccagagcagcgagggcagaagaaaggccttcagcacctgcgccagccacctggccatcgtgttcctgttctacggcagcgccatcttcacctacgtgagacccatcagcacctacagcctgaagaaggacagactggtgagcgtgctgtacagcgtggtgacccccatgctgaaccccatcatctacaccctgagaaacaaggacatcaaggaggccgtgaagaccatcggcagcaagtggcagccccccatcagcagcctggacagcaagctgacctactag

SEQ ID NO: 20536 - DNA, 966 bp, Artificial Sequence; identical to SEQ ID NO: 20535
  Description of Artificial Sequence: Synthetic coding sequence

SEQ ID NO: 20537 - DNA, 966 bp, Artificial Sequence; identical to SEQ ID NO: 20535
  Description of Artificial Sequence: Synthetic coding sequence

SEQ ID NO: 20538 - DNA, 966 bp, Artificial Sequence; identical to SEQ ID NO: 20535
  Description of Artificial Sequence: Synthetic coding sequence

SEQ ID NO: 20539 - DNA, 966 bp, Artificial Sequence; identical to SEQ ID NO: 20535
  Description of Artificial Sequence: Synthetic coding sequence

SEQ ID NO: 20540 - DNA, 966 bp, Artificial Sequence; identical to SEQ ID NO: 20535
  Description of Artificial Sequence: Synthetic coding sequence

SEQ ID NO: 20541 - DNA, 966 bp, Artificial Sequence; identical to SEQ ID NO: 20535
  Description of Artificial Sequence: Synthetic coding sequence

SEQ ID NO: 20542 - DNA, 966 bp, Artificial Sequence; identical to SEQ ID NO: 20535
  Description of Artificial Sequence: Synthetic coding sequence

SEQ ID NO: 20543 - DNA, 966 bp, Artificial Sequence; identical to SEQ ID NO: 20535
  Description of Artificial Sequence: Synthetic coding sequence

SEQ ID NO: 20544 - DNA, 933 bp, Artificial Sequence
  Description of Artificial Sequence: Synthetic coding sequence
atggactgggagaactgcagcagcctgaccgacttcttcctgctgggcatcaccaacaaccccgagatgaaggtgaccctgttcgccgtgttcctggccgtgtacatcatcaacttcagcgccaacctgggcatgatcgtgctgatcagaatggactaccagctgcacacccccatgtacttcttcctgagccacctgagcttctgcgacctgtgctacagcaccgccaccggccccaagatgctggtggacctgctggccaagaacaagagcatccccttctacggctgcgccctgcagttcctggtgttctgcatcttcgccgacagcgagtgcctgctgctgagcgtgatggccttcgacagatacaaggccatcatcaaccccctgctgtacaccgtgaacatgagcagcagagtgtgctacctgctgctgaccggcgtgtacctggtgggcatcgccgacgccctgatccacatgaccctggccttcagactgtgcttctgcggcagcaacgagatcaaccacttcttctgcgacatcccccccctgctgctgctgagcagaagcgacacccaggtgaacgagctggtgctgttcaccgtgttcggcttcatcgagctgagcaccatcagcggcgtgttcatcagctactgctacatcatcctgagcgtgctggagatccacagcgccgagggcagattcaaggccctgagcacctgcaccagccacctgagcgccgtggccatcttccagggcaccctgctgttcatgtacttcagacccagcagcagctacagcctggaccaggacaagatgaccagcctgttctacaccctggtggtgcccatgctgaaccccctgatctacagcctgagaaacaaggacgtgaaggaggccctgaagaagctgaagaacaagatcctgttctag

SEQ ID NO: 20545 - DNA, 942 bp, Artificial Sequence
  Description of Artificial Sequence: Synthetic coding sequence
atgagcatcatcaacaccagctacgtggagatcaccaccttcttcctggtgggcatgcccggcctggagtacgcccacatctggatcagcatccccatctgcagcatgtacctgatcgccatcctgggcaacggcaccatcctgttcatcatcaagaccgagcccagcctgcacggccccatgtactacttcctgagcatgctggccatgagcgacctgggcctgagcctgagcagcctgcccaccgtgctgagcatcttcctgttcaacgcccccgagaccagcagcagcgcctgcttcgcccaggagttcttcatccacggcttcagcgtgctggagagcagcgtgctgctgatcatgagcttcgacagattcctggccatccacaaccccctgagatacaccagcatcctgaccaccgtgagagtggcccagatcggcatcgtgttcagcttcaagagcatgctgctggtgctgcccttccccttcaccctgagaagcctgagatactgcaagaagaaccagctgagccacagctactgcctgcaccaggacgtgatgaagctggcctgcagcgacaacagaatcgacgtgatctacggcttcttcggcgccctgtgcctgatggtggacttcatcctgatcgccgtgagctacaccctgatcctgaagaccgtgcccggcatcgccagcaagaaggaggagctgaaggccctgaacacctgcgtgagccacatctgcgccgtgatcatcttctacctgcccatcatcaacctggccgtggtgcacagattcgccggccacgtgagccccctgatcaacgtgctgatggccaacgtgctgctgctggtgccccccctgatgaagcccatcgtgtactgcgtgaagaccaagcagatcagagtgagagtggtggccaagctgtgccagtggaagatctag

SEQ ID NO: 20546 - DNA, 942 bp, Artificial Sequence
  Description of Artificial Sequence: Synthetic coding sequence
atgagcatcatcaacaccagctacgtggagatcaccaccttcttcctggtgggcatgcccggcctggagtacgcccacatctggatcagcatccccatctgcagcatgtacctgatcgccatcctgggcaacggcaccatcctgttcatcatcaagaccgagcccagcctgcacgagcccatgtactacttcctgagcatgctggccatgagcgacctgggcctgagcctgagcagcctgcccaccgtgctgagcatcttcctgttcaacgcccccgagatcagcagcaacgcctgcttcgcccaggagttcttcatccacggcttcagcgtgctggagagcagcgtgctgctgatcatgagcttcgacagattcctggccatccacaaccccctgagatacaccagcatcctgaccaccgtgagagtggcccagatcggcatcgtgttcagcttcaagagcatgctgctggtgctgcccttccccttcaccctgagaaacctgagatactgcaagaagaaccagctgagccacagctactgcctgcaccaggacgtgatgaagctggcctgcagcgacaacagaatcgacgtgatctacggcttcttcggcgccctgtgcctgatggtggacttcatcctgatcgccgtgagctacaccctgatcctgaagaccgtgctgggcatcgccagcaagaaggagcagctgaaggccctgaacacctgcgtgagccacatctgcgccgtgatcatcttctacctgcccatcatcaacctggccgtggtgcacagattcgccagacacgtgagccccctgatcaacgtgctgatggccaacgtgctgctgctggtgccccccctgaccaaccccatcgtgtactgcgtgaagaccaagcagatcagagtgagagtggtggccaagctgtgccagagaaagatctag

SEQ ID NO: 20547 - DNA, 939 bp, Artificial Sequence
  Description of Artificial Sequence: Synthetic coding sequence
atgagcgtgctgaacaacagcgaggtgaagctgttcctgctgatcggcatccccggcctggagcacgcccacatctggttcagcatccccatctgcctgatgtacctgctggccatcatgggcaactgcaccatcctgttcatcatcaagaccgagcccagcctgcacgagcccatgtactacttcctggccatgctggccgtgagcgacatgggcctgagcctgagcagcctgcccaccatgctgagagtgttcctgttcaacgccatgggcatcagccccaacgcctgcttcgcccaggagttcttcatccacggcttcaccgtgatggagagcagcgtgctgctgatcatgagcctggacagattcctggccatccacaaccccctgagatacagcagcatcctgaccagcaacagagtggccaagatgggcctgatcctggccatcagaagcatcctgctggtgatccccttccccttcaccctgagaagactgaagtactgccagaagaacctgctgagccacagctactgcctgcaccaggacaccatgaagctggcctgcagcgacaacaagaccaacgtgatctacggcttcttcatcgccctgtgcaccatgctggacctggccctgatcgtgctgagctacgtgctgatcctgaagaccatcctgagcatcgccagcctggccgagagactgaaggccctgaacacctgcgtgagccacatctgcgccgtgctgaccttctacgtgcccatcatcaccctggccgccatgcaccacttcgccaagcacaagagccccctggtggtgatcctgatcgccgacatgttcctgctggtgccccccctgatgaaccccatcgtgtactgcgtgaagaccagacagatctgggagaagatcctgggcaagctgctgaacgtgtgcggcagatag

SEQ ID NO: 20548 - DNA, 894 bp, Artificial Sequence
  Description of Artificial Sequence: Synthetic coding sequence
ttcctgctgatcggcatccccggcctggagcacgcccacatctggttcagcatccccatctgcctgatgtacctgctggccatcatgggcaactgcaccatcctgttcatcatcaagaccgagcccagcctgcacgagcccatgtactacttcctggccatgctggccgtgagcgacatgggcctgagcctgagcagcctgcccaccatgctgagagtgttcctgttcaacgccatgggcatcagccccaacgcctgcttcgcccaggagttcttcatccacggcttcaccgtgatggagagcagcgtgctgctgatcatgagcctggacagattcctggccatccacaaccccctgagatacagcagcatcctgaccagcaacagagtggccaagatgggcctgatcctggccatcagaagcatcctgctggtgatccccttccccttcaccctgagaagactgaagtactgccagaagaacctgctgagccacagctactgcctgcaccaggacaccatgaagctggcctgcagcgacaacaagaccaacgtgatctacggcttcttcatcgccctgtgcaccatgctggacctggccctgatcgtgctgagctacgtgctgatcctgaagaccatcctgagcatcgccagcctggccgagagactgaaggccctgaacacctgcgtgagccacatctgcgccgtgctgaccttctacgtgcccatcatcaccctggccgccatgcaccacttcgccaagcacaagagccccctggtggtgatcctgatcgccgacatgttcctgctggtgccccccctgatgaaccccatcgtgtactgcgtgaagaccagacagatctgggagaagatcctgggcatctactgccactag
